US007041490B1

(12) United States Patent
Griffais et al.

(10) Patent No.: US 7,041,490 B1
(45) Date of Patent: May 9, 2006

(54) *CHLAMYDIA TRACHOMATIS* POLYNUCLEOTIDES AND VECTORS, RECOMBINANT HOST CELLS, DNA CHIPS OR KITS CONTAINING THE SAME

(75) Inventors: Remy Griffais, Momtrouge (FR); Susan K. Hoiseth, Fairport, NY (US); Robert John Zagursky, Victor, NY (US); Benjamin J. Metcalf, Rochester, NY (US); Joel A. Peek, Pittsford, NY (US); Banumathi Sankaran, Penfield, NY (US); Leah Diane Fletcher, Geneseo, NY (US)

(73) Assignee: Serono Genetics Institute, S.A., (FR)

( * ) Notice: Subject to any disclaimer, the term of this patent is extended or adjusted under 35 U.S.C. 154(b) by 0 days.

(21) Appl. No.: 09/201,228

(22) Filed: Nov. 30, 1998

Related U.S. Application Data

(60) Provisional application No. 60/107,077, filed on Nov. 4, 1998.

(30) Foreign Application Priority Data

Nov. 28, 1997 (FR) .................................. 97 15041
Dec. 17, 1997 (FR) .................................. 97 16034

(51) Int. Cl.
*C12N 1/21* (2006.01)
*C12N 15/31* (2006.01)

(52) U.S. Cl. .............................. 435/252.3; 435/320.1; 536/23.4; 536/23.7; 536/24.3

(58) Field of Classification Search .................... 435/6, 435/69.1, 325, 440, 252.3, 320.1; 536/23.1, 536/24.1, 24.3–24.33, 23.4, 23.7
See application file for complete search history.

(56) References Cited

U.S. PATENT DOCUMENTS 5,436,327 A * 7/1995 Southern et al. ......... 536/25.34
5,700,637 A * 12/1997 Southern ....................... 435/6
6,207,647 B1 * 3/2001 Black et al. .................. 514/44

FOREIGN PATENT DOCUMENTS

WO WO 89/10977 * 11/1989

OTHER PUBLICATIONS

Genbank Accession No. X68033 (May 2, 1994).*
Genbank Accession No. M 74221 (Feb. 16, 1995).*
Genbank Accession No. Z11839 (Dec. 6, 1996).*
Genbank Accession No. T67502 (Jul. 9, 1997).*
Genbank Accession No. Q54841 (Jul. 15, 1994).*
Genbank Accession No. X63515 (Feb. 17, 1997).*
Genbank Accession No. U76536 (Feb. 1, 1997).*
Genbank Accession No. L35530 (Dec. 20, 1994).*
Genbank Accession No. X 59601 (Dec. 19, 1996).*
Genbank Accession No. N70920 (May 7, 1991).*
*Sigma Catalog* [Published by the Sigma Chemical Company, P.O. Box 14508, Saint Louis, Missouri 63178], pp. 776-778, 1990.*
Cousineau et al., Gene, vol. 120, No. 1, pp. 33-41 (1992).*
Beunis CJ et al., "Inhibition of lipopolysaccharide biosynthesis and cell growth following inactivation of the kdtA gene in *Escherichia coli*", J Biol Chem. Nov. 17, 1995;270(46):27646-52.
Brade H et al., "Chemical and serological investigations on the genus-specific lipopolysaccharide epitope of *Chlamydia*", Proc Natl Acad Sci U S A. Apr. 1987;84(8):2508-12.
Caldwell HD et al., "Monoclonal antibody against a genus-specific antigen of *Chlamydia* species: location of the eptiope on *Chlamydial* lipopolysaccharide", Infect Immun. May 1984;44(2):306-14.

(Continued)

*Primary Examiner*—John S. Brusca
(74) *Attorney, Agent, or Firm*—Saliwanchik, Lloyd & Saliwanchik

(57) ABSTRACT

The subject of the invention is the genomic sequence and the nucleotide sequences encoding polypeptides of *Chlamydia trachomatis*, such as cellular envelope polypeptides, which are secreted or specific, or which are involved in metabolism, in the replication process or in virulence, polypeptides encoded by such sequences, as well as vectors including the said sequences and cells or animals transformed with these vectors. The invention also relates to transcriptional gene products of the *Chlamydia trachomatis* genome, such as, for example, antisense and ribozyme molecules, which can be used to control growth of the microorganism. The invention also relates to methods of detecting these nucleic acids or polypeptides and kits for diagnosing *Chlamydia trachomatis* infection. The invention also relates to a method of selecting compounds capable of modulating bacterial infection and a method for the biosynthesis or biodegradation of molecules of interest using the said nucleotide sequences or the said polypeptides. The invention finally comprises, pharmaceutical, in particular vaccine, compositions for the prevention and/or treatment of bacterial, in particular *Chlamydia trachomatis*, infections.

22 Claims, 3 Drawing Sheets

OTHER PUBLICATIONS

Figure 1:
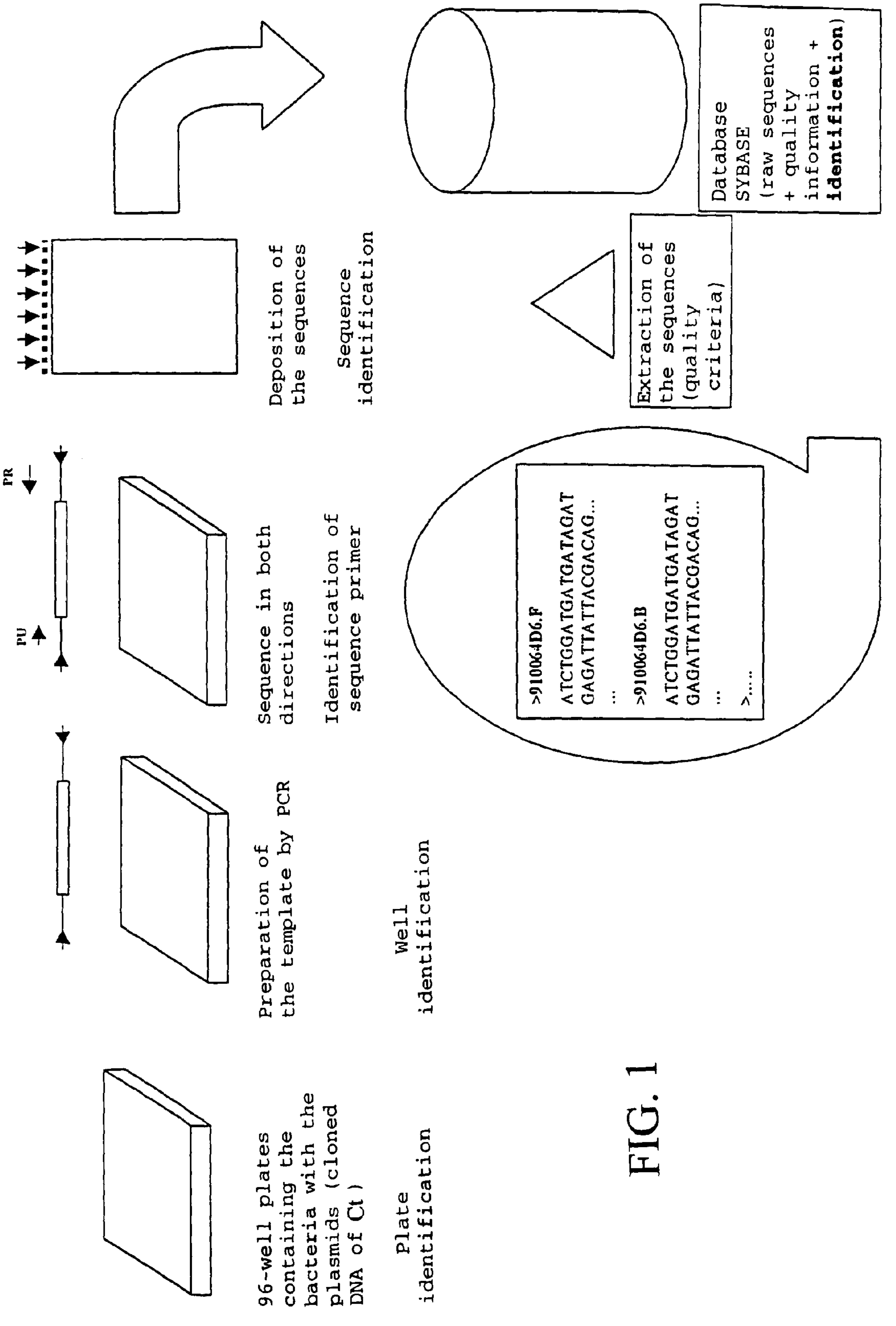

Fu Y et al., "A synthetic glycoconjugate representing the genus-specific epitope of *Chlamydial* lipopolysaccharide exhibits the same specificity as its natural counterpart", Infect Immun. Apr. 1992;60(4):1314-21.

Girjes AA et al., "Lipopolysaccharide biosynthesis genes in koala type I Chamydia: cloning and characterization", Res Microbiol. Jun. 1997;148(5):413-25.

Holst O et al., "Structure, serological specificity, and synthesis of artificial glycoconjugates representing the genus-specific lipopolysaccharide epitope of *Chlamydia* spp", J. Bacteriol. Mar. 1991;173(6):1862-6.

Mamat U et al., "The genus-specific lipopolysaccharide epitope of *Chlamydia* is assembled in *C. psittaci* and *C. trachomatis* by glycosyltransferases of low homology", Mol Microbiol. Dec. 1993;10(5):935-41.

Nao FE et al., "Expression of the *Chlamydial* genus-specific lipopolysaccharide epitope in *Escherichia coli*", Science. May 1985 10:228(4700):742-4.

Altschul, S.F. et al., 1990, "Basic local alignment search tool", J. Mol. Biol. 215:403-410.

Altschul et al., 1997, "Gapped BLAST and PSI-BLAST: a new generation of protein database search programs", Nucl. Acids Res. 25:3389-3402.

Bai, M. et al., 1993, "Mutations that alter an Arg-Gly-Asp (RGD) sequence in the adenovirus type 2 penton base protein abolish its cell-rounding activity and delay virus reproduction in flat cells",. Virol. 67:5198-5205.

Fox, G. et al., 1989, "The cell attachment site on foot-and-mouth disease virus includes the amino acid sequence RGD (Arginine-Glycine-Aspartic Acid)", J. Gen. Virol. 70:625-637.

Gish et al., 1993, "Identification of protein coding regions by database similarity search", Nature Genetics 3:266-272.

Gonnet et al., 1992, "Exhaustive matching of the entire protein sequence database", Science 256:1443-1445.

Hackstadt, T. 1996, "Origins and functions of the chlamydial inclusion", Trends in Microbiol. 5:288-293.

Hayashi, S. & Wu, H.C., 1992, "Identification and characterization of lipid-modified proteins in bacteria", in N.M. Hooper and A.J. Turner (ed.), *Lipid Modification of Proteins: A Practical Approach*, Oxford University Press, New York, pp. 261-285.

Heinkoff & Heinkoff, 1993, "Performance evaluation of amino acid substitution matrices", Proteins 17:49-61.

Higgins et al., 1996, "Using CLUSTAL for multiple sequence alignments", Meth. Enzymol. 266:383-402.

Hueck, C.J., 1998, "Type III protein secretion systems in bacterial pathogens of animals and plants", Molec. Biology Rev. 62:379-433.

Huovinen, P. et al., 1989, "Pharyngitis in adults: the presence and coexistence of viruses and bacterial organisms", Ann. Intern. Med. 110:612-616.

Karlin & Altschul, 1990, "Methods for assessing the statistical significance of molecular sequence features by using general scoring schemes", PNAS USA 87:2264-2268.

Lee, C.A., 1997, "Type III secretion systems: machines to deliver bacterial proteins into eukaryotic cells?", Trends Microbiol. 5:148-156.

Leininger, E. et al., 1991, "Pertactin, and Arg-Gly-Asp-containing *Bordetella pertussis* surface protein that promotes adherence of mammalian cells", PNAS USA 88:345-349.

Longbottom et al., 1998, "Molecular cloning and characterization of the genes coding for the highly immunogenic cluster of 90-kilodalton envelope proteins from the *Chlamydia psittaci* subtype that causes abortion in sheep", Infect. Immunol. 66:1317-1324.

Lukacova, M. et al., 1994, "Lipopolysacharaide smooth-rough phase variation in bacteria of the genus *Chlamydia*", Infect. Immunol. 62(6):2270-2276.

Morrison, R.P. et al., 1995, "Gene knockout mice establish a primary protective role for major histocompatability complex class II-restricted responses in *Chlamydia trachomatis*", Infect. Immun. 63:4661-4668.

Nakai, K. & Kanehisa, M., 1991, "Expert system for predicting protein localization sites in gram-negative bacteria", Proteins 11:95-110.

Nielsen, H. et al., 1997, "Identification of prokaryotic and eukaryotic signal peptides and prediction of their cleavage sites", Protein Engin. 10:1-6.

Pearson & Lipman, 1988, "Improved tools for biological sequence comparison", PNAS USA 85(8):2444-2448.

Peterson et al., 1988, "Protective role of magnesium in the neutralization by antibodies of *Chlamydia trachomatis* infectivity", Infect. Immun. 56(4):885-891.

Pierschbacher & Ruoslahti, 1987, "Influence of stereochemistry of the sequence Arg-Gly-Asp-Xaa on binding specificity in cell adhesion", J. Biol. Chem. 262:17294-17298.

Pugsley, A.P., 1993, "The complete general secretory pathway in gram-negative bacteria", (abstract) Microbiol. Rev. 57:50-108.

Rank, R.G. et al., 1988, "Susceptibility to reinfection after a primary chlamydial genital infection", Infect. Immun. 56:2243-2249.

Raulston, J.E., 1995, "Chlamydial envelope components and pathogen—host cell interactions", Mol. Microbiol. 15:607-616.

Reeves, P.R. et al., 1996, in *Bacterial Polysaccharide Synthesis and Gene Nomenclature*, Elsevier Science Ltd., pp. 10071-10078, from Trends in Microbiology, 1996, 4(12):495-503.

Relman,D. et al., 1990, "Recognition of a bacterial adhesin by an integrin: macrophage CR3 ($\alpha_M$ $\beta_2$, CD11b/CD18) binds filamentous hemagglutinin of *Bordetella pertussis*", Cell 61:1375-1382.

Roivainen, M. et al., 1994, "Entry of coxsackievirus A9 into host cells: specific interactions with $\alpha v\beta 3$ integrin, the vitronectin receptor", Virology 203:357-365.

Salzberg et al., 1988, "Microbial gene identification using interpolated Markov models", Nucl. Acids Res. 26:544-548.

Schacter, J. 1980, *Chlamydiae*, p. 357-365. In E.H. Lennette (ed.), Manual of clinical microbiology, $3^{rd}$ ed. American Society for Microbiology, Washington, D.C.

Schnaitman, C.A. & Klena, J.D., 1993, "Genetics of lipopolysaccharide biosynthesis in enteric bacteria", Microbiol. Rev. 57:655-682.

Schneewind, O. et al., 1995, "Structure of the cell wall anchor of surface proteins in *Staphylococcus aureus*", Science 268:103-106.

Struyve, M. et al., 1991,, "Carbox-terminal phenylalanine is essential for the correct assembly of a bacterial outer membrane protein", J.Mol. Biol. 218:141-148.

Sutcliffe, I.C. & Russel, R.R.B., 1995, "Lipoproteins of gram-positive bacteria", J. Bacteriol. 177:1123-1128.

Thompson et al., 1994, "CLUSTAL W: improving the sensitivity of progressive multiple sequence alignment through sequence weighting,position-specific gap penalties and weight matrix choice", Nucl. Acids Res. 22(2):4673-4680.

* cited by examiner

FIG. 3A

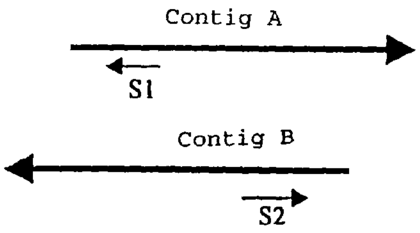

Statistical determination of the sequences:
1- Belonging to the same clone
2- Situated on two different contigs

Distribution and position of the sequences on the contigs:
1- Define the arrangement of the contigs in relation to each other
2- Define the PCR primers which make it possible to fill the sequence

FIG. 3B

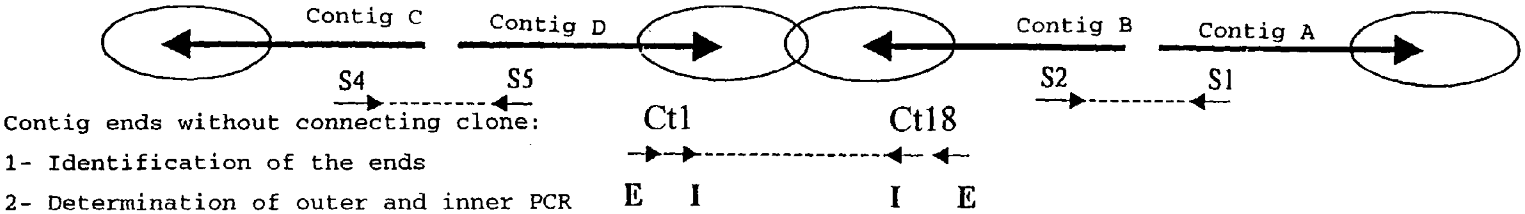

Contig ends without connecting clone:
1- Identification of the ends
2- Determination of outer and inner PCR primers for studying the relationships between the contigs
E: outer primers
I: inner primers

*CHLAMYDIA TRACHOMATIS* POLYNUCLEOTIDES AND VECTORS, RECOMBINANT HOST CELLS, DNA CHIPS OR KITS CONTAINING THE SAME

This application claims the benefit of Provisional Application No. 60/107,077, filed Nov. 4, 1998.

The Sequence Listing for this application is on duplicate compact discs labeled "Copy 1" and "Copy 2." Copy 1 and Copy 2 each contain one file named "seq-list-relace.txt" which was created on May 24, 2005 and is 4771 KB. The entire contents of each of the computer discs are incorporated herein by reference.

The subject of the invention is the genomic sequence and the nucleotide sequences encoding polypeptides of *Chlamydia trachomatis*, such as cellular envelope polypeptides, which are secreted or specific, or which are involved in metabolism, in the replication process or in virulence, polypeptides encoded by such sequences as well as vectors including the said sequences and cells or animals transformed with these vectors. The invention also relates to transcriptional gene products of the *Chlamydia trachomatis* genome, such as, for example, antisense and ribozyme molecules, which can be used to control growth of the microorganism. The invention also relates to methods of detecting these nucleic acids or polypeptides and kits for diagnosing *Chlamydia trachomatis* infection. The invention also relates to a method of selecting compounds capable of modulating bacterial infection and a method for the biosynthesis or biodegradation of molecules of interest using the said nucleotide sequences or the said polypeptides. The invention finally comprises, pharmaceutical, in particular vaccine, compositions for the prevention and/or treatment of bacterial, in particular *Chlamydia trachomatis*, infections.

The genus *Chlamydia* is composed of four species: *Chlamydia psittaci, Chlamydia pecorum, Chlamydia pneumoniae* and *Chlamydia trachomatis.*

*Chlamydia psittaci* comprises numerous species, whose hosts are terrestrial vertebrate animals as well as birds and occasionally humans;

*Chlamydia pecorum* is a pathogen of ruminants;

*Chlamydia pneumoniae* is responsible for pneumopathies, for sinusitis and for arterial impairments in humans;

*Chlamydia trachomatis* (Ct) is responsible for a large number of human diseases:

- eye diseases: conventional trachoma, nonendemic trachoma, paratrachoma, inclusion conjunctivitis in neonates and in adults;
- genital diseases: nongonococcal uretritis, epididymitis, cervicitis, salpingitis, perihepatitis and bartholinitis as well as pneumopathy in breast-feeding infants;
- systemic diseases: venereal lymphogranulomatosis (LGV).

These diseases affect a very large number of women and men [more than 600 million individuals are trachoma carriers and there are more than 90 million cases of genital *Chlamydia* infections] worldwide. Accordingly, basic and applied research which makes it possible to understand the physiopathology linked to this bacterium is very important for public health. (Raulston J E., 1995; Hackstadt T. et al., 1996).

Eye impairments due to *Chlamydia trachomatis* cause trachoma and inclusion conjunctivitis. Trachoma is a chronic conjunctivitis. It is the major cause of curable eye diseases leading to blindness. It is estimated that 20 million cases of loss of sight are due to it worldwide. Moreover, inclusion conjunctivitis is an eye inflammation which is caused by *Chlamydia trachomatis* and is transmitted by the venereal route. Inclusion conjunctivitis affects adults and neonates exposed to genital secretions.

Two types of eye disease caused by agents of the species *Chlamydia trachomatis* can be distinguished. The conventional trachomatous disease is found in endemic regions; transmission occurs from eye to eye and through the hands, or it can be passed on by flies. In nonendemic regions, transmission occurs through the genital apparatus; it usually only causes conjunctivitis, most often without associated keratitis; it is rare for a pannus or for scars similar to those in trachoma to develop. This conjunctival impairment is called paratrachoma to differentiate it from the conventional endemic trachoma which is transmitted by the ocular route. The seriousness and the number of cases of trachoma have decreased over the last forty years. This is related to the improvement in hygiene and living conditions. However, trachoma remains the principal cause of avoidable blindness in Africa, in the Middle East and in some regions of Asia. The transmission of the endemic disease occurs in particular through close personal contact, in regions where a secondary exposure exists in a repeated form. Often, the infection is also latent. In some industrialized countries, such as the United States, a mild form of trachoma still exists in some ethnic groups. Sometimes, a tardive trachoma may be found following an immunosuppressive treatment. The eye impairments caused by *Chlamydia trachomatis*, such as inclusion conjunctivitis and paratrachoma, are also a complication due to a common venereal infection. These infections are not very frequent; they occur most often in young adults. The eye impairments in neonates are produced during the passage through the maternal genital routes during childbirth. Theoretically, endemic trachoma and inclusion conjunctivitis in adults appear in the form of conjunctivitis, the latter being characterized by the presence of lymphoid follicles. In regions where the endemic disease is serious, the disease often starts before the age of 2 years and reinfection is frequent. Superficial neovascularization is added, in this case, to leukocytic infiltration. The conjunctival scars will then cause trichiasis and entropion. The eroded cornea will become a carrier of a corneal ulcer of bacterial origin. The scar on the cornea causes blindness. Impairment of the lachrymal glands gives a picture of dryness of the cornea. Xerosis becomes complicated with secondary bacterial ulcer. In regions where trachoma is endemic, the infectious process disappears towards the age of fifteen. The scars then progress to blindness, which affects almost exclusively adults. In regions where exposure is lower, the infectious process is, in this case, less rapid and adults are carriers of a chronic disease.

Positive diagnosis of trachoma can be most often established by clinical observation: lymphoid follicles are visible on the upper tarsal conjuctiva; conjunctival scar is typical. Vascular pannus exists. In endemic regions, clinical diagnosis is often sufficient. However, isolated cases of inclusion conjunctivitis must be the subject of a differential diagnosis, in particular to distinguish viral conjunctivitis.

Public health measures against the endemic form of the disease provide for mass treatments with tetracycline or erythromycin collyria of all children. The treatment may also provide for surgical correction of the lesions. The other conjunctival impairments respond well to general treatments with tetracyclines or erythromycin. The prevention of trachomatous disease by health measures and by improving living standards is sufficient. Furthermore, to avoid the spread of trachoma, antibiotic collyria may be used.

The role of *Chlamydia trachomatis* in a number of genital impairments has been demonstrated over the last three decades. *Chlamydia trachomatis* is responsible in this case for a pathology which may be superposed on the impairments observed with *Neisseria gonorrhoeae*. The pathologies for which *Chlamydia trachomatis* may be responsible at the genital level are acquired by the venereal route and are a major source of sexually transmitted diseases.

The epidemiology of *Chlamydia trachomatis* genital infections shows each year more than 4 million new cases in the United States, and more than 3 million new cases in Europe. Like the other venereal infections, *Chlamydia trachomatis* affects young subjects. There is a direct relationship between the number of sexual partners and the frequency of the disease. For example, the frequency of *Chlamydia trachomatis* appears to be five to ten times higher than that of *Neisseria gonorrhoeae* in pregnant women. The *Chlamydia trachomatis* infection is probably more discreet than its *Neisseria gonorrhoeae* homologue. This relative clinical silence, estimated in women at 50% or even 70% of infections, explains why the total morbidity of *Chlamydia trachomatis* conditions is high. Diagnosis must therefore be requested in patients who are sometimes asymptomatic carriers of infection.

*Chlamydia trachomatis* is responsible for nearly 30% of nongonococcal urethritis, or NGU. *Chlamydia trachomatis* urethritis may be discreet, the disease then progresses to a certain form of chronicity. The diagnosis will, like for the other clinical forms of the disease, be called into play later.

*Chlamydia trachomatis* is a cause of epididymitis in humans during a period of sexual activity. The bacterium may be found in the urethra, urine, sperm or even a sample collected by aspiration from the epididymis. It is in particular found in humans under 35 years of age. A discharge from the urethra which is associated with the disease suggests the diagnosis of a *Chlamydia* condition or sometimes a gonococcal condition.

Untreated Reiter's syndrome, if accompanied by urethritis, evokes a *Chlamydia trachomatis* condition.

*Chlamydia trachomatis* affects 30% to 40% of women who are clinically carriers of a gonorrhoea (or have had contact), 10% to 20% of women having a venereal origin, 5% of women consulting having no particular origin.

The cervix is often normal during a *Chlamydia trachomatis* infection. However, a hypertrophic cervical erythema will cause such an infection to be suspected. *Chlamydia trachomatis* is responsible for an endocervicitis whereas viral impairments result in exocervicitis. A nongonococcal endocervicitis requires treating the patient and partners with tetracyclines.

*Chlamydia trachomatis* is responsible for a large number of acute salpingites. The picture is often complicated by an acute peritonitis or even a perihepatitis.

In case of pregnancy, the risk is first that of infection of the neonate at birth. However, the risk of postpartum complications exists (endometritis or salpingitis).

The reference method for the diagnosis of *Chlamydia trachomatis* is the isolation of the bacterium on cell culture. For all infections, the sample collection should make it possible to obtain a suitable sample with the aid of a swab. This sample should be transported to a laboratory under excellent conditions; in particular, the cold chain must absolutely be maintained. The placing in cell culture on mouse fibroblasts will be carried out by people having specific skills. The distinction of *Chlamydia trachomatis* with labelled antibodies and the observation of cell cultures under a microscope will take place two days after placing in culture. Provided these imperatives are observed, cell culture is a reliable technique. However, the constraints linked to this technique are many: not only must the laboratory be equipped for the cell culture, but, furthermore, highly competent staff must take care of this type of diagnosis.

Techniques for identifying genetic material can obviously be used for the detection of *Chlamydia trachomatis*. Among these techniques, enzymatic gene amplification or PCR is favoured by those skilled in the art. The technique indeed makes it possible to identify *Chlamydia trachomatis* with a very high sensitivity and complete specificity. Initially used in specialist laboratories, PCR is now performed in numerous medical laboratories. This diagnostic approach is important because it allows detection of the bacteria even in samples which have been transported under poor conditions.

The treatment of *Chlamydia* urethritis with antibiotics such as tetracycline or quinolones is very effective. The duration of treatment varies between 7 and 14 days. The treatment of pregnant women poses the problem of contraindications to tetracycline.

Neonatal infections caused by *Chlamydia trachomatis* are explained by the frequency of these bacteria in the cervix. In some studies, 5% to 13% of impairments are observed in the cervix in asymptomatic pregnant women. The neonates risk, in this case, developing an inclusion conjunctivitis. Not only can *Chlamydia trachomatis* be isolated from the children's eyes, but also persistently from the rhinopharynx and also from the rectum. Pneumopathies and otitis media are also found, a result of contamination at childbirth.

Differential diagnosis of inclusion conjunctivitis in neonates is required with gonococcal ophthalmia; while the duration of incubation is from one to three days in the case of a gonococcal ophthalmia, neonatal inclusion conjunctivitis has an acute beginning with discharge and formation of membranes or even of conjunctival scars.

Treatment consists of oral erythromycin at the dose of 40 to 50 mg per kg of weight, for two to three weeks. In a nonendemic trachoma region, this disease never progresses to chronicity.

Finally, mention should be made of infantile pneumopathy. The syndrome is well defined; it is found in children affected by *Chlamydia trachomatis*. Less than ten children are affected by *Chlamydia trachomatis* pneumopathies per thousand births. The syndrome is, in this case, always found at an early age (less than four months).

Venereal lymphogranulomatosis is an infection which is transmitted through sexual contact and is due to *Chlamydia trachomatis* strains L1, L2 and L3. In humans, a passing primary genital lesion is followed by an often suppurative and multiple regional lymphadenopathy. This disease is a general disease which is accompanied by fever and a rise in the number of white blood cells. If it progresses to chronicity, the disease then becomes complicated with genital elephantiasis, stricture or even fistula of the genital apparatus, of the penis, of the urethra and of the rectum.

The three *Chlamydia trachomatis* strains L1, L2 and L3 are responsible for venereal lymphogranulomatosis. These *Chlamydia* strains are more virulent than the strains responsible for trachoma and STD. It is very important to note that venereal lymphogranulomatosis is a systemic disease which affects primarily the lymphatic tissue. Generally transmitted by the sexual route, *Chlamydia trachomatis* L may also cause contamination through direct contact or even during poor laboratory handling. In spite of these variable modes of transmission, the age for the highest incidence of these diseases corresponds to that for greater sexual activity. Venereal lymphogranulomatosis is still endemic in South America, in Africa and sometimes in Asia. For a long time, the prevalence of venereal lymphogranulomatosis was difficult to establish because of the difficulty of performing diagnosis with certitude. It should also be noted that men are affected more often than women. In low endemic regions, it is difficult to recognize the reservoir of microbes. This situation is explained by the fact that the isolation of the strains causing venereal lymphogranulomatosis from asymptomatic subjects is rarely successful.

Clinical impairment by venereal lymphogranulomatosis manifests itself by the appearance of a small ulcer 3 to 21 days after the exposure of small nonpainful vesicles. In both men and women, the lesion is most often silent. Since this impairment disappears within a few days and causes no functional discomfort and leaves no visible scar, the disease is often recognized late. The venereal lymphogranulomatosis strains may be found in the urethra or the endocervix in patients with inguinal adenopathies; these regions are then considered as the initial site of infection. The characteristic feature of the venereal lymphogranulomatosis strains is that from the initial site of infection, *Chlamydia* exhibits a diffusion drained by the lymphatic ducts. The disease is then complicated by a ganglionic impairment of the region draining the site of inoculation. By way of example, anorectal infection causes deep adenopathies. These adneopathies are marked by the appearance of a periadenitis which forms a fluctuating and suppurative ganglionic mass. Fistulae will appear during the decline of the disease. As general signs are present at this stage of the disease, it is often confused with a malignant lymphoma. The other general complications are rarely observed. Clinical examinations have been able to lead biologists to isolate *Chlamydia* from the cerebrospinal fluid or from the blood. It should also be noted that in a number of cases (5%), venereal lymphogranulomatosis is complicated by a chronic oedema: this is genital elephantiasis.

The diagnosis of venereal lymphogranulomatosis requires the isolation of the *Chlamydia* strains involved in the disease. However, isolation on cell cultures is rarely used, but immunological reactions may be used.

The treatment of venereal lymphogranulomatosis in its initial phase is identical to the treatment of other *Chlamydia* infections. In the chronic phases, antibiotics have little effect on the progress of the disease, but they are however useful in case of superinfection. Although the recommended therapeutic arsenal is identical, it is advisable to prolong the treatment for a period of at least four weeks. In addition to this treatment, reconstructive surgery may be useful in cases of urethral, penile or rectal strictures, as well as for the treatment of fistulae.

In conclusion, a short and effective treatment, without recurrences, and a well-tolerated treatment of *Chlamydia trachomatis* infections therefore remains desirable.

An even greater need up until now relates to a diagnosis which is specific to each of the strains, which is sensitive, which can be carried out conveniently and rapidly, and which allows early detection of the infection.

No vaccine is currently available against *Chlamydia trachomatis*. The role of the immune defense in the physiology and pathology of the disease should probably be understood in order to develop satisfactory vaccines.

More detailed information relating to the biology of these strains, their interactions with their hosts, the associated phenomena of infectivity and those of escaping the immune defenses of the host in particular, and finally their involvement in the development of the these associated pathologies, will allow a better understanding of these mechanisms. In the light of the preceding text which shows in particular the limitations of the means of controlling *Chlamydia trachomatis* infection, it is therefore at present essential, on the one hand, to develop molecular tools, in particular from a better genetic knowledge of *Chlamydia trachomatis*, but also to develop new preventive and therapeutic treatments, new diagnostic methods and new vaccine strategies which are specific, effective and tolerated. This is precisely the object of the present invention.

The subject of the present invention is the nucleotide sequence having the sequence SEQ ID No. 1 of the *Chlamydia trachomatis* LGV2 genome. However, the invention is not limited to SEQ ID No. 1, but encompasses genomes and nucleotides encoding polypeptides of strain variants, polymorphisms, allelic variants, and mutants.

Thus, the subject of the present invention encompasses nucleotide sequences characterized in that they are chosen from:

a) the nucleotide sequence of SEQ ID No. 1, a nucleotide sequence exhibiting at least 99.9% identity with the sequence SEQ ID No. 1, the nucleotide sequence of the genomic DNA contained within ECACC Deposit No. 98112618, the nucleotide sequence of a clone insert within ECACC Deposit No. 98112617 (these being provisional deposit numbers);

b) a nucleotide sequence homologous to the sequence SEQ ID No. 1;

c) a polynucleotide sequence that hybridizes to the nucleotide sequence of a) under conditions of high or intermediate stringency as described below:

(i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C., the preferred hybridization temperature, in prehybridization mixture containing 100 μg/ml denatured salmon sperm DNA and 5–20×$10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety.

(ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety.

d) a nucleotide sequence complementary to the sequence SEQ ID No. 1 or complementary to a nucleotide sequence as defined in a), b) or c), and a nucleotide sequence of their corresponding RNA;

e) a nucleotide sequence of a representative fragment of the sequence SEQ ID No. 1, or of a representative fragment of the nucleotide sequence as defined in a), b), c) or d);

f) a nucleotide sequence comprising a sequence as defined in a), b), c), d) or e);

g) a nucleotide sequence capable of being obtained from a nucleotide sequence as defined in a), b), c), d), e) or f); and h) a modified nucleotide sequence of a nucleotide sequence as defined in a), b), c), d), e), f) org).

Sequence of the genome, or genomic sequence of *Chlamydia trachomatis* is understood to mean the sequence of the chromosome of *Chlamydia trachomatis*, in contrast with the plasmid sequence of *Chlamydia trachomatis*.

Nucleotide sequence, polynucleotide or nucleic acid are understood to mean, according to the present invention, either a double-stranded DNA, a single-stranded DNA or products of transcription of the said DNAs.

It should be understood that the present invention does not relate to the genomic nucleotide sequences of *Chlamydia trachomatis* taken in their natural environment, that is to say in the natural state. They are sequences which may have been isolated, purified or partially purified, by separation methods such as, for example, ion-exchange chromatography, molecular size exclusion chromatography or affinity chromatography, or alternatively fractionation techniques based on solubility in various solvents, or by genetic engineering methods such as amplification, cloning or subcloning, it being possible for the sequences of the invention to be carried by vectors.

The nucleotide sequence SEQ ID No. 1 was obtained by sequencing the *Chlamydia trachomatis* LGV2 genome by the method of directed sequencing after fluorescent automated sequencing of the inserts of clones and assembling of these sequences of nucleotide fragments (inserts) by means of softwares (cf. Examples). In spite of the high precision of the sequence SEQ ID No. 1, it is possible that it does not perfectly, 100% represent the nucleotide sequence of the *Chlamydia trachomatis* LGV2 genome and that a few rare sequencing errors or uncertainties still remain in the sequence SEQ ID No. 1. In the present invention, the presence of an uncertainty for an amino acid is designated by <<Xaa>> and that for a nucleotide is designated by <<N>> in the sequence listing below. These few rare errors or uncertainties could be easily detected and corrected by persons skilled in the art using the entire chromosome and/or its representative fragments according to the invention and standard amplification, cloning and sequencing methods, it being possible for the sequences obtained to be easily compared, in particular by means of a computer software and using computer-readable media for recording the sequences according to the invention as described, for example, below. After correcting these possible rare errors or uncertainties, the corrected nucleotide sequence obtained would still exhibit at least 99.9% identity with the sequence SEQ ID No. 1. Such rare sequencing uncertainties are not present within the DNA contained within ECACC Deposit No. 98112617 or 98112618 (provisional numbers) and whatever rare sequence uncertainties that exist within SEQ ID No. 1 can routinely be corrected utilizing the DNA of the ECACC Deposits.

Homologous nucleotide sequence for the purposes of the present invention is understood to mean a nucleotide sequence having a percentage identity with the bases of the nucleotide sequence SEQ ID No. 1 of at least 80%, preferably 90% and 95%, this percentage being purely statistical and it being possible for the differences between the two nucleotide sequences to be distributed randomly and over their entire length. The said homologous sequences exhibiting a percentage identity with the bases of the nucleotide sequence SEQ ID No. 1 of at least 80%, preferably 90% and 95%, may comprise, for example, the sequences corresponding to the genomic sequence or to the sequences of its representative fragments of a bacterium belonging to the *Chlamydia* family, including the species *Chlamydia pneumoniae, Chlamydia psittaci* and *Chlamydia pecorum* mentioned above, as well as the sequences corresponding to the genomic sequence or to the sequences of its representative fragments of a bacterium belonging to the variants of the species *Chlamydia trachomatis*. In the present invention, the terms family and genus are mutually interchangeable, the terms variant, serotype, strain and subspecies are also mutually interchangeable. These homologous sequences may thus correspond to variations linked to mutations within the same species or between species and may correspond in particular to truncations, substitutions, deletions and/or additions of at least one nucleotide. The said homologous sequences may also correspond to variations linked to the degeneracy of the genetic code or to a bias in the genetic code which is specific to the family, to the species or to the variant and which are likely to be present in *Chlamydia*.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215 (3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3): 403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well known in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1)BLASTP and BLAST3 compare an amino acid query sequence against a protein sequence database;

(2)BLASTN compares a nucleotide query sequence against a nucleotide sequence database;

(3)BLASTX compares the six-frame conceptual translation products of a query nucleotide sequence (both strands) against a protein sequence database;

(4)TBLASTN compares a query protein sequence against a nucleotide sequence database translated in all six reading frames (both strands); and (5)TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992*, Science* 256:1443–1445; Henikoff and Henikoff, 1993*, Proteins* 17:49–61). Less preferably, the PAM or PAM250 matrices may also be used (see, e.g., Schwartz and Dayhoff, eds., 1978*, Matrices for Detecting Distance Relationships: Atlas of Protein Sequence and Structure*, Washington: National Biomedical Research Foundation)

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990*, Proc. Natl. Acad. Sci. USA* 87:2267–2268).

Nucleotide sequence complementary to a sequence of the invention is understood to mean any DNA whose nucleotides are complementary to those of the sequence of the invention, and whose orientation is reversed (antiparallel sequence).

The present invention further comprises fragments of the sequences of a) through h) above. Representative fragments of the sequences according to the invention will be understood to mean any nucleotide fragment having at least 8 successive nucleotides, preferably at least 12 successive nucleotides, and still more preferably at least 15 or at least 20 successive nucleotides of the sequence from which it is derived. It is understood that such fragments refer only to portions of SEQ ID No. 1 that are not currently listed in a publicly available database.

Among these representative fragments, those capable of hybridizing under stringent conditions with a nucleotide sequence according to the invention are preferred. Hybridization under stringent conditions means that the temperature and ionic strength conditions are chosen such that they allow hybridization to be maintained between two complementary DNA fragments.

By way of illustration, high stringency conditions for the hybridization step for the purposes of defining the nucleotide fragments described above, are advantageously the following.

The hybridization is carried out at a preferred temperature of 65° C. in the presence of SSC buffer, 1×SSC corresponding to 0.15 M NaCl and 0.05 M Na citrate. The washing steps may be, for example, the following:

2×SSC, 0.1% SDS at room temperature followed by three washes with 1×SSC, 0.1% SDS; 0.5×SSC, 0.1% SDS; 0.1×SSC, 0.1% SDS at 68° C. for 15 minutes.

Intermediate stringency conditions, using, for example, a temperature of 60° C. in the presence of a 5×SSC buffer, or of low stringency, for example a temperature of 50° C. in the presence of a 5×SSC buffer, respectively require a lower overall complementarity for the hybridization between the two sequences.

The stringent hybridization conditions described above for a polynucleotide of about 300 bases in size will be adapted by persons skilled in the art for larger- or smaller-sized oligonucleotides, according to the teaching of Sambrook et al., 1989.

Among the representative fragments according to the invention, those which can be used as primer or probe in methods which make it possible to obtain homologous sequences or their representative fragments according to the invention, or to reconstitute a genomic fragment found to be incomplete in the sequence SEQ ID No. 1 or carrying an error or an uncertainty, are also preferred, these methods, such as the polymerase chain reaction (PCR), cloning and sequencing of nucleic acid being well known to persons skilled in the art. These homologous nucleotide sequences corresponding to mutations or to inter- or intra-species variations, as well as the complete genomic sequence or one of its representative fragments capable of being reconstituted, of course form part of the invention.

Among the said representative fragments, those which can be used as primer or probe in methods allowing diagnosis of the presence of *Chlamydia trachomatis* or one of its associated microorganisms as defined below are also preferred.

The representative fragments capable of modulating, regulating, inhibiting or inducing the expression of a gene of *Chlamydia trachomatis* or one of its associated microorganisms, and/or capable of modulating the replication cycle of *Chlamydia trachomatis* or one of its associated microorganisms in the host cell and/or organism, are also preferred. Replication cycle is intended to designate invasion, multiplication, intracellular localization, in particular retention in the vacuole and inhibition of the process of fusion to the lysosome, and propagation of *Chlamydia trachomatis* or one of its associated microorganisms from host cells to host cells.

Among the said representative fragments, those corresponding to nucleotide sequences corresponding to open reading frames, called ORF sequences (ORF for open reading frame), and encoding polypeptides, such as for example, but without being limited thereto, the ORF sequences which will be later described, are finally preferred.

The representative fragments according to the invention may be obtained, for example, by specific amplification, such as PCR, or after digestion, with appropriate restriction enzymes, of nucleotide sequences according to the invention; these methods are in particular described in the manual by Sambrook et al., 1989. The said representative fragments may also be obtained by chemical synthesis when they are not too large in size and according to methods well known to persons skilled in the art. For example, such fragments can be obtained by isolating fragments of the genomic DNA of ECACC Deposit No. 98112618 or a clone insert present at this ECACC Deposit No. 98112617 (provisional numbers).

The representative fragments according to the invention may be used, for example, as primer, to reconstitute some of the said representative fragments, in particular those in which a portion of the sequence is likely to be missing or imperfect, by methods well known to persons skilled in the art such as amplification, cloning or sequencing techniques.

Modified nucleotide sequence will be understood to mean any nucleotide sequence obtained by mutagenesis according to techniques well known to persons skilled in the art, and exhibiting modifications in relation to the normal sequences, for example mutations in the regulatory and/or promoter sequences for the expression of a polypeptide, in particular leading to a modification of the level of expression of the said polypeptide or to a modulation of the replicative cycle.

Modified nucleotide sequence will also be understood to mean any nucleotide sequence encoding a modified polypeptide as defined below.

The subject of the present invention also includes *Chlamydia trachomatis* nucleotide sequences characterized in that they are chosen from a nucleotide sequence of an open reading frame (ORF), that is, the ORF2 to ORF1197 sequences.

The ORF2 to ORF1197 nucleotide sequences are defined in Tables 1 and 2, infra, represented below by their position on the sequence SEQ ID No. 1. For example, the ORF10 sequence is defined by the nucleotide sequence between the nucleotides at position 9828 and 10430 on the sequence SEQ ID No. 1, ends included. ORF2 to ORF1197 have been identified via homology analyses as well as via analyses of potential ORF start sites, as discussed in the examples below. It is to be understood that each identified ORF of the invention comprises a nucleotide sequence that spans the contiguous nucleotide sequence from the codon immediately 3' to the stop codon of the preceding ORF and through the 5' codon to the next stop codon of SEQ ID No.: 1 in-frame to the ORF nucleotide sequence. Table 2, infra, lists the beginning, end and potential start site of each of ORFs 2–1197. In one embodiment, the ORF comprises the contiguous nucleotide sequence spanning from the potential ORF start site downstream (that is, 3') to the ORF stop codon (or the ORF codon immediately adjacent to and upstream of the ORF stop codon). ORF2 to ORF1197 encode the polypeptides of SEQ ID No. 2 to SEQ ID No. 1197.

Upon introduction of minor frameshifts, certain individual ORFs can comprise larger <<combined>> ORFs. A list of such putative <<combined>> ORFs is shown in Table 3, below. For example, a combined ORF can comprise ORF 1076 and ORF 1073, including intervening in-frame, nucleotide sequences. The order of ORFs (5' to 3'), within each <<combined>> ORF is as listed. It is to be understood that when ORF2 to ORF1197 are referred to herein, such reference is also meant to include <<combined>> ORFs. Polypeptide sequences encoded by such <<combined>> ORFs are also part of the present invention.

Table 3

ORF 1076, ORF 1073;
ORF 3, ORF 2;
ORF 23, ORF 22, ORF 21;
ORF 1141, ORF 477, ORF 478, ORF 479;
ORF 487, ORF 486, ORF 485, ORF 484, ORF 483, ORF 482, ORF 481;
ORF 488, ORF 489;
ORF 573, ORF 572, ORF 571;
ORF 817, ORF 818;
ORF 819, ORF 820;
ORF 1037, ORF 1038;
ORF 1071, ORF 1070;
ORF 17, ORF 1077;
ORF 1185, ORF 933, ORF 934;
ORF 1060, ORF 1059;
ORF 155, ORF 156;
ORF 679, ORF 680;
ORF 879, ORF 878;
ORF 1028; ORF 1029,
and representative fragments.

Table 1 also depicts the results of homology searches that compared the sequences of the polypeptides encoded by each of the ORFs to sequences present in public published databases. It is understood that in one embodiment, those polypeptides listed in Table 1 as exhibiting greater than about 95% identity to a polypeptide present in a publicly disclosed database are not considered part of the present invention; likewise in this embodiment, those nucleotide sequences encoding such polypeptides are not considered part of the invention. In another embodiment, it is understood that those polypeptides listed in Table 1 as exhibiting greater than about 99% identity to a polypeptide present in a publicly disclosed database are not considered part of the invention; likewise, in this embodiment, those nucleotide sequences encoding such polypeptides are not considered part of the invention.

The invention also relates to the nucleotide sequences characterized in that they comprise a nucleotide sequence chosen from:

a) an ORF2 to ORF1197, a <<combined>> ORF nucleotide sequence, the nucleotide sequence of the genomic DNA contained within ECACC Deposit No. 98112618 or the nucleotide sequence of a clone insert in ECACC Deposit No. 98112617 according to the invention;

b) a homologous nucleotide sequence exhibiting at least 80% identity across an entire ORF2 to ORF1197 nucleotide sequence according to the invention or as defined in a);

c) a polynucleotide sequence that hybridizes to ORF2 to ORF1197 under conditions of high or intermediate stringency as described below:

(i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C., the preferred hybridization temperature, in prehybridization mixture containing 100 μg/ml denatured salmon sperm DNA and 5–20×$10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1197. In one embodiment, such sequences encode a *Chlamydia trachomatis* polypeptide.

(ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1197. In one embodiment, such sequences encode a *Chlamydia trachomatis* polypeptide.

d) a complementary or RNA nucleotide sequence corresponding to an ORF2 to ORF1197 sequence according to the invention or as defined in a), b) or c);

e) a nucleotide sequence of a representative fragment of an ORF2 to ORF1197 sequence according to the invention or of a sequence as defined in a), b), c) or d);

f) a nucleotide sequence capable of being obtained from an ORF2 to ORF1197 sequence according to the invention or as defined in a), b), c), d) or e); and g) a modified nucleotide sequence of an ORF2 to ORF1197 sequence according to the invention or as defined in a), b), c), d), e) or f).

As regards the homology with the ORF2 to ORF1197 nucleotide sequences, the homologous sequences exhibiting a percentage identity with the bases of one of the ORF2 to ORF1197 nucleotide sequences of at least 80%, preferably 90% and 95%, are preferred. Such homologous sequences are identified routinely via, for example, the algorithms described above and in the examples below. The said homologous sequences correspond to the homologous sequences as defined above and may comprise, for example, the sequences corresponding to the ORF sequences of a bacterium belonging to the *Chlamydia* family, including the species *Chlamydia pneumoniae, Chlamydia psittaci* and *Chlamydia pecorum* mentioned above, as well as the sequences corresponding to the ORF sequences of a bacterium belonging to the variants of the species *Chlamydia trachomatis*. These homologous sequences may likewise correspond to variations linked to mutations within the same species or between species and may correspond in particular to truncations, substitutions, deletions and/or additions of at least one nucleotide. The said homologous sequences may also correspond to variations linked to the degeneracy of the genetic code or to a bias in the genetic code which is specific to the family, to the species or to the variant and which are likely to be present in *Chlamydia*.

The invention comprises the polypeptides encoded by a nucleotide sequence according to the invention, preferably by a representative fragment of the sequence SEQ ID No. 1 and corresponding to an ORF sequence, in particular the *Chlamydia trachomatis* polypeptides, characterized in that they are chosen from the sequences SEQ ID No. 2 to SEQ ID No. 1197, and representative fragments thereof. However, the invention is not limited to polypeptides encoded by ORFs in SEQ ID No. 1 and its corresponding ORF sequences, but encompasses polypeptides of strain variants, polymorphisms, allelic variants, and mutants.

Thus, the invention also comprises the polypeptides characterized in that they comprise a polypeptide chosen from:

a) a polypeptide encoded by a polynucleotide sequence in SEQ ID No. 1 (e.g., any polypeptide encoded by a polynucleotide sequence corresponding to ORF2 to ORF1197) and/or representative fragments thereof according to the invention;

b) a polypeptide homologous to a polypeptide according to the invention, or as defined in a);

c) a polypeptide encoded by a polynucleotide sequence that hybridizes to SEQ ID No. 1 or ORF2 to ORF1197 under high or intermediate stringency as described below:

(i) By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 μg/ml denatured salmon sperm DNA. Filters are hybridized for 48 h at 65° C., the preferred hybridization temperature, in prehybridization mixture containing 100 μg/ml denatured salmon sperm DNA and 5–20×$10^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. Other conditions of high stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1197. In one embodiment, such sequences encode a *Chlamydia trachomatis* polypeptide.

(ii) By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of intermediate stringency which may be used are well known in the art and as cited in Sambrook et al., 1989, Molecular Cloning, A Laboratory Manual, Second Edition, Cold Spring Harbor Press, N.Y., pp. 9.47–9.57; and Ausubel et al., 1989, Current Protocols in Molecular Biology, Green Publishing Associates and Wiley Interscience, N.Y. are incorporated herein in their entirety. Preferably, such sequences encode a homolog of a polypeptide encoded by one of ORF2 to ORF1197. In one embodiment, such sequences encode a *Chlamydia trachomatis* polypeptide.

d) a fragment of at least 5 amino acids of a polypeptide according to the invention, or as defined in a), b) or c);

e) a biologically active fragment of a polypeptide according to the invention, or as defined in a), b), c) or d); and f) a modified polypeptide of a polypeptide according to the invention, as defined in a), b), c), d) or e).

In the present description, the terms polypeptide, peptide and protein are interchangeable.

It should be understood that the invention does not relate to the polypeptides in natural form, that is to say that they are not taken in their natural environment but that they may have been isolated or obtained by purification from natural sources, or alternatively obtained by genetic recombination, or else by chemical synthesis and that they may, in this case, comprise nonnatural amino acids, as will be described below.

Homologous polypeptide will be understood to designate the polypeptides exhibiting, in relation to the natural polypeptide, certain modifications such as in particular a deletion, addition or substitution of at least one amino acid, a truncation, an extension, a chimeric fusion, and/or a mutation, or polypeptides exhibiting post-translational modifications. Among the homologous polypeptides, those whose amino acid sequence exhibits at least 80%, preferably 90%, homology or identity with the amino acid sequences of the polypeptides according to the invention are preferred. In the case of a substitution, one or more consecutive or nonconsecutive amino acids are replaced by <<equivalent>> amino acids. The expression <<equivalent>> amino acid is intended here to designate any amino acid capable of being substituted for one of the amino acids in the basic structure without, however, essentially modifying the biological activities of the corresponding peptides and as will be defined later.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad. Sci. USA* 85(8):2444–2448; Altschul et al., 1990, *J. Mol. Biol.* 215 (3):403–410; Thompson et al., 1994, *Nucleic Acids Res.* 22(2):4673–4680; Higgins et al., 1996, *Methods Enzymol.* 266:383–402; Altschul et al., 1990, *J. Mol. Biol.* 215(3): 403–410; Altschul et al., 1993, *Nature Genetics* 3:266–272).

In a particularly preferred embodiment, protein and nucleic acid sequence homologies are evaluated using the Basic Local Alignment Search Tool ("BLAST") which is well know in the art (see, e.g., Karlin and Altschul, 1990, *Proc. Natl. Acad. Sci. USA* 87:2267–2268; Altschul et al., 1990, *J. Mol. Biol.* 215:403–410; Altschul et al., 1993, *Nature Genetics* 3:266–272; Altschul et al., 1997, *Nuc. Acids Res.* 25:3389–3402). In particular, five specific BLAST programs are used to perform the following task:

(1)BLASTP and BLAST3 compare an amino acid query sequence against a protein sequence database;

(2)BLASTN compares a nucleotide query sequence against a nucleotide sequence database;

(3)BLASTX compares the six-frame conceptual translation products of a query nucleotide sequence (both strands) against a protein sequence database;

(4)TBLASTN compares a query protein sequence against a nucleotide sequence database translated in all six reading frames (both strands); and (5)TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443–1445; Henikoff and Henikoff, 1993, *Proteins* 17:49–61). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation)

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267–2268).

Equivalent amino acids may be determined either based on their structural homology with the amino acids for which they are substituted, or on results of comparative tests of biological activity between the various polypeptides which may be carried out.

By way of example, there may be mentioned the possibilities of substitutions which may be carried out without resulting in a substantial modification of the biological activity of the corresponding modified polypeptides; the replacements, for example, of leucine with valine or isoleucine, of aspartic acid with glutamic acid, of glutamine with asparagine, of arginine with lysine, and the like, the reverse substitutions naturally being feasible under the same conditions.

The homologous polypeptides also correspond to the polypeptides encoded by the homologous nucleotide sequences as defined above and thus comprise in the present definition the mutated polypeptides or polypeptides corresponding to inter- or intra-species variations which may exist in *Chlamydia*, and which correspond in particular to truncations, substitutions, deletions and/or additions of at least one amino acid residue.

Biologically active fragment of a polypeptide according to the invention will be understood to designate in particular a polypeptide fragment, as defined below, exhibiting at least one of the characteristics of the polypeptides according to the invention, in particular in that it is:

capable of eliciting an immune response directed against *Chlamydia trachomatis*; and/or capable of being recognized by an antibody specific for a polypeptide according to the invention; and/or capable of binding to a polypeptide or to a nucleotide sequence of *Chlamydia trachomatis*; and/or capable of modulating, regulating, inducing or inhibiting the expression of a gene of *Chlamydia trachomatis* or one of its associated microorganisms, and/or capable of modulating the replication cycle of *Chlamydia trachomatis* or one of its associated microorganisms in the host cell and/or organism; and/or capable of generally exerting an even partial physiological activity, such as for example a structural activity (cellular envelope, ribosome), an enzymatic (metabolic) activity, a transport activity, an activity in the secretion or in the virulence.

A representative polypeptide fragment according to the invention is understood to designate a polypeptide comprising a minimum of 5 amino acids, preferably 10 amino acids or preferably 15 amino acids. It is to be understood that such fragments refer only to portions of polypeptides encoded by ORF2 or ORF1197 that are not currently listed in a publicly available database.

The polypeptide fragments according to the invention may correspond to isolated or purified fragments which are naturally present in *Chlamydia trachomatis* or which are secreted by *Chlamydia trachomatis*, or may correspond to fragments capable of being obtained by cleaving the said polypeptide with a proteolytic enzyme, such as trypsin or chymotrypsin or collagenase, or with a chemical reagent, such as cyanogen bromide (CNBr) or alternatively by placing the said polypeptide in a highly acidic environment, for example at pH 2.5. Such polypeptide fragments may be equally well prepared by chemical synthesis, using hosts transformed with an expression vector according to the invention containing a nucleic acid allowing the expression of the said fragments, placed under the control of appropriate elements for regulation and/or expression.

<<Modified polypeptide>> of a polypeptide according to the invention is understood to designate a polypeptide obtained by genetic recombination or by chemical synthesis as will be described below, exhibiting at least one modification in relation to the normal sequence. These modifications may in particular affect amino acids responsible for a specificity or for the efficiency of the activity, or responsible for the structural conformation, for the charge or for the hydrophobicity, and for the capacity for multimerization and for membrane insertion of the polypeptide according to the invention. It is thus possible to create polypeptides with an equivalent, an increased or a reduced activity, and with an equivalent, a narrower or a broader specificity. Among the modified polypeptides, there may be mentioned the polypeptides in which up to 5 amino acids may be modified, truncated at the N- or C-terminal end, or alternatively deleted, or else added.

As is indicated, the modifications of the polypeptide may have in particular the objective:

of making it capable of modulating, regulating, inhibiting or inducing the expression of a gene of Chlamydia, in particular of *Chlamydia trachomatis* and its variants, or one of its associated micro-organisms, and/or capable of modulating the replication cycle of *Chlamydia*, in particular of *Chlamydia trachomatis* and its variants, or one of its associated microorganisms, in the host cell and/or organism, of allowing its use in methods of biosynthesis or of biodegradation, or its incorporation into vaccine compositions, of modifying its bioavailability as a compound for therapeutic use.

The said modified polypeptides may also be used on any cell or microorganism for which the said modified polypeptides will be capable of modulating, regulating, inhibiting or inducing gene expression, or of modulating the growth or the replication cycle of the said cell or of the said microorganism. The methods allowing demonstration of the said modulations on eukaryotic or prokaryotic cells are well known to persons skilled in the art. The said cells or microorganisms will be chosen, in particular, from tumour cells or infectious microorganisms and the said modified polypeptides may be used for the prevention or treatment of pathologies linked to the presence of the said cells or of the said microorganisms. It is also clearly understood that the nucleotide sequences encoding the said modified polypeptides may be used for the said modulations, for example by the intermediacy of vectors according to the invention and which are described below, so as to prevent or to treat the said pathologies.

The above modified polypeptides may be obtained using combinatory chemistry, in which it is possible to systematically vary portions of the polypeptide before testing them on models, cell cultures or microorganisms for example, so as to select the compounds which are the most active or which exhibit the desired properties.

Chemical synthesis also has the advantage of being able to use:

nonnatural amino acids, or nonpeptide bonds.

Accordingly, in order to extend the life of the polypeptides according to the invention, it may be advantageous to use nonnatural amino acids, for example in the D form, or alternatively amino acid analogues, in particular sulphur-containing forms for example.

Finally, the structure of the polypeptides according to the invention, its homologous or modified forms, as well as the corresponding fragments may be integrated into chemical structures of the polypeptide type and the like. Accordingly, it may be advantageous to provide at the N- and C-terminal ends compounds which are not recognized by proteases.

Also forming part of the invention are the nucleotide sequences encoding a polypeptide according to the invention. Described below are ORF nucleotide sequences encoding polypeptides exhibiting particularly preferable characteristics. For each group of preferred ORFs described below, it is to be understood that in addition to the individual ORFs listed, in instances wherein such ORFs are present as part of <<combined>> ORFs, the <<combined>> ORFs are also to be included within the preferred group.

More particularly, the subject of the invention is nucleotide sequences, characterized in that they encode a polypeptide of the cellular envelope, preferably of the outer cellular envelope of *Chlamydia trachomatis* or one of its representative fragments, such as for example the predominant proteins of the outer membrane, the adhesion proteins or the proteins entering into the composition of the *Chlamydia* wall. Among these sequences, the sequences comprising a nucleotide sequence chosen from the following sequences are most preferred:

ORF3; ORF19; ORF51; ORF189; ORF212; ORF213; ORF324; ORF477; ORF478; ORF479; ORF481; ORF482; ORF483; ORF484; ORF486; ORF488; ORF489; ORF490; ORF572; ORF573; ORF742; ORF817; ORF818; ORF820; ORF1035; ORF1036; ORF1037; ORF1038; ORF1070; ORF1071; ORF1073 and one of their representative fragments.

The structure of the cytoplasmic membranes and of the wall of bacteria is dependent on the associated proteins. The structure of the cytoplasmic membrane makes it impermeable to water, to water-soluble substances and to small-sized molecules (ions, small inorganic molecules, peptides or proteins). To enter into or to interfere with a cell or a bacterium, a ligand must establish a special relationship with a protein anchored in the cytoplasmic membrane (the receptor). These proteins which are anchored on the membrane play an important role in metabolism since they control the exchanges in the bacterium. These exchanges apply to molecules of interest for the bacterium (small molecules such as sugars and small peptides) as well as undesirable molecules for the bacterium such as antibiotics or heavy metals.

The double lipid layer structure of the membrane requires the proteins which are inserted therein to have hydrophobic domains of about twenty amino acids forming an alpha helix. Predominantly hydrophobic and potentially transmembrane regions may be predicted from the primary sequence of the proteins, itself deduced from the nucleotide sequence. The presence of one or more putative transmembrane domains raises the possibility for a protein to be associated with the cytoplasmic membrane and to be able to play an important metabolic role therein or alternatively for the protein thus exposed to be able to exhibit potentially protective epitopes.

If the proteins inserted into the membrane exhibit several transmembrane domains capable of interacting with one another via electrostatic bonds, it then becomes possible for these proteins to form pores which go across the membrane which becomes permeable for a number of substances. It should be noted that proteins which do not have transmembrane domains may also be anchored by the intermediacy of fatty acids in the cytoplasmic membrane, it being possible for the breaking of the bond between the protein and its anchor in some cases to be responsible for the release of the peptide outside the bacterium.

Preferably, the invention relates to the nucleotide sequences according to the invention, characterized in that they encode a *Chlamydia trachomatis* transmembrane polypeptide or one of its representative fragments, having between 1 and 3 transmembrane domains and in that they comprise a nucleotide sequence chosen from the following sequences:

ORF2; ORF3; ORF5; ORF8; ORF9; ORF10; ORF11; ORF12; ORF17; ORF21; ORF26; ORF27; ORF28; ORF29; ORF30; ORF31; ORF33; ORF35; ORF37; ORF39; ORF40; ORF41; ORF42; ORF43; ORF44; ORF45; ORF46; ORF47; ORF48; ORF49; ORF52; ORF53; ORF55; ORF56; ORF58; ORF65; ORF66; ORF68; ORF70; ORF74; ORF75; ORF76; ORF78; ORF79; ORF81; ORF82; ORF83; ORF86; ORF91; ORF92; ORF94; ORF97; ORF100; ORF102; ORF103; ORF105; ORF106; ORF107; ORF109; ORF110; ORF111; ORF112; ORF113; ORF114; ORF115; ORF116; ORF117; ORF120; ORF122; ORF123; ORF130; ORF134; ORF135; ORF137; ORF140; ORF141; ORF143; ORF144; ORF145; ORF147; ORF148; ORF149; ORF150; ORF151; ORF155; ORF156; ORF173; ORF175; ORF176; ORF177; ORF181; ORF183; ORF184; ORF186; ORF187; ORF188; ORF190; ORF191; ORF192; ORF194; ORF195; ORF196; ORF197; ORF198; ORF199; ORF201; ORF202; ORF204; ORF206; ORF207; ORF209; ORF212; ORF213; ORF217; ORF219; ORF220; ORF221; ORF222; ORF223; ORF224; ORF225; ORF227; ORF228; ORF231; ORF232; ORF234; ORF236; ORF237; ORF243; ORF244; ORF245; ORF247; ORF248; ORF249; ORF252; ORF254; ORF257; ORF260; ORF261; ORF263; ORF265; ORF266; ORF267; ORF270; ORF271; ORF272; ORF274; ORF276; ORF277; ORF278; ORF279; ORF282; ORF283; ORF284; ORF285; ORF287; ORF289; ORF290; ORF291; ORF294; ORF298; ORF305; ORF306; ORF310; ORF311; ORF313; ORF315; ORF316; ORF319; ORF320; ORF322; ORF323; ORF325; ORF326; ORF327; ORF328; ORF330; ORF331; ORF332; ORF333; ORF334; ORF335; ORF336; ORF338; ORF339; ORF340; ORF341; ORF344; ORF345; ORF348; ORF349; ORF350; ORF351; ORF352; ORF353; ORF356; ORF357; ORF358; ORF361; ORF362; ORF366; ORF367; ORF368; ORF370; ORF372; ORF373; ORF375; ORF377; ORF378; ORF379; ORF380; ORF382; ORF383; ORF384; ORF385; ORF387; ORF389; ORF390; ORF391; ORF393; ORF396; ORF398; ORF399; ORF403; ORF404; ORF406; ORF407; ORF413; ORF414; ORF417; ORF418; ORF420; ORF421; ORF424; ORF426; ORF427; ORF428; ORF430; ORF433; ORF434; ORF435; ORF436; ORF437; ORF440; ORF443; ORF446; ORF448; ORF450; ORF451; ORF454; ORF455; ORF457; ORF458; ORF459; ORF463; ORF464; ORF466; ORF467; ORF468; ORF469; ORF470; ORF473; ORF474; ORF475; ORF476; ORF477; ORF479; ORF480; ORF481; ORF483; ORF484; ORF485; ORF486; ORF487; ORF488; ORF491; ORF493; ORF496; ORF497; ORF498; ORF500; ORF501; ORF503; ORF504; ORF508; ORF512; ORF513; ORF514; ORF519; ORF521; ORF523; ORF524; ORF526; ORF527; ORF529; ORF530; ORF531; ORF532; ORF534; ORF536; ORF537; ORF538; ORF540; ORF541; ORF542; ORF543; ORF544; ORF545; ORF546; ORF547; ORF551; ORF552; ORF553; ORF555; ORF558; ORF559; ORF560; ORF561; ORF562; ORF566; ORF567; ORF568; ORF569; ORF571; ORF572; ORF574; ORF575; ORF576; ORF580; ORF582; ORF585; ORF587; ORF589; ORF592; ORF593; ORF595; ORF596; ORF597; ORF599; ORF601; ORF602; ORF603; ORF604; ORF608; ORF609; ORF610; ORF611; ORF615; ORF616; ORF617; ORF618; ORF621; ORF622; ORF623; ORF624; ORF625; ORF628; ORF632; ORF633; ORF634; ORF635; ORF637; ORF638; ORF640; ORF641; ORF643; ORF646; ORF648; ORF649; ORF651; ORF652; ORF653; ORF654; ORF655; ORF658; ORF664; ORF665; ORF666; ORF668; ORF669; ORF670; ORF671; ORF672; ORF673; ORF674; ORF676; ORF677; ORF678; ORF680; ORF682; ORF683; ORF684; ORF686; ORF688; ORF689; ORF690; ORF691; ORF692; ORF693; ORF695; ORF696; ORF698; ORF701; ORF703; ORF704; ORF705; ORF706; ORF707; ORF709; ORF710; ORF711; ORF712; ORF713; ORF714; ORF715; ORF717; ORF718; ORF720; ORF721; ORF722; ORF724; ORF726; ORF728; ORF729; ORF730; ORF731; ORF732; ORF733; ORF734; ORF737; ORF738; ORF739; ORF740; ORF742; ORF743; ORF744; ORF745; ORF746; ORF748; ORF750; ORF751; ORF752; ORF753; ORF754; ORF755; ORF757; ORF758; ORF759; ORF760; ORF764; ORF766; ORF768; ORF769; ORF771; ORF772; ORF773; ORF774; ORF775; ORF776; ORF777; ORF778; ORF779; ORF780; ORF781; ORF782; ORF783; ORF786; ORF787; ORF788; ORF789; ORF790; ORF793; ORF798; ORF800; ORF802; ORF803; ORF806; ORF808; ORF809; ORF810; ORF811; ORF813; ORF814; ORF817; ORF820; ORF822; ORF824; ORF825; ORF827; ORF828; ORF829; ORF830; ORF833; ORF834; ORF835; ORF837; ORF838; ORF839; ORF840; ORF841; ORF842; ORF843; ORF845; ORF848; ORF849; ORF850; ORF851; ORF852; ORF854; ORF855; ORF856; ORF857; ORF859; ORF860; ORF862; ORF863; ORF864; ORF866; ORF869; ORF872; ORF873; ORF874; ORF878; ORF879; ORF880; ORF881; ORF883; ORF884; ORF885; ORF886; ORF887; ORF892; ORF893; ORF894; ORF895; ORF897; ORF899; ORF900; ORF901; ORF904; ORF906; ORF909; ORF910; ORF912; ORF914; ORF917; ORF920; ORF921; ORF922; ORF923; ORF924; ORF925; ORF926; ORF927; ORF930; ORF933; ORF934; ORF935; ORF936; ORF937; ORF940; ORF941; ORF942; ORF943; ORF944; ORF945; ORF947; ORF948; ORF951; ORF952; ORF953; ORF954; ORF955; ORF956; ORF957; ORF958; ORF960; ORF961; ORF962; ORF963; ORF964; ORF966; ORF967; ORF969; ORF970; ORF971; ORF973; ORF974; ORF979;

ORF980; ORF981; ORF982; ORF984; ORF988; ORF989; ORF990; ORF991; ORF995; ORF996; ORF999; ORF1001; ORF1003; ORF1004; ORF1005; ORF1006; ORF1007; ORF1009; ORF1010; ORF1011; ORF1012; ORF1013; ORF1014; ORF1016; ORF1017; ORF1018; ORF1020; ORF1021; ORF1025; ORF1026; ORF1027; ORF1029; ORF1030; ORF1031; ORF1035; ORF1036; ORF1037; ORF1038; ORF1039; ORF1040; ORF1044; ORF1045; ORF1047; ORF1048; ORF1050; ORF1051; ORF1052; ORF1053; ORF1055; ORF1056; ORF1057; ORF1058; ORF1061; ORF1062; ORF1063; ORF1064; ORF1065; ORF1066; ORF1068; ORF1069; ORF1072; ORF1074; ORF1076 and one of their representative fragments.

Preferably, the invention relates to the nucleotide sequences according to the invention, characterized in that they encode a *Chlamydia trachomatis* transmembrane polypeptide or one of its representative fragments, having between 4 and 6 transmembrane domains and in that they comprise a nucleotide sequence chosen from the following sequences:

ORF7; ORF14; ORF16; ORF32; ORF34; ORF36; ORF38; ORF50; ORF57; ORF59; ORF61; ORF62; ORF63; ORF64; ORF67; ORF69; ORF72; ORF77; ORF80; ORF84; ORF87; ORF93; ORF95; ORF99; ORF108; ORF119; ORF125; ORF126; ORF129; ORF131; ORF136; ORF139; ORF146; ORF152; ORF154; ORF160; ORF161; ORF172; ORF179; ORF182; ORF185; ORF200; ORF203; ORF205; ORF239; ORF242; ORF250; ORF253; ORF256; ORF259; ORF262; ORF268; ORF275; ORF281; ORF286; ORF288; ORF292; ORF295; ORF296; ORF297; ORF299; ORF300; ORF308; ORF314; ORF317; ORF318; ORF324; ORF342; ORF343; ORF355; ORF360; ORF374; ORF376; ORF386; ORF388; ORF392; ORF394; ORF395; ORF402; ORF405; ORF411; ORF415; ORF416; ORF422; ORF423; ORF429; ORF432; ORF441; ORF442; ORF444; ORF449; ORF452; ORF456; ORF460; ORF461; ORF465; ORF471; ORF472; ORF482; ORF489; ORF492; ORF494; ORF495; ORF502; ORF505; ORF506; ORF509; ORF516; ORF517; ORF520; ORF525; ORF533; ORF539; ORF549; ORF554; ORF557; ORF563; ORF570; ORF573; ORF581; ORF590; ORF591; ORF600; ORF607; ORF612; ORF613; ORF620; ORF626; ORF629; ORF630; ORF639; ORF644; ORF647; ORF656; ORF659; ORF661; ORF685; ORF687; ORF699; ORF700; ORF708; ORF716; ORF719; ORF725; ORF747; ORF749; ORF756; ORF765; ORF767; ORF794; ORF796; ORF797; ORF799; ORF801; ORF807; ORF821; ORF823; ORF826; ORF847; ORF853; ORF861; ORF870; ORF871; ORF875; ORF882; ORF888; ORF889; ORF898; ORF902; ORF903; ORF911; ORF916; ORF931; ORF939; ORF975; ORF976; ORF978; ORF983; ORF986; ORF987; ORF992; ORF993; ORF1000; ORF1002; ORF1008; ORF1019; ORF1022; ORF1032; ORF1034; ORF1046; ORF1054; ORF1060; ORF1071 and one of their representative fragments.

Preferably, the invention also relates to the nucleotide sequences according to the invention, characterized in that they encode a *Chlamydia trachomatis* transmembrane polypeptide or one of its representative fragments, having at least 7 transmembrane domains and in that they comprise a nucleotide sequence chosen from the following sequences:

ORF4; ORF6; ORF13; ORF20; ORF51; ORF71; ORF88; ORF118; ORF128; ORF132; ORF133; ORF158; ORF159; ORF174; ORF180; ORF189; ORF210; ORF211; ORF214; ORF215; ORF226; ORF229; ORF233; ORF235; ORF240; ORF246; ORF251; ORF255; ORF273; ORF354; ORF364; ORF369; ORF371; ORF397; ORF401; ORF409; ORF412; ORF419; ORF439; ORF453; ORF462; ORF490; ORF510; ORF511; ORF518; ORF535; ORF548; ORF550; ORF564; ORF565; ORF578; ORF579; ORF614; ORF631; ORF636; ORF650; ORF662; ORF667; ORF679; ORF681; ORF702; ORF727; ORF741; ORF763; ORF791; ORF792; ORF815; ORF816; ORF832; ORF846; ORF858; ORF865; ORF867; ORF868; ORF877; ORF891; ORF896; ORF907; ORF908; ORF918; ORF919; ORF932; ORF959; ORF977; ORF994; ORF998; ORF1024; ORF1028; ORF1042; ORF1067; ORF1070; ORF1073 and one of their representative fragments.

Preferably, the invention relates to the nucleotide sequences according to the invention, characterized in that they encode a *Chlamydia trachomatis* surface exposed polypeptide (e.g., an outer membrane protein) or one of its representative fragments, said nucleotide sequences comprising a nucleotide sequence chosen from the following sequences:

ORF 2, ORF 3, ORF 21, ORF 22, ORF 23, ORF 53, ORF 77, ORF 187, ORF 203, ORF 383, ORF 477, ORF 478, ORF 479, ORF 481, ORF 482, ORF 483, ORF 484, ORF 485, ORF 486, ORF 487, ORF 488, ORF 489, ORF 490, ORF 571, ORF 572, ORF 573, ORF 593, ORF 670, ORF 693, ORF 742, ORF 749, ORF 801, ORF 817, ORF 818, ORF 819, ORF 820, ORF 851, ORF 902, ORF 923, ORF 1035, ORF 1036, ORF 1037, ORF 1038, ORF 1069, ORF 1070, ORF 1071, ORF 1073, ORF 1076, ORF 1095, ORF 1096, ORF 1141, ORF 1181, and their representative fragments.

Preferably, the invention relates to the nucleotide sequences according to the invention, characterized in that they encode a *Chlamydia trachomatis* lipoprotein or one of its representative fragments, said nucleotide sequences comprising a nucleotide sequence chosen from the following sequences:

ORF 29, ORF 42, ORF 66, ORF 72, ORF 76, ORF 78, ORF 148, ORF 154, ORF 180, ORF 182, ORF 184, ORF 187, ORF 200, ORF 242, ORF 245, ORF 250, ORF 253, ORF 272, ORF 274, ORF 275, ORF 308, ORF 350, ORF 362, ORF 383, ORF 394, ORF 396, ORF 399, ORF 422, ORF 488, ORF 535, ORF 568, ORF 573, ORF 578, ORF 593, ORF 607, ORF 625, ORF 662, ORF 669, ORF 688, ORF 690, ORF 716, ORF 773, ORF 778, ORF 781, ORF 783, ORF 788, ORF 817, ORF 848, ORF 851, ORF 853, ORF 857, ORF 875, ORF 877, ORF 886, ORF 898, ORF 902, ORF 923, ORF 938, ORF 976, ORF 978, ORF 990, ORF 1005, ORF 1021, ORF 1035, ORF 1069, ORF 1083, ORF 1088, ORF 1089, ORF 1091, ORF 1092, ORF 1095, ORF 1096, ORF 1100, ORF 1105, ORF 1108, ORF 1117, ORF 1120, ORF 1121, ORF 1124, ORF 1128, ORF 1133, ORF 1135, ORF 1139, ORF 1140, ORF 1157, ORF 1159, ORF 1163, ORF 1165, ORF 1167, ORF 1168, ORF 1169, ORF 1171, ORF 1173, ORF 1174, ORF 1177, ORF 1180, ORF 1181, ORF 1186, ORF 1194, ORF 1197, and their representative fragments.

Preferably, the invention relates to the nucleotide sequences according to the invention, characterized in that they encode a *Chlamydia trachomatis* polypeptide involved in lipopolysaccharide (LPS) biosynthesis, said nucleotide sequences comprising a nucleotide sequence chosen from the following sequences: ORF 17, ORF 201, ORF 691, ORF 807, ORF 936, ORF 983, ORF 1019, ORF 1077 and one of their representative fragments.

Preferably the invention relates to additional LPS-related nucleotide sequences according to the invention, characterized in that they encode:

(a) a *Chlamydia trachomatis* KDO (3-deoxy-D-manno-octulosonic acid)-related polypeptide or one of its representative fragments, said nucleotide sequences comprising a nucleotide sequence chosen from the following sequences: ORF 41, ORF 242, ORF 269, ORF 772, and one of their representative fragments;

(b) a *Chlamydia trachomatis* phosphomannomutase-related polypeptide or one of its representative fragments, said nucleotide sequences comprising a nucleotide sequence chosen from the following sequence: ORF 139, and one of its representative fragments;

(c) a *Chlamydia trachomatis* phosphoglucomutase-related polypeptide or one of its representative fragments, said nucleotide sequences comprising a nucleotide sequence chosen from the following sequence: ORF 567, and one of its representative fragments; and (d) a *Chlamydia trachomatis* lipid A component-related polypeptide or one of its representative fragments, said nucleotide sequences comprising a nucleotide sequence chosen from the following sequences: ORF 4, ORF 933, ORF 934, ORF 935, ORF 1185, and one of their representative fragments.

Preferably, the invention relates to the nucleotide sequences according to the invention, characterized in that they encode a *Chlamydia trachomatis* Type III or other, non-Type III secreted polypeptides or one of its representative fragments, said nucleotide sequences comprising a nucleotide sequence chosen from the following sequences: ORF 180, ORF 181, ORF 207, ORF 208, ORF 372, ORF 391, ORF 399, ORF 477, ORF 486, ORF 749, ORF 758, ORF 819, ORF 878, ORF 888, ORF 896, ORF 897, ORF 900, ORF 902, ORF 923, ORF 1015, ORF 1018, ORF 1059, ORF 1060, ORF 1069, ORF 1071, ORF 1073, ORF 1076, ORF 1189, and their representative fragments.

Preferably, the invention relates to the nucleotide sequences according to the invention, characterized in that they encode a *Chlamydia trachomatis* polypeptide containing RGD (Arg-Gly-Asp) attachment sites or one of its representative fragments:

(a) RGD-containing proteins that are outer membrane proteins, are more likely to play a role in cell attachment. ORFs that encoded a protein containing an RGD sequence and also were classified as outer membrane proteins are ORF 488, ORF 489, ORF 571, ORF 572, ORF 573 or ORF 716, and its representative fragments.

(b) The outer membrane of *Chlamydia* is made of cysteine-rich proteins that form a network of both intra and inter molecular disulfide links. This contributes to the integrity of the membrane since *Chlamydia* lacks the peptidoglycan layer that other gram-negative bacteria have. Cysteine-rich proteins that have the RGD sequence are also considered to be potential vaccine candidates. Cysteine-rich proteins were defined as proteins that had more than 3.0% cysteine in their primary amino acid sequence, above the mean genomic ORF cysteine content. The corresponding ORF is: ORF 1144 and one of its representative fragments.

(c) The outer membrane of *Chlamydia* may also contain small proteins that have cysteines in their N- and C-terminus that may contribute to the network formed by disulfide linkages. These proteins may be anchored in the outer membrane via their N-terminus and may have their C-terminus exposed, which then can interact with the host cells. Alternatively, these proteins may be anchored in the outer membrane via both N-and C-terminus and may have regions in the middle that may be exposed which can in turn interact with the host cells. ORFs encoding polypeptides that contain cysteines in their first 30 amino acids and also contain an RGD sequence are: ORF 101, ORF 122, ORF 308, ORF 488, ORF 489, ORF 571, ORF 572, ORF 573, ORF 651, ORF 679, ORF 680, ORF 705, ORF 716, ORF 763, ORF 870, ORF 878, ORF 879, ORF 995, ORF 1028, ORF 1029, ORF 1176, and one of their representative fragments.

(d) RGD-containing ORFs homologous to RGD-containing ORFs from *Chlamydia pneumoniae* are:

ORF 28, ORF 101, ORF 125, ORF 155, ORF 156, ORF 286, ORF 571, ORF 572, ORF 573, ORF 763, ORF 870, and one of their representative fragments.

Preferably, the invention relates to the nucleotide sequences according to the invention, characterized in that they encode a *Chlamydia trachomatis* cell wall anchored surface polypeptide or one of its representative fragments, said nucleotide sequences comprising a nucleotide sequence chosen from the following sequences: ORF 662, ORF 681, ORF 1182, ORF 1192, and their representative fragments.

Preferably, the invention relates to the nucleotide sequences according to the invention, characterized in that they encode *Chlamydia trachomatis* polypeptides not found in *Chlamydia pneumoniae* (Blastp P>$e^{-10}$), said nucleotide sequences comprising a nucleotide sequence chosen from the following sequences: ORF 2, ORF 18, ORF 60, ORF 66, ORF 67, ORF 68, ORF 69, ORF 70, ORF 81, ORF 89, ORF 107, ORF 108, ORF 109, ORF 134, ORF 147, ORF 191, ORF 194, ORF 216, ORF 217, ORF 218, ORF 219, ORF 220, ORF 221, ORF 222, ORF 223, ORF 224, ORF 225, ORF 228, ORF 235, ORF 257, ORF 276, ORF 277, ORF 278, ORF 279, ORF 280, ORF 281, ORF 282, ORF 283, ORF 284, ORF 285, ORF 289, ORF 291, ORF 298, ORF 313, ORF 314, ORF 315, ORF 316, ORF 334, ORF 335, ORF 336, ORF 337, ORF 338, ORF 339, ORF 340, ORF 381, ORF 393, ORF 413, ORF 418, ORF 419, ORF 420, ORF 421, ORF 422, ORF 423, ORF 436, ORF 460, ORF 475, ORF 476, ORF 480, ORF 485, ORF 487, ORF 491, ORF 492, ORF 493, ORF 494, ORF 496, ORF 500, ORF 504, ORF 514, ORF 527, ORF 559, ORF 569, ORF 570, ORF 575, ORF 580, ORF 582, ORF 593, ORF 598, ORF 632, ORF 640, ORF 651, ORF 671, ORF 690, ORF 694, ORF 698, ORF 710, ORF 722, ORF 723, ORF 724, ORF 770, ORF 771, ORF 782, ORF 783, ORF 784, ORF 790, ORF 795, ORF 798, ORF 805, ORF 810, ORF 817, ORF 829, ORF 830, ORF 864, ORF 866, ORF 876, ORF 887, ORF 892, ORF 899, ORF 913, ORF 921, ORF 933, ORF 938, ORF 949, ORF 956, ORF 1010, ORF 1017, ORF 1018, ORF 1027, ORF 1030, ORF 1037, ORF 1038, ORF 1047, ORF 1072, ORF 1074, ORF 1075, ORF 1078, ORF 1079, ORF 1081, ORF 1083, ORF 1084, ORF 1087, ORF 1088, ORF 1089, ORF 1091, ORF 1092, ORF 1094, ORF 1095, ORF 1096, ORF 1098, ORF 1104, ORF 1105, ORF 1106, ORF 1108, ORF 1110, ORF 1114, ORF 1115, ORF 1116, ORF 1117, ORF 1119, ORF 1128, ORF 1132, ORF 1133, ORF 1135, ORF 1136, ORF 1139, ORF 1140, ORF 1141, ORF 1142, ORF 1144, ORF 1148, ORF 1151, ORF 1155, ORF 1157, ORF 1159, ORF 1161, ORF 1162, ORF 1165, ORF 1166, ORF 1167, ORF 1168, ORF 1169, ORF 1171, ORF 1172, ORF 1173, ORF 1174, ORF 1175, ORF 1176, ORF 1177, ORF 1178, ORF 1180, ORF 1181, ORF 1183, ORF 1184, ORF 1186, ORF 1187, ORF 1188, ORF 1192, ORF 1194, ORF 1197, and their representative fragments.

Preferably, the invention also relates to the nucleotide sequences according to the invention, characterized in that they encode a *Chlamydia trachomatis* polypeptide or one of its representative fragments which is involved in the intermediate metabolism, in particular in the metabolism of sugars and/or of cofactors, such as for example triose phosphate isomerase or pyruvate kinase, and in that they comprise a nucleotide sequence chosen from the following sequences:

ORF10; ORF44; ORF45; ORF46; ORF47; ORF93; ORF101; ORF102; ORF103; ORF106; ORF107; ORF120; ORF121; ORF130; ORF135; ORF140; ORF143; ORF144; ORF145; ORF158; ORF159; ORF160; ORF161; ORF192; ORF193; ORF196; ORF197; ORF198; ORF199; ORF227; ORF229; ORF236; ORF236; ORF239; ORF243; ORF245; ORF264; ORF265; ORF297; ORF331; ORF333; ORF359; ORF360; ORF374; ORF404; ORF405; ORF405; ORF410; ORF415; ORF415; ORF416; ORF417; ORF432; ORF460; ORF461; ORF462; ORF495; ORF513; ORF515; ORF566; ORF566; ORF566; ORF589; ORF613; ORF645; ORF646; ORF647; ORF652; ORF653; ORF654; ORF672; ORF673; ORF674; ORF682; ORF684; ORF692; ORF700; ORF725; ORF801; ORF802; ORF835; ORF836; ORF837; ORF860; ORF861; ORF862; ORF863; ORF869; ORF869; ORF925; ORF964; ORF983 and one of their representative fragments.

Preferably, the invention also relates to the nucleotide sequences according to the invention, characterized in that they encode a *Chlamydia trachomatis* polypeptide or one of its representative fragments which is involved in the intermediate metabolism of nucleotides or nucleic acids, such as for example CTP synthetase or GMP synthetase, and in that they comprise a nucleotide sequence chosen from the following sequences:

ORF142; ORF142; ORF169; ORF256; ORF268; ORF325; ORF352; ORF366; ORF435; ORF444; ORF528; ORF529; ORF530; ORF548; ORF549; ORF601; ORF602; ORF617; ORF619; ORF644; ORF745; ORF971; ORF972; ORF1023 and one of their representative fragments.

Preferably, the invention also relates to the nucleotide sequences according to the invention, characterized in that they encode a *Chlamydia trachomatis* polypeptide or one of its representative fragments which is involved in the metabolism of nucleic acids, such as for example DNA polymerases or DNA topoisomerases, and in that they comprise a nucleotide sequence chosen from the following sequences:

ORF5; ORF12; ORF82; ORF96; ORF97; ORF98; ORF99; ORF100; ORF105; ORF118; ORF136; ORF137; ORF163; ORF190; ORF204; ORF259; ORF260; ORF262; ORF290; ORF300; ORF301; ORF302; ORF387; ORF427; ORF434; ORF441; ORF444; ORF471; ORF595; ORF596; ORF597; ORF599; ORF600; ORF605; ORF612; ORF624; ORF625; ORF650; ORF657; ORF658; ORF702; ORF703; ORF704; ORF708; ORF719; ORF766; ORF767; ORF775; ORF779; ORF787; ORF788; ORF794; ORF841; ORF842; ORF883; ORF884; ORF907; ORF918; ORF924; ORF928; ORF929; ORF962; ORF962; ORF963; ORF969; ORF970; ORF975; ORF979; ORF995; ORF1031; ORF1032 and one of their representative fragments.

Preferably, the invention also relates to the nucleotide sequences according to the invention, characterized in that they encode a *Chlamydia trachomatis* polypeptide or one of its representative fragments which is involved in the metabolism of amino acids or polypeptides, such as for example serine hydroxymethyl transferase or the proteins which load amino acids onto transfer RNAs, and in that they comprise a nucleotide sequence chosen from the following sequences:

ORF27; ORF41; ORF55; ORF56; ORF57; ORF59; ORF62; ORF63; ORF64; ORF65; ORF119; ORF132; ORF240; ORF241; ORF277; ORF278; ORF279; ORF382; ORF406; ORF428; ORF442; ORF446; ORF447; ORF453; ORF454; ORF541; ORF542; ORF591; ORF608; ORF609; ORF610; ORF618; ORF648; ORF649; ORF660; ORF661; ORF677; ORF717; ORF765; ORF797; ORF871; ORF875; ORF920; ORF922; ORF937; ORF998; ORF1020; ORF1021; ORF1034; ORF1044; ORF1046; ORF1049 and one of their representative fragments.

Preferably, the invention also relates to the nucleotide sequences according to the invention, characterized in that they encode a *Chlamydia trachomatis* polypeptide or one of its representative fragments which is involved in the metabolism of polypeptides, such as for example protein kinases or proteases, and in that they comprise a nucleotide sequence chosen from the following sequences:

ORF21; ORF22; ORF23; ORF24; ORF25; ORF26; ORF75; ORF84; ORF86; ORF92; ORF133; ORF151; ORF152; ORF157; ORF179; ORF209; ORF307; ORF326; ORF343; ORF344; ORF345; ORF371; ORF429; ORF519; ORF557; ORF586; ORF587; ORF630; ORF656; ORF706; ORF707; ORF730; ORF751; ORF752; ORF786; ORF847; ORF885; ORF923; ORF978; ORF1039; ORF1048 and one of their representative fragments.

Preferably, the invention also relates to the nucleotide sequences according to the invention, characterized in that they encode a *Chlamydia trachomatis* polypeptide or one of its representative fragments which is involved in the metabolism of fatty acids, such as for example succinyl-CoA-synthesizing proteins or phosphatidylserine synthetase, and in that they comprise a nucleotide sequence chosen from the following sequences:

ORF4; ORF15; ORF16; ORF141; ORF173; ORF205; ORF205; ORF206; ORF207; ORF208; ORF312; ORF355; ORF415; ORF550; ORF558; ORF560; ORF561; ORF574; ORF574; ORF577; ORF578; ORF590; ORF614; ORF772; ORF808; ORF809; ORF904; ORF905; ORF905; ORF933; ORF934; ORF934; ORF936 and one of their representative fragments.

Preferably, the invention also relates to the nucleotide sequences according to the invention, characterized in that they encode a *Chlamydia trachomatis* polypeptide or one of its representative fragments which is involved in the synthesis of the wall, such as for example KDO transferase, and the proteins responsible for the attachment of certain sugars onto the exposed proteins, and in that they comprise a nucleotide sequence chosen from the following sequences:

ORF87; ORF196; ORF242; ORF269; ORF628; ORF629; ORF634; ORF635; ORF637; ORF638; ORF1019 and one of their representative fragments.

Preferably, the invention also relates to the nucleotide sequences according to the invention, characterized in that they encode a *Chlamydia trachomatis* polypeptide or one of its representative fragments which is involved in the transcription, translation and/or maturation process, such as for example initiation factors, RNA polymerases or certain chaperone proteins, and in that they comprise a nucleotide sequence chosen from the following sequences:

ORF112; ORF113; ORF332; ORF212; ORF213; ORF350; ORF362; ORF363; ORF364; ORF407; ORF451; ORF546; ORF643; ORF744; ORF746; ORF833; ORF868; ORF981; ORF982; ORF1003; ORF1011; ORF1042 and one of their representative fragments.

Preferably, the invention also relates to the nucleotide sequences according to the invention, characterized in that they encode a *Chlamydia trachomatis* ribosomal polypeptide or one of its representative fragments, such as for example the ribosomal proteins L21, L27 and S10, and in that they comprise a nucleotide sequence chosen from the following sequences:

ORF114; ORF115; ORF116; ORF328; ORF361; ORF375; ORF445; ORF543; ORF584; ORF585; ORF743; ORF813; ORF941; ORF942; ORF944; ORF946; ORF947; ORF948; ORF950; ORF951; ORF952; ORF953; ORF954; ORF955; ORF955; ORF957; ORF958; ORF960; ORF961; ORF1040; ORF1041; ORF1043; ORF1063; ORF1064 and one of their representative fragments.

Preferably, the invention also relates to the nucleotide sequences according to the invention, characterized in that they encode a *Chlamydia trachomatis* transport polypeptide or one of its representative fragments, such as for example the proteins for transporting amino acids, sugars and certain oligopeptides, and in that they comprise a nucleotide sequence chosen from the following sequences:

ORF6; ORF50; ORF51; ORF80; ORF125; ORF126; ORF128; ORF129; ORF215; ORF246; ORF248; ORF249; ORF251; ORF252; ORF253; ORF255; ORF271; ORF275; ORF293; ORF309; ORF323; ORF324; ORF398; ORF401; ORF449; ORF451; ORF512; ORF564; ORF565; ORF667; ORF679; ORF680; ORF711; ORF712; ORF713; ORF714; ORF715; ORF730; ORF731; ORF736; ORF737; ORF738; ORF870; ORF908; ORF919; ORF977; ORF987; ORF988; ORF992; ORF993; ORF994; ORF1028; ORF1029 and one of their representative fragments.

Preferably, the invention also relates to the nucleotide sequences according to the invention, characterized in that they encode a *Chlamydia trachomatis* polypeptide or one of its representative fragments which is involved in the virulence process, such as for example the proteins analogous to the *Escherichia coli* vacB protein, and in that they comprise a nucleotide sequence chosen from the following sequences:

ORF20; ORF815; ORF816; ORF898; ORF1059; ORF1060 and one of their representative fragments.

Preferably, the invention also relates to the nucleotide sequences according to the invention, characterized in that they encode a *Chlamydia trachomatis* polypeptide or one of its representative fragments which is involved in the secretory system and/or which is secreted, such as for example proteins homologous to proteins in the secretory system of certain bacteria such as the *Salmonellae* or the *Yersiniae*, and in that they comprise a nucleotide sequence chosen from the following sequences:

ORF758; ORF888; ORF889; ORF890; ORF891; ORF896; ORF897; ORF898 and one of their representative fragments.

Preferably, the invention also relates to nucleotide sequences according to the invention, characterized in that they encode a polypeptide specific to Chlamydiae or one of its representative fragments, and in that they comprise a nucleotide sequence chosen from the following sequences:

ORF22; ORF29; ORF31; ORF32; ORF34; ORF35; ORF39; ORF40; ORF43; ORF48; ORF49; ORF50; ORF52; ORF53; ORF54; ORF72; ORF77; ORF78; ORF87; ORF90; ORF95; ORF108; ORF110; ORF111; ORF122; ORF123; ORF124; ORF127; ORF138; ORF144; ORF146; ORF153; ORF155; ORF164; ORF166; ORF175; ORF182; ORF184; ORF186; ORF187; ORF188; ORF202; ORF210; ORF247; ORF258; ORF266; ORF267; ORF270; ORF273; ORF274; ORF295; ORF296; ORF305; ORF306; ORF309; ORF318; ORF319; ORF322; ORF326; ORF342; ORF357; ORF376; ORF379; ORF380; ORF388; ORF390; ORF400; ORF431; ORF433; ORF438; ORF443; ORF456; ORF457; ORF458; ORF464; ORF468; ORF470; ORF473; ORF486; ORF489; ORF497; ORF501; ORF503; ORF504; ORF508; ORF512; ORF521; ORF522; ORF523; ORF524; ORF533; ORF535; ORF536; ORF537; ORF538; ORF539; ORF540; ORF554; ORF563; ORF572; ORF579; ORF595; ORF603; ORF604; ORF606; ORF607; ORF615; ORF616; ORF622; ORF641; ORF642; ORF659; ORF668; ORF670; ORF693; ORF695; ORF696; ORF699; ORF703; ORF704; ORF716; ORF726; ORF728; ORF739; ORF742; ORF747; ORF750; ORF751; ORF755; ORF757; ORF759; ORF761; ORF762; ORF763; ORF764; ORF773; ORF780; ORF781; ORF789; ORF800; ORF803; ORF804; ORF818; ORF820; ORF822; ORF823; ORF824; ORF827; ORF828; ORF839; ORF849; ORF850; ORF851; ORF852; ORF855; ORF856; ORF857; ORF858; ORF859; ORF860; ORF861; ORF862; ORF863; ORF865; ORF868; ORF869; ORF870; ORF871; ORF872; ORF873; ORF874; ORF875; ORF877; ORF878; ORF880; ORF882; ORF884; ORF886; ORF893; ORF901; ORF906; ORF910; ORF912; ORF915; ORF916; ORF917; ORF926; ORF929; ORF933; ORF965; ORF967; ORF968; ORF984; ORF986; ORF989; ORF990; ORF996; ORF997; ORF1001; ORF1002; ORF1013; ORF1016; ORF1031; ORF1033; ORF1035; ORF1049; ORF1051; ORF1052; ORF1054; ORF1056; ORF1057; ORF1058; ORF1062; ORF1070; ORF1071; ORF1073 and one of their representative fragments.

Also forming part of the invention are polypeptides encoded by the polynucleotides of the invention, as well as fusion polypeptides comprising such polypeptides. In one embodiment, the polypeptides and fusion polypeptides immunoreact with seropositive serum of an individual infected with *Chlamydia trachomatis*. For example, described below, are polypeptide sequences exhibiting particularly preferable characteristics. For each group of preferred polypeptides described below, it is to be understood that in addition to the individual polypeptides listed, in instances wherein such polypeptides are encoded as part of <<combined>> ORFs, such <<combined>> polypeptides are also to be included within the preferred group.

The subject of the invention is also a polypeptide according to the invention, characterized in that it is a polypeptide of the cellular envelope, preferably of the outer cellular envelope, of *Chlamydia trachomatis* or one of its representative fragments. According to the invention, the said polypeptide is preferably chosen from the polypeptides having the following sequences:

SEQ ID No. 3; SEQ ID No. 19; SEQ ID No. 51; SEQ ID No. 189; SEQ ID No. 212; SEQ ID No. 213; SEQ ID No. 324; SEQ ID No. 477; SEQ ID No. 478; SEQ ID No. 479; SEQ ID No. 481; SEQ ID No. 482; SEQ ID No. 483; SEQ ID No. 484; SEQ ID No. 486; SEQ ID No. 488; SEQ ID No. 489; SEQ ID No. 490; SEQ ID No. 572; SEQ ID No. 573; SEQ ID No. 742; SEQ ID No. 817; SEQ ID No. 818; SEQ ID No. 820; SEQ ID No. 1035; SEQ ID No. 1036; SEQ ID No. 1037; SEQ ID No. 1038; SEQ ID No. 1070; SEQ ID No. 1071; SEQ ID No. 1073 and one of their representative fragments.

Preferably, the invention relates to a polypeptide according to the invention, characterized in that it is a *Chlamydia trachomatis* transmembrane polypeptide or one of its representative fragments, having between 1 and 3 transmembrane domains, and in that it is chosen from the polypeptides having the following sequences:

SEQ ID No. 2; SEQ ID No. 3; SEQ ID No. 5; SEQ ID No. 8; SEQ ID No. 9; SEQ ID No. 10; SEQ ID No. 11; SEQ ID No. 12; SEQ ID No. 17; SEQ ID No. 21; SEQ ID No. 26;

SEQ ID No. 27; SEQ ID No. 28; SEQ ID No. 29; SEQ ID No. 30; SEQ ID No. 31; SEQ ID No. 33; SEQ ID No. 35; SEQ ID No. 37; SEQ ID No. 39; SEQ ID No. 40; SEQ ID No. 41; SEQ ID No. 42; SEQ ID No. 43; SEQ ID No. 44; SEQ ID No. 45; SEQ ID No. 46; SEQ ID No. 47; SEQ ID No. 48; SEQ ID No. 49; SEQ ID No. 52; SEQ ID No. 53; SEQ ID No. 55; SEQ ID No. 56; SEQ ID No. 58; SEQ ID No. 65; SEQ ID No. 66; SEQ ID No. 68; SEQ ID No. 70; SEQ ID No. 74; SEQ ID No. 75; SEQ ID No. 76; SEQ ID No. 78; SEQ ID No. 79; SEQ ID No. 81; SEQ ID No. 82; SEQ ID No. 83; SEQ ID No. 86; SEQ ID No. 91; SEQ ID No. 92; SEQ ID No. 94; SEQ ID No. 97; SEQ ID No. 100; SEQ ID No. 102; SEQ ID No. 103; SEQ ID No. 105; SEQ ID No. 106; SEQ ID No. 107; SEQ ID No. 109; SEQ ID No. 110; SEQ ID No. 111; SEQ ID No. 112; SEQ ID No. 113; SEQ ID No. 114; SEQ ID No. 115; SEQ ID No. 116; SEQ ID No. 117; SEQ ID No. 120; SEQ ID No. 122; SEQ ID No. 123; SEQ ID No. 130; SEQ ID No. 134; SEQ ID No. 135; SEQ ID No. 137; SEQ ID No. 140; SEQ ID No. 141; SEQ ID No. 143; SEQ ID No. 144; SEQ ID No. 145; SEQ ID No. 147; SEQ ID No. 148; SEQ ID No. 149; SEQ ID No. 150; SEQ ID No. 151; SEQ ID No. 155; SEQ ID No. 156; SEQ ID No. 162; SEQ ID No. 163; SEQ ID No. 164; SEQ ID No. 165; SEQ ID No. 166; SEQ ID No. 167; SEQ ID No. 168; SEQ ID No. 169; SEQ ID No. 170; SEQ ID No. 171; SEQ ID No. 173; SEQ ID No. 175; SEQ ID No. 176; SEQ ID No. 177; SEQ ID No. 181; SEQ ID No. 183; SEQ ID No. 184; SEQ ID No. 186; SEQ ID No. 187; SEQ ID No. 188; SEQ ID No. 190; SEQ ID No. 191; SEQ ID No. 192; SEQ ID No. 194; SEQ ID No. 195; SEQ ID No. 196; SEQ ID No. 197; SEQ ID No. 198; SEQ ID No. 199; SEQ ID No. 201; SEQ ID No. 202; SEQ ID No. 204; SEQ ID No. 206; SEQ ID No. 207; SEQ ID No. 209; SEQ ID No. 212; SEQ ID No. 213; SEQ ID No. 217; SEQ ID No. 219; SEQ ID No. 220; SEQ ID No. 221; SEQ ID No. 222; SEQ ID No. 223; SEQ ID No. 224; SEQ ID No. 225; SEQ ID No. 227; SEQ ID No. 228; SEQ ID No. 231; SEQ ID No. 232; SEQ ID No. 234; SEQ ID No. 236; SEQ ID No. 237; SEQ ID No. 243; SEQ ID No. 244; SEQ ID No. 245; SEQ ID No. 247; SEQ ID No. 248; SEQ ID No. 249; SEQ ID No. 252; SEQ ID No. 254; SEQ ID No. 257; SEQ ID No. 260; SEQ ID No. 261; SEQ ID No. 263; SEQ ID No. 265; SEQ ID No. 266; SEQ ID No. 267; SEQ ID No. 270; SEQ ID No. 271; SEQ ID No. 272; SEQ ID No. 274; SEQ ID No. 276; SEQ ID No. 277; SEQ ID No. 278; SEQ ID No. 279; SEQ ID No. 282; SEQ ID No. 283; SEQ ID No. 284; SEQ ID No. 285; SEQ ID No. 287; SEQ ID No. 289; SEQ ID No. 290; SEQ ID No. 291; SEQ ID No. 294; SEQ ID No. 298; SEQ ID No. 305; SEQ ID No. 306; SEQ ID No. 310; SEQ ID No. 311; SEQ ID No. 313; SEQ ID No. 315; SEQ ID No. 316; SEQ ID No. 319; SEQ ID No. 320; SEQ ID No. 322; SEQ ID No. 323; SEQ ID No. 325; SEQ ID No. 326; SEQ ID No. 327; SEQ ID No. 328; SEQ ID No. 330; SEQ ID No. 331; SEQ ID No. 332; SEQ ID No. 333; SEQ ID No. 334; SEQ ID No. 335; SEQ ID No. 336; SEQ ID No. 338; SEQ ID No. 339; SEQ ID No. 340; SEQ ID No. 341; SEQ ID No. 344; SEQ ID No. 345; SEQ ID No. 348; SEQ ID No. 349; SEQ ID No. 350; SEQ ID No. 351; SEQ ID No. 352; SEQ ID No. 353; SEQ ID No. 356; SEQ ID No. 357; SEQ ID No. 358; SEQ ID No. 361; SEQ ID No. 362; SEQ ID No. 366; SEQ ID No. 367; SEQ ID No. 368; SEQ ID No. 370; SEQ ID No. 372; SEQ ID No. 373; SEQ ID No. 375; SEQ ID No. 377; SEQ ID No. 378; SEQ ID No. 379; SEQ ID No. 380; SEQ ID No. 382; SEQ ID No. 383; SEQ ID No. 384; SEQ ID No. 385; SEQ ID No. 387; SEQ ID No. 389; SEQ ID No. 390; SEQ ID No. 391; SEQ ID No. 393; SEQ ID No. 396; SEQ ID No. 398; SEQ ID No. 399; SEQ ID No. 403; SEQ ID No. 404; SEQ ID No. 406; SEQ ID No. 407; SEQ ID No. 413; SEQ ID No. 414; SEQ ID No. 417; SEQ ID No. 418; SEQ ID No. 420; SEQ ID No. 421; SEQ ID No. 424; SEQ ID No. 426; SEQ ID No. 427; SEQ ID No. 428; SEQ ID No. 430; SEQ ID No. 433; SEQ ID No. 434; SEQ ID No. 435; SEQ ID No. 436; SEQ ID No. 437; SEQ ID No. 440; SEQ ID No. 443; SEQ ID No. 446; SEQ ID No. 448; SEQ ID No. 450; SEQ ID No. 451; SEQ ID No. 454; SEQ ID No. 455; SEQ ID No. 457; SEQ ID No. 458; SEQ ID No. 459; SEQ ID No. 463; SEQ ID No. 464; SEQ ID No. 466; SEQ ID No. 467; SEQ ID No. 468; SEQ ID No. 469; SEQ ID No. 470; SEQ ID No. 473; SEQ ID No. 474; SEQ ID No. 475; SEQ ID No. 476; SEQ ID No. 477; SEQ ID No. 479; SEQ ID No. 480; SEQ ID No. 481; SEQ ID No. 483; SEQ ID No. 484; SEQ ID No. 485; SEQ ID No. 486; SEQ ID No. 487; SEQ ID No. 488; SEQ ID No. 491; SEQ ID No. 493; SEQ ID No. 496; SEQ ID No. 497; SEQ ID No. 498; SEQ ID No. 500; SEQ ID No. 501; SEQ ID No. 503; SEQ ID No. 504; SEQ ID No. 508; SEQ ID No. 512; SEQ ID No. 513; SEQ ID No. 514; SEQ ID No. 519; SEQ ID No. 521; SEQ ID No. 523; SEQ ID No. 524; SEQ ID No. 526; SEQ ID No. 527; SEQ ID No. 529; SEQ ID No. 530; SEQ ID No. 531; SEQ ID No. 532; SEQ ID No. 534; SEQ ID No. 536; SEQ ID No. 537; SEQ ID No. 538; SEQ ID No. 540; SEQ ID No. 541; SEQ ID No. 542; SEQ ID No. 543; SEQ ID No. 544; SEQ ID No. 545; SEQ ID No. 546; SEQ ID No. 547; SEQ ID No. 551; SEQ ID No. 552; SEQ ID No. 553; SEQ ID No. 555; SEQ ID No. 558; SEQ ID No. 559; SEQ ID No. 560; SEQ ID No. 561; SEQ ID No. 562; SEQ ID No. 566; SEQ ID No. 567; SEQ ID No. 568; SEQ ID No. 569; SEQ ID No. 571; SEQ ID No. 572; SEQ ID No. 574; SEQ ID No. 575; SEQ ID No. 576; SEQ ID No. 580; SEQ ID No. 582; SEQ ID No. 585; SEQ ID No. 587; SEQ ID No. 589; SEQ ID No. 592; SEQ ID No. 593; SEQ ID No. 595; SEQ ID No. 596; SEQ ID No. 597; SEQ ID No. 599; SEQ ID No. 601; SEQ ID No. 602; SEQ ID No. 603; SEQ ID No. 604; SEQ ID No. 608; SEQ ID No. 609; SEQ ID No. 610; SEQ ID No. 611; SEQ ID No. 615; SEQ ID No. 616; SEQ ID No. 617; SEQ ID No. 618; SEQ ID No. 621; SEQ ID No. 622; SEQ ID No. 623; SEQ ID No. 624; SEQ ID No. 625; SEQ ID No. 628; SEQ ID No. 632; SEQ ID No. 633; SEQ ID No. 634; SEQ ID No. 635; SEQ ID No. 637; SEQ ID No. 638; SEQ ID No. 640; SEQ ID No. 641; SEQ ID No. 643; SEQ ID No. 646; SEQ ID No. 648; SEQ ID No. 649; SEQ ID No. 651; SEQ ID No. 652; SEQ ID No. 653; SEQ ID No. 654; SEQ ID No. 655; SEQ ID No. 658; SEQ ID No. 664; SEQ ID No. 665; SEQ ID No. 666; SEQ ID No. 668; SEQ ID No. 669; SEQ ID No. 670; SEQ ID No. 671; SEQ ID No. 672; SEQ ID No. 673; SEQ ID No. 674; SEQ ID No. 676; SEQ ID No. 677; SEQ ID No. 678; SEQ ID No. 680; SEQ ID No. 682; SEQ ID No. 683; SEQ ID No. 684; SEQ ID No. 686; SEQ ID No. 688; SEQ ID No. 689; SEQ ID No. 690; SEQ ID No. 691; SEQ ID No. 692; SEQ ID No. 693; SEQ ID No. 695; SEQ ID No. 696; SEQ ID No. 698; SEQ ID No. 701; SEQ ID No. 703; SEQ ID No. 704; SEQ ID No. 705; SEQ ID No. 706; SEQ ID No. 707; SEQ ID No. 709; SEQ ID No. 710; SEQ ID No. 711; SEQ ID No. 712; SEQ ID No. 713; SEQ ID No. 714; SEQ ID No. 715; SEQ ID No. 717; SEQ ID No. 718; SEQ ID No. 720; SEQ ID No. 721; SEQ ID No. 722; SEQ ID No. 724; SEQ ID No. 726; SEQ ID No. 728; SEQ ID No. 729; SEQ ID No. 730; SEQ ID No. 731; SEQ ID No. 732; SEQ ID No. 733; SEQ ID No. 734; SEQ ID No. 737; SEQ ID No. 738; SEQ ID No. 739; SEQ ID No. 740; SEQ ID No. 742; SEQ ID No. 743; SEQ ID No. 744; SEQ ID No. 745; SEQ ID No. 746; SEQ ID No. 748; SEQ ID No. 750; SEQ ID No. 751; SEQ ID No. 752; SEQ ID No. 753; SEQ ID No. 754; SEQ ID No. 755; SEQ ID No. 757; SEQ ID No. 758; SEQ ID No. 759; SEQ ID No. 760; SEQ ID No.

764; SEQ ID No. 766; SEQ ID No. 768; SEQ ID No. 769; SEQ ID No. 771; SEQ ID No. 772; SEQ ID No. 773; SEQ ID No. 774; SEQ ID No. 775; SEQ ID No. 776; SEQ ID No. 777; SEQ ID No. 778; SEQ ID No. 779; SEQ ID No. 780; SEQ ID No. 781; SEQ ID No. 782; SEQ ID No. 7783; SEQ ID No. 786; SEQ ID No. 787; SEQ ID No. 788; SEQ ID No. 789; SEQ ID No. 790; SEQ ID No. 793; SEQ ID No. 798; SEQ ID No. 800; SEQ ID No. 802; SEQ ID No. 803; SEQ ID No. 806; SEQ ID No. 808; SEQ ID No. 809; SEQ ID No. 810; SEQ ID No. 811; SEQ ID No. 813; SEQ ID No. 814; SEQ ID No. 817; SEQ ID No. 820; SEQ ID No. 822; SEQ ID No. 824; SEQ ID No. 825; SEQ ID No. 827; SEQ ID No. 828; SEQ ID No. 829; SEQ ID No. 830; SEQ ID No. 833; SEQ ID No. 834; SEQ ID No. 835; SEQ ID No. 837; SEQ ID No. 838; SEQ ID No. 839; SEQ ID No. 840; SEQ ID No. 841; SEQ ID No. 842; SEQ ID No. 843; SEQ ID No. 845; SEQ ID No. 848; SEQ ID No. 849; SEQ ID No. 850; SEQ ID No. 851; SEQ ID No. 852; SEQ ID No. 854; SEQ ID No. 855; SEQ ID No. 856; SEQ ID No. 857; SEQ ID No. 859; SEQ ID No. 860; SEQ ID No. 862; SEQ ID No. 863; SEQ ID No. 864; SEQ ID No. 866; SEQ ID No. 869; SEQ ID No. 872; SEQ ID No. 873; SEQ ID No. 874; SEQ ID No. 878; SEQ ID No. 879; SEQ ID No. 880; SEQ ID No. 881; SEQ ID No. 883; SEQ ID No. 884; SEQ ID No. 885; SEQ ID No. 886; SEQ ID No. 887; SEQ ID No. 892; SEQ ID No. 893; SEQ ID No. 894; SEQ ID No. 895; SEQ ID No. 897; SEQ ID No. 899; SEQ ID No. 900; SEQ ID No. 901; SEQ ID No. 904; SEQ ID No. 906; SEQ ID No. 909; SEQ ID No. 910; SEQ ID No. 912; SEQ ID No. 914; SEQ ID No. 917; SEQ ID No. 920; SEQ ID No. 921; SEQ ID No. 922; SEQ ID No. 923; SEQ ID No. 924; SEQ ID No. 925; SEQ ID No. 926; SEQ ID No. 927; SEQ ID No. 930; SEQ ID No. 933; SEQ ID No. 934; SEQ ID No. 935; SEQ ID No. 936; SEQ ID No. 937; SEQ ID No. 940; SEQ ID No. 941; SEQ ID No. 942; SEQ ID No. 943; SEQ ID No. 944; SEQ ID No. 945; SEQ ID No. 947; SEQ ID No. 948; SEQ ID No. 951; SEQ ID No. 952; SEQ ID No. 953; SEQ ID No. 954; SEQ ID No. 955; SEQ ID No. 956; SEQ ID No. 957; SEQ ID No. 958; SEQ ID No. 960; SEQ ID No. 961; SEQ ID No. 962; SEQ ID No. 963; SEQ ID No. 964; SEQ ID No. 966; SEQ ID No. 967; SEQ ID No. 969; SEQ ID No. 970; SEQ ID No. 971; SEQ ID No. 973; SEQ ID No. 974; SEQ ID No. 979; SEQ ID No. 980; SEQ ID No. 981; SEQ ID No. 982; SEQ ID No. 984; SEQ ID No. 988; SEQ ID No. 989; SEQ ID No. 990; SEQ ID No. 991; SEQ ID No. 995; SEQ ID No. 996; SEQ ID No. 999; SEQ ID No. 1001; SEQ ID No. 1003; SEQ ID No. 1004; SEQ ID No. 1005; SEQ ID No. 1006; SEQ ID No. 1007; SEQ ID No. 1009; SEQ ID No. 1010; SEQ ID No. 1011; SEQ ID No. 1012; SEQ ID No. 1013; SEQ ID No. 1014; SEQ ID No. 1016; SEQ ID No. 1017; SEQ ID No. 1018; SEQ ID No. 1020; SEQ ID No. 1021; SEQ ID No. 1025; SEQ ID No. 1026; SEQ ID No. 1027; SEQ ID No. 1029; SEQ ID No. 1030; SEQ ID No. 1031; SEQ ID No. 1035; SEQ ID No. 1036; SEQ ID No. 1037; SEQ ID No. 1038; SEQ ID No. 1039; SEQ ID No. 1040; SEQ ID No. 1044; SEQ ID No. 1045; SEQ ID No. 1047; SEQ ID No. 1048; SEQ ID No. 1050; SEQ ID No. 1051; SEQ ID No. 1052; SEQ ID No. 1053; SEQ ID No. 1055; SEQ ID No. 1056; SEQ ID No. 1057; SEQ ID No. 1058; SEQ ID No. 1061; SEQ ID No. 1062; SEQ ID No. 1063; SEQ ID No. 1064; SEQ ID No. 1065; SEQ ID No. 1066; SEQ ID No. 1068; SEQ ID No. 1069; SEQ ID No. 1072; SEQ ID No. 1074; SEQ ID No. 1076 and one of their representative fragments.

Preferably, the invention relates to a polypeptide according to the invention, characterized in that it is a *Chlamydia trachomatis* transmembrane polypeptide or one of its representative fragments, having between 4 and 6 transmembrane domains, and in that it is chosen from the polypeptides having the following sequences:

SEQ ID No. 7; SEQ ID No. 14; SEQ ID No. 16; SEQ ID No. 32; SEQ ID No. 34; SEQ ID No. 36; SEQ ID No. 38; SEQ ID No. 50; SEQ ID No. 57; SEQ ID No. 59; SEQ ID No. 61; SEQ ID No. 62; SEQ ID No. 63; SEQ ID No. 64; SEQ ID No. 67; SEQ ID No. 69; SEQ ID No. 72; SEQ ID No. 77; SEQ ID No. 80; SEQ ID No. 84; SEQ ID No. 87; SEQ ID No. 93; SEQ ID No. 95; SEQ ID No. 99; SEQ ID No. 108; SEQ ID No. 119; SEQ ID No. 125; SEQ ID No. 126; SEQ ID No. 129; SEQ ID No. 131; SEQ ID No. 136; SEQ ID No. 139; SEQ ID No. 146; SEQ ID No. 152; SEQ ID No. 154; SEQ ID No. 160; SEQ ID No. 161; SEQ ID No. 172; SEQ ID No. 179; SEQ ID No. 182; SEQ ID No. 185; SEQ ID No. 200; SEQ ID No. 203; SEQ ID No. 205; SEQ ID No. 239; SEQ ID No. 242; SEQ ID No. 250; SEQ ID No. 253; SEQ ID No. 256; SEQ ID No. 259; SEQ ID No. 262; SEQ ID No. 268; SEQ ID No. 275; SEQ ID No. 281; SEQ ID No. 286; SEQ ID No. 288; SEQ ID No. 292; SEQ ID No. 295; SEQ ID No. 296; SEQ ID No. 297; SEQ ID No. 299; SEQ ID No. 300; SEQ ID No. 308; SEQ ID No. 314; SEQ ID No. 317; SEQ ID No. 318; SEQ ID No. 324; SEQ ID No. 342; SEQ ID No. 343; SEQ ID No. 355; SEQ ID No. 360; SEQ ID No. 374; SEQ ID No. 376; SEQ ID No. 386; SEQ ID No. 388; SEQ ID No. 392; SEQ ID No. 394; SEQ ID No. 395; SEQ ID No. 402; SEQ ID No. 405; SEQ ID No. 411; SEQ ID No. 415; SEQ ID No. 416; SEQ ID No. 422; SEQ ID No. 423; SEQ ID No. 429; SEQ ID No. 432; SEQ ID No. 441; SEQ ID No. 442; SEQ ID No. 444; SEQ ID No. 449; SEQ ID No. 452; SEQ ID No. 456; SEQ ID No. 460; SEQ ID No. 461; SEQ ID No. 465; SEQ ID No. 471; SEQ ID No. 472; SEQ ID No. 482; SEQ ID No. 489; SEQ ID No. 492; SEQ ID No. 494; SEQ ID No. 495; SEQ ID No. 502; SEQ ID No. 505; SEQ ID No. 506; SEQ ID No. 509; SEQ ID No. 516; SEQ ID No. 517; SEQ ID No. 520; SEQ ID No. 525; SEQ ID No. 533; SEQ ID No. 539; SEQ ID No. 549; SEQ ID No. 554; SEQ ID No. 557; SEQ ID No. 563; SEQ ID No. 570; SEQ ID No. 573; SEQ ID No. 581; SEQ ID No. 590; SEQ ID No. 591; SEQ ID No. 600; SEQ ID No. 607; SEQ ID No. 612; SEQ ID No. 613; SEQ ID No. 620; SEQ ID No. 626; SEQ ID No. 629; SEQ ID No. 630; SEQ ID No. 639; SEQ ID No. 644; SEQ ID No. 647; SEQ ID No. 656; SEQ ID No. 659; SEQ ID No. 661; SEQ ID No. 685; SEQ ID No. 687; SEQ ID No. 699; SEQ ID No. 700; SEQ ID No. 708; SEQ ID No. 716; SEQ ID No. 719; SEQ ID No. 725; SEQ ID No. 747; SEQ ID No. 749; SEQ ID No. 756; SEQ ID No. 765; SEQ ID No. 767; SEQ ID No. 794; SEQ ID No. 796; SEQ ID No. 797; SEQ ID No. 799; SEQ ID No. 801; SEQ ID No. 807; SEQ ID No. 821; SEQ ID No. 823; SEQ ID No. 826; SEQ ID No. 847; SEQ ID No. 853; SEQ ID No. 861; SEQ ID No. 870; SEQ ID No. 871; SEQ ID No. 875; SEQ ID No. 882; SEQ ID No. 888; SEQ ID No. 889; SEQ ID No. 898; SEQ ID No. 902; SEQ ID No. 903; SEQ ID No. 911; SEQ ID No. 916; SEQ ID No. 931; SEQ ID No. 939; SEQ ID No. 975; SEQ ID No. 976; SEQ ID No. 978; SEQ ID No. 983; SEQ ID No. 986; SEQ ID No. 987; SEQ ID No. 992; SEQ ID No. 993; SEQ ID No. 1000; SEQ ID No. 1002; SEQ ID No. 1008; SEQ ID No. 1019; SEQ ID No. 1022; SEQ ID No. 1032; SEQ ID No. 1034; SEQ ID No. 1046; SEQ ID No. 1054; SEQ ID No. 1060; SEQ ID No. 1071 and one of their representative fragments.

Preferably, the invention relates to a polypeptide according to the invention, characterized in that it is a *Chlamydia trachomatis* transmembrane polypeptide or one of its representative fragments, having at least 7 transmembrane domains, and in that it is chosen from the polypeptides having the following sequences: SEQ ID No. 4; SEQ ID No. 6; SEQ ID No. 13; SEQ ID No. 20; SEQ ID No. 51; SEQ ID No. 71; SEQ ID No. 88; SEQ ID No. 118; SEQ ID No. 128; SEQ ID No. 132; SEQ ID No. 133; SEQ ID No. 158; SEQ ID No. 159; SEQ ID No. 174; SEQ ID No. 180; SEQ ID No. 189; SEQ ID No. 210; SEQ ID No. 211; SEQ ID No. 214; SEQ ID No. 215; SEQ ID No. 226; SEQ ID No. 229; SEQ ID No. 233; SEQ ID No. 235; SEQ ID No. 240; SEQ ID No. 246; SEQ ID No. 251; SEQ ID No. 255; SEQ ID No. 273; SEQ ID No. 354; SEQ ID No. 364; SEQ ID No. 369; SEQ ID No. 371; SEQ ID No. 397; SEQ ID No. 401; SEQ ID No. 409; SEQ ID No. 412; SEQ ID No. 419; SEQ ID No. 439; SEQ ID No. 453; SEQ ID No. 462; SEQ ID No. 490; SEQ ID No. 510; SEQ ID No. 511; SEQ ID No. 518; SEQ ID No. 535; SEQ ID No. 548; SEQ ID No. 550; SEQ ID No. 564; SEQ ID No. 565; SEQ ID No. 578; SEQ ID No. 579; SEQ ID No. 614; SEQ ID No. 631; SEQ ID No. 636; SEQ ID No. 650; SEQ ID No. 662; SEQ ID No. 667; SEQ ID No. 679; SEQ ID No. 681; SEQ ID No. 702; SEQ ID No. 727; SEQ ID No. 741; SEQ ID No. 763; SEQ ID No. 791; SEQ ID No. 792; SEQ ID No. 815; SEQ ID No. 816; SEQ ID No. 832; SEQ ID No. 846; SEQ ID No. 858; SEQ ID No. 865; SEQ ID No. 867; SEQ ID No. 868; SEQ ID No. 877; SEQ ID No. 891; SEQ ID No. 896; SEQ ID No. 907; SEQ ID No. 908; SEQ ID No. 918; SEQ ID No. 919; SEQ ID No. 932; SEQ ID No. 959; SEQ ID No. 977; SEQ ID No. 994; SEQ ID No. 998; SEQ ID No. 1024; SEQ ID No. 1028; SEQ ID No. 1042; SEQ ID No. 1067; SEQ ID No. 1070; SEQ ID No. 1073 and one of their representative fragments.

Preferably, the invention relates to a polypeptide according to the invention, in that it is a *Chlamydia trachomatis* surface exposed polypeptide or one of its representative fragments, and in that it is chosen from the polypeptides having the following sequences:

SEQ ID No. 2, SEQ ID No. 3, SEQ ID No. 21, SEQ ID No. 22, SEQ ID No. 23, SEQ ID No. 53, SEQ ID No. 77, SEQ ID No. 187, SEQ ID No. 203, SEQ ID No. 383, SEQ ID No. 477, SEQ ID No. 478, SEQ ID No. 479, SEQ ID No. 481, SEQ ID No. 482, SEQ ID No. 483, SEQ ID No. 484, SEQ ID No. 485, SEQ ID No. 486, SEQ ID No. 487, SEQ ID No. 488, SEQ ID No. 489, SEQ ID No. 490, SEQ ID No. 571, SEQ ID No. 572, SEQ ID No. 573, SEQ ID No. 593, SEQ ID No. 670, SEQ ID No. 693, SEQ ID No. 742, SEQ ID No. 749, SEQ ID No. 801, SEQ ID No. 817, SEQ ID No. 818, SEQ ID No. 819, SEQ ID No. 820, SEQ ID No. 851, SEQ ID No. 902, SEQ ID No. 923, SEQ ID No. 1035, SEQ ID No. 1036, SEQ ID No. 1037, SEQ ID No. 1038, SEQ ID No. 1069, SEQ ID No. 1070, SEQ ID No. 1071, SEQ ID No. 1073, SEQ ID No. 1076, SEQ ID No. 1095, SEQ ID No. 1096, SEQ ID No. 1141, SEQ ID No. 1181, and their representative fragments.

Preferably, the invention relates to a polypeptide according to the invention, characterized in that it is a *Chlamydia trachomatis* lipoprotein or one of its representative fragments, and in that it is chosen from the polypeptides having the following sequences:

SEQ ID No. 29, SEQ ID No. 42, SEQ ID No. 66, SEQ ID No. 72, SEQ ID No. 76, SEQ ID No. 78, SEQ ID No. 148, SEQ ID No. 154, SEQ ID No. 180, SEQ ID No. 182, SEQ ID No. 184, SEQ ID No. 187, SEQ ID No. 200, SEQ ID No. 242, SEQ ID No. 245, SEQ ID No. 250, SEQ ID No. 253, SEQ ID No. 272, SEQ ID No. 274, SEQ ID No. 275, SEQ ID No. 308, SEQ ID No. 350, SEQ ID No. 362, SEQ ID No. 383, SEQ ID No. 394, SEQ ID No. 396, SEQ ID No. 399, SEQ ID No. 422, SEQ ID No. 488, SEQ ID No. 535, SEQ ID No. 568, SEQ ID No. 573, SEQ ID No. 578, SEQ ID No. 593, SEQ ID No. 607, SEQ ID No. 625, SEQ ID No. 662, SEQ ID No. 669, SEQ ID No. 688, SEQ ID No. 690, SEQ ID No. 716, SEQ ID No. 773, SEQ ID No. 778, SEQ ID No. 781, SEQ ID No. 783, SEQ ID No. 788, SEQ ID No. 817, SEQ ID No. 848, SEQ ID No. 851, SEQ ID No. 853, SEQ ID No. 857, SEQ ID No. 875, SEQ ID No. 877, SEQ ID No. 886, SEQ ID No. 898, SEQ ID No. 902, SEQ ID No. 923, SEQ ID No. 938, SEQ ID No. 976, SEQ ID No. 978, SEQ ID No. 990, SEQ ID No. 1005, SEQ ID No. 1021, SEQ ID No. 1035, SEQ ID No. 1069, SEQ ID No. 1083, SEQ ID No. 1088, SEQ ID No. 1089, SEQ ID No. 1091, SEQ ID No. 1092, SEQ ID No. 1095, SEQ ID No. 1096, SEQ ID No. 1100, SEQ ID No. 1105, SEQ ID No. 1108, SEQ ID No. 1117, SEQ ID No. 1120, SEQ ID No. 1121, SEQ ID No. 1124, SEQ ID No. 1128, SEQ ID No. 1133, SEQ ID No. 1135, SEQ ID No. 1139, SEQ ID No. 1140, SEQ ID No. 1157, SEQ ID No. 1159, SEQ ID No. 1163, SEQ ID No. 1165, SEQ ID No. 1167, SEQ ID No. 1168, SEQ ID No. 1169, SEQ ID No. 1171, SEQ ID No. 1173, SEQ ID No. 1174, SEQ ID No. 1177, SEQ ID No. 1180, SEQ ID No. 1181, SEQ ID No. 1186, SEQ ID No. 1194, SEQ ID No. 1197, and their representative fragments.

Preferably, the invention relates to a polypeptide according to the invention, in that it is a *Chlamydia trachomatis* polypeptide involved in lipopolysaccharide (LPS) biosynthesis, and in that it is chosen from the polypeptides having the following sequences: SEQ ID No. 17, SEQ ID No. 201, SEQ ID No. 691, SEQ ID No. 807, SEQ ID No. 936, SEQ ID No. 983, SEQ ID No. 1019, SEQ ID No. 1077, and their representative fragments.

Preferably, the invention relates to additional LPS-related polypeptides according to the invention, in that it is:

(a) a *Chlamydia trachomatis* KDO (3-deoxy-D-manno-octylosonic acid)-related polypeptide or one of its representative fragments, and in that it is chosen from the polypeptides having the following sequences: SEQ ID No. 41, SEQ ID No. 242, SEQ ID No. 269, SEQ ID No. 772, and one of their representative fragments;

(b) a *Chlamydia trachomatis* phosphomannomutase-related polypeptide or one of its representative fragments, and in that it is chosen from the polypeptides having the following sequence: SEQ ID No. 139, and its representative fragments;

(c) a *Chlamydia trachomatis* phosphoglucomutase-related polypeptide or one of its representative fragments, and in that it is chosen from the polypeptides having the following sequence: SEQ ID No. 567 and its representative fragments; and (d) a *Chlamydia trachomatis* lipid A component-related polypeptide or one of its representative fragments, and in that it is chosen from the polypeptides having the following sequences: SEQ ID No. 4, SEQ ID No. 933, SEQ ID No. 934, SEQ ID No. 935, SEQ ID No. 1185, and one of their representative fragments.

Preferably, the invention relates to a polypeptide according to the invention, in that it is a *Chlamydia trachomatis* polypeptide or one of its representative fragments that contains an RGD sequence and is also an outer membrane protein, and in that it is chosen from the polypeptides having the following sequences: SEQ. ID No. 488, SEQ ID No. 489, SEQ ID No. 571, SEQ ID No. 572, SEQ No. 573, SEQ ID No. 716 and one of their representative fragments.

Preferably, the invention relates to a polypeptide according to the invention, in that it is a *Chlamydia trachomatis* polypeptide or one of its representative fragments that is cysteine-rich and contains RGD sequence, and in that it is chosen from the polypeptides having the following sequence: SEQ ID No. 144 and one of its representative fragments.

Preferably, the invention relates to a polypeptide according to the invention, in that it is a *Chlamydia trachomatis* outer membrane polypeptide that contains cysteines in their first 30 amino acids and also contain an RGD sequence, and in that it is chosen from the polypeptides having the following sequences: SEQ ID No. 101, SEQ ID No. 122, SEQ ID No. 308, SEQ ID No. 488, SEQ ID No. 489, SEQ ID No. 571, SEQ ID No. 572, SEQ ID No. 573, SEQ ID No. 651, SEQ ID No. 679, SEQ ID No. 680, SEQ ID No. 705, SEQ ID No. 716, SEQ ID No. 763, SEQ ID No. 870, SEQ ID No. 878, SEQ ID No. 879, SEQ ID No. 995, SEQ ID No. 1028, SEQ ID No. 1029, SEQ ID No. 1176, and one of their representative fragments.

Preferably, the invention relates to a polypeptide according to the invention, in that it is a *Chlamydia trachomatis* polypeptide or one of its representative fragments that contains RGD sequences homologous to *Chlamydia pneumoniae* polypeptides containing RGD sequences, and in that it is chosen from the polypeptides having the following sequences: SEQ ID No. 28, SEQ ID No. 101, SEQ ID No. 125, SEQ ID No. 155, SEQ ID No. 156, SEQ ID No. 286, SEQ ID No. 571, SEQ ID No. 572, SEQ ID No. 573, SEQ ID No. 763, SEQ ID No. 870, and one of their representative fragments.

Preferably, the invention relates to a polypeptide according to the invention, in that it is a *Chlamydia trachomatis* Type III or non-Type III secreted polypeptide or one of its representative fragments, and in that it is chosen from the polypeptides having the following sequences:

SEQ ID No. 180, SEQ ID No. 181, SEQ ID No. 207, SEQ ID No. 208, SEQ ID No. 372, SEQ ID No. 391, SEQ ID No. 399, SEQ ID No. 477, SEQ ID No. 486, SEQ ID No. 749, SEQ ID No. 758, SEQ ID No. 819, SEQ ID No. 878, SEQ ID No. 888, SEQ ID No. 896, SEQ ID No. 897, SEQ ID No. 900, SEQ ID No. 902, SEQ ID No. 923, SEQ ID No. 1015, SEQ ID No. 1018, SEQ ID No. 1059, SEQ ID No. 1060, SEQ ID No. 1069, SEQ ID No. 1071, SEQ ID No. 1073, SEQ ID No. 1076, SEQ ID No. 1189, and their representative fragments.

Preferably, the invention relates to a polypeptide according to the invention, in that it is a *Chlamydia trachomatis* cell wall anchored surface polypeptide or one of its representative fragments, and in that it is chosen from the polypeptides having the following sequences:

SEQ ID No. 662, SEQ ID No. 681, SEQ ID No. 1182, SEQ ID No. 1192, and their representative fragments.

Preferably, the invention relates to a polypeptide according to the invention, in that it is a *Chlamydia trachomatis* polypeptide or, one of its representative fragments not found in *Chlamydia pneumoniae* (Blastp P>$e^{-10}$) and in that it is chosen from the polypeptides having the following sequences: SEQ ID No. 2, SEQ ID No. 18, SEQ ID No. 60, SEQ ID No. 66, SEQ ID No. 67, SEQ ID No. 68, SEQ ID No. 69, SEQ ID No. 70, SEQ ID No. 81, SEQ ID No. 89, SEQ ID No. 107, SEQ ID No. 108, SEQ ID No. 109, SEQ ID No. 134, SEQ ID No. 147, SEQ ID No. 191, SEQ ID No. 194, SEQ ID No. 216, SEQ ID No. 217, SEQ ID No. 218, SEQ ID No. 219, SEQ ID No. 220, SEQ ID No. 221, SEQ ID No. 222, SEQ ID No. 222, SEQ ID No. 223, SEQ ID No. 224, SEQ ID No. 225, SEQ ID No. 228, SEQ ID No. 235, SEQ ID No. 257, SEQ ID No. 276, SEQ ID No. 277, SEQ ID No. 278, SEQ ID No. 279, SEQ ID No. 280, SEQ ID No. 281, SEQ ID No. 282, SEQ ID No. 283, SEQ ID No. 284, SEQ ID No. 285, SEQ ID No. 289, SEQ ID No. 291, SEQ ID No. 298, SEQ ID No. 284, SEQ ID No. 313, SEQ ID No. 314, SEQ ID No. 315, SEQ ID No. 316, SEQ ID No. 334, SEQ ID No. 335, SEQ ID No. 336, SEQ ID No. 337, SEQ ID No. 338, SEQ ID No. 339, SEQ ID No. 340, SEQ ID No. 381, SEQ ID No. 393, SEQ ID No. 413, SEQ ID No. 418, SEQ ID No. 419, SEQ ID No. 419, SEQ ID No. 420, SEQ ID No. 421, SEQ ID No. 422, SEQ ID No. 423, SEQ ID No. 436, SEQ ID No. 460, SEQ ID No. 475, SEQ ID No. 476, SEQ ID No. 480, SEQ ID No. 485, SEQ ID No. 487, SEQ ID No. 491, SEQ ID No. 492, SEQ ID No. 493, SEQ ID No. 494, SEQ ID No. 496, SEQ ID No. 500, SEQ ID No. 504, SEQ ID No. 514, SEQ ID No. 527, SEQ ID No. 559, SEQ ID No. 569, SEQ ID No. 570, SEQ ID No. 575, SEQ ID No. 580, SEQ ID No. 582, SEQ ID No. 593, SEQ ID No. 598, SEQ ID No. 632, SEQ ID No. 640, SEQ ID No. 651, SEQ ID No. 671, SEQ ID No. 690, SEQ ID No. 694, ID No. 698, SEQ ID No. 710, SEQ ID No. 722, SEQ ID No. 723, SEQ ID No. 724, SEQ ID No. 770, SEQ ID No. 771, SEQ ID No. 782, SEQ ID No. 783, SEQ ID No. 784, SEQ ID No. 790, SEQ ID No. 795, SEQ ID No. 798, SEQ ID No. 805, SEQ ID No. 810, SEQ ID No. 817, SEQ ID No. 829, SEQ ID No. 830, SEQ ID No. 864, SEQ ID No. 866, SEQ ID No. 876, SEQ ID No. 887, SEQ ID No. 892, SEQ ID No. 899, SEQ ID No. 913, SEQ ID No. 921, SEQ ID No. 933, SEQ ID No. 938, SEQ ID No. 949, SEQ ID No. 956, SEQ ID No. 1010, SEQ ID No. 1017, SEQ ID No. 1018, SEQ ID No. 1027, SEQ ID No. 1030, SEQ ID No. 1037, SEQ ID No. 1038, SEQ ID No. 1047, SEQ ID No. 1072, SEQ ID No. 1074, SEQ ID No. 1075, SEQ ID No. 1078, SEQ ID No. 1079, SEQ ID No. 1081, SEQ ID No. 1083, SEQ ID No. 1084, SEQ ID No. 1087, SEQ ID No. 1088, SEQ ID No. 1089, SEQ ID No. 1091, SEQ ID No. 1092, SEQ ID No. 1094, SEQ ID No. 1095, SEQ ID No. 1096, SEQ ID No. 1098, SEQ ID No. 1104, SEQ ID No. 1105, SEQ ID No. 1106, SEQ ID No. 1108, SEQ ID No. 1110, SEQ ID No. 1114, SEQ ID No. 1115, SEQ ID No. 1116, SEQ ID No. 1117, SEQ ID No. 1119, SEQ ID No. 1128, SEQ ID No. 1132, SEQ ID No. 1133, SEQ ID No. 1135, SEQ ID No. 1136, SEQ ID No. 1139, SEQ ID No. 1140, SEQ ID No. 1141, SEQ ID No. 1142, SEQ ID No. 1144, SEQ ID No. 1148, SEQ ID No. 1151, SEQ ID No. 1155, SEQ ID No. 1157, SEQ ID No. 1159, SEQ ID No. 1161, SEQ ID No. 1162, SEQ ID No. 1165, SEQ ID No. 1166, SEQ ID No. 1167, SEQ ID No. 1168, SEQ ID No. 1169, SEQ ID No. 1171, SEQ ID No. 1172, SEQ ID No. 1173, SEQ ID No. 1174, SEQ ID No. 1175, SEQ ID No. 1176, SEQ ID No. 1177, SEQ ID No. 1178, SEQ ID No. 1180, SEQ ID No. 1181, SEQ ID No. 1183, SEQ ID No. 1184, SEQ ID No. 1186, SEQ ID No. 1187, SEQ ID No. 1188, SEQ ID No. 1192, SEQ ID No. 1194, SEQ ID No. 1197, and their representative fragments.

Preferably, the invention relates to a polypeptide according to the invention, characterized in that it is a *Chlamydia trachomatis* polypeptide or one of its representative fragments which is involved in the intermediate metabolism, in particular in the metabolism of sugars and/or of cofactors, and in that it is chosen from the polypeptides having the following sequences:

SEQ ID No. 10; SEQ ID No. 44; SEQ ID No. 45; SEQ ID No. 46; SEQ ID No. 47; SEQ ID No. 93; SEQ ID No. 101; SEQ ID No. 102; SEQ ID No. 103; SEQ ID No. 106; SEQ ID No. 107; SEQ ID No. 120; SEQ ID No. 121; SEQ ID No. 130; SEQ ID No. 135; SEQ ID No. 140; SEQ ID No. 143; SEQ ID No. 144; SEQ ID No. 145; SEQ ID No. 158; SEQ ID No. 159; SEQ ID No. 160; SEQ ID No. 161; SEQ ID No.

192; SEQ ID No. 193; SEQ ID No. 196; SEQ ID No. 197; SEQ ID No. 198; SEQ ID No. 199; SEQ ID No. 227; SEQ ID No. 229; SEQ ID No. 236; SEQ ID No. 236; SEQ ID No. 239; SEQ ID No. 243; SEQ ID No. 245; SEQ ID No. 264; SEQ ID No. 265; SEQ ID No. 297; SEQ ID No. 331; SEQ ID No. 333; SEQ ID No. 359; SEQ ID No. 360; SEQ ID No. 374; SEQ ID No. 404; SEQ ID No. 405; SEQ ID No. 405; SEQ ID No. 410; SEQ ID No. 415; SEQ ID No. 415; SEQ ID No. 416; SEQ ID No. 417; SEQ ID No. 432; SEQ ID No. 460; SEQ ID No. 461; SEQ ID No. 462; SEQ ID No. 495; SEQ ID No. 513; SEQ ID No. 515; SEQ ID No. 566; SEQ ID No. 566; SEQ ID No. 566; SEQ ID No. 589; SEQ ID No. 613; SEQ ID No. 645; SEQ ID No. 646; SEQ ID No. 647; SEQ ID No. 652; SEQ ID No. 653; SEQ ID No. 654; SEQ ID No. 672; SEQ ID No. 673; SEQ ID No. 674; SEQ ID No. 682; SEQ ID No. 684; SEQ ID No. 692; SEQ ID No. 700; SEQ ID No. 725; SEQ ID No. 801; SEQ ID No. 802; SEQ ID No. 835; SEQ ID No. 836; SEQ ID No. 837; SEQ ID No. 860; SEQ ID No. 861; SEQ ID No. 862; SEQ ID No. 863; SEQ ID No. 869; SEQ ID No. 869; SEQ ID No. 925; SEQ ID No. 964; SEQ ID No. 983 and one of their representative fragments.

Preferably, the invention relates to a polypeptide according to the invention, characterized in that it is a *Chlamydia trachomatis* polypeptide or one of its representative fragments which is involved in the intermediate metabolism of nucleotides or nucleic acids, and in that it is chosen from the polypeptides having the following sequences:

SEQ ID No. 142; SEQ ID No. 142; SEQ ID No. 169; SEQ ID No. 256; SEQ ID No. 268; SEQ ID No. 325; SEQ ID No. 352; SEQ ID No. 366; SEQ ID No. 435; SEQ ID No. 444; SEQ ID No. 528; SEQ ID No. 529; SEQ ID No. 530; SEQ ID No. 548; SEQ ID No. 549; SEQ ID No. 601; SEQ ID No. 602; SEQ ID No. 617; SEQ ID No. 619; SEQ ID No. 644; SEQ ID No. 745; SEQ ID No. 971; SEQ ID No. 972; SEQ ID No. 1023 and one of their representative fragments.

Preferably, the invention relates to a polypeptide according to the invention, characterized in that it is a *Chlamydia trachomatis* polypeptide or one of its representative fragments which is involved in the metabolism of nucleic acids, and in that it is chosen from the polypeptides having the following sequences:

SEQ ID No. 5; SEQ ID No. 12; SEQ ID No. 82; SEQ ID No. 96; SEQ ID No. 97; SEQ ID No. 98; SEQ ID No. 99; SEQ ID No. 100; SEQ ID No. 105; SEQ ID No. 118; SEQ ID No. 136; SEQ ID No. 137; SEQ ID No. 163; SEQ ID No. 190; SEQ ID No. 204; SEQ ID No. 259; SEQ ID No. 260; SEQ ID No. 262; SEQ ID No. 290; SEQ ID No. 300; SEQ ID No. 301; SEQ ID No. 302; SEQ ID No. 387; SEQ ID No. 427; SEQ ID No. 434; SEQ ID No. 441; SEQ ID No. 444; SEQ ID No. 471; SEQ ID No. 595; SEQ ID No. 596; SEQ ID No. 597; SEQ ID No. 599; SEQ ID No. 600; SEQ ID No. 605; SEQ ID No. 612; SEQ ID No. 624; SEQ ID No. 625; SEQ ID No. 650; SEQ ID No. 657; SEQ ID No. 658; SEQ ID No. 702; SEQ ID No. 703; SEQ ID No. 704; SEQ ID No. 708; SEQ ID No. 719; SEQ ID No. 766; SEQ ID No. 767; SEQ ID No. 775; SEQ ID No. 779; SEQ ID No. 787; SEQ ID No. 788; SEQ ID No. 794; SEQ ID No. 841; SEQ ID No. 842; SEQ ID No. 883; SEQ ID No. 884; SEQ ID No. 907; SEQ ID No. 918; SEQ ID No. 924; SEQ ID No. 928; SEQ ID No. 929; SEQ ID No. 962; SEQ ID No. 962; SEQ ID No. 963; SEQ ID No. 969; SEQ ID No. 970; SEQ ID No. 975; SEQ ID No. 979; SEQ ID No. 995; SEQ ID No. 1031; SEQ ID No. 1032 and one of their representative fragments.

Preferably, the invention relates to a polypeptide according to the invention, characterized in that it is a *Chlamydia trachomatis* polypeptide or one of its representative fragments which is involved in the metabolism of amino acids or polypeptides, and in that it is chosen from the polypeptides having the following sequences:

SEQ ID No. 27; SEQ ID No. 41; SEQ ID No. 55; SEQ ID No. 56; SEQ ID No. 57; SEQ ID No. 59; SEQ ID No. 62; SEQ ID No. 63; SEQ ID No. 64; SEQ ID No. 65; SEQ ID No. 119; SEQ ID No. 132; SEQ ID No. 240; SEQ ID No. 241; SEQ ID No. 277; SEQ ID No. 278; SEQ ID No. 279; SEQ ID No. 382; SEQ ID No. 406; SEQ ID No. 428; SEQ ID No. 442; SEQ ID No. 446; SEQ ID No. 447; SEQ ID No. 453; SEQ ID No. 454; SEQ ID No. 541; SEQ ID No. 542; SEQ ID No. 591; SEQ ID No. 608; SEQ ID No. 609; SEQ ID No. 610; SEQ ID No. 618; SEQ ID No. 648; SEQ ID No. 649; SEQ ID No. 660; SEQ ID No. 661; SEQ ID No. 677; SEQ ID No. 717; SEQ ID No. 765; SEQ ID No. 797; SEQ ID No. 871; SEQ ID No. 875; SEQ ID No. 920; SEQ ID No. 922; SEQ ID No. 937; SEQ ID No. 998; SEQ ID No. 1020; SEQ ID No. 1021; SEQ ID No. 1034; SEQ ID No. 1044; SEQ ID No. 1046; SEQ ID No. 1049 and one of their representative fragments.

Preferably, the invention relates to a polypeptide according to the invention, characterized in that it is a *Chlamydia trachomatis* polypeptide or one of its representative fragments which is involved in the metabolism of polypeptides, and in that it is chosen from the polypeptides having the following sequences:

SEQ ID No. 21; SEQ ID No. 22; SEQ ID No. 23; SEQ ID No. 24; SEQ ID No. 25; SEQ ID No. 26; SEQ ID No. 75; SEQ ID No. 84; SEQ ID No. 86; SEQ ID No. 92; SEQ ID No. 133; SEQ ID No. 151; SEQ ID No. 152; SEQ ID No. 157; SEQ ID No. 179; SEQ ID No. 209; SEQ ID No. 307; SEQ ID No. 326; SEQ ID No. 343; SEQ ID No. 344; SEQ ID No. 345; SEQ ID No. 371; SEQ ID No. 429; SEQ ID No. 519; SEQ ID No. 557; SEQ ID No. 586; SEQ ID No. 587; SEQ ID No. 630; SEQ ID No. 656; SEQ ID No. 706; SEQ ID No. 707; SEQ ID No. 730; SEQ ID No. 751; SEQ ID No. 752; SEQ ID No. 786; SEQ ID No. 847; SEQ ID No. 885; SEQ ID No. 923; SEQ ID No. 978; SEQ ID No. 1039; SEQ ID No. 1048 and one of their representative fragments.

Preferably, the invention relates to a polypeptide according to the invention, characterized in that it is a *Chlamydia trachomatis* polypeptide or one of its representative fragments which is involved in the metabolism of fatty acids, and in that it is chosen from the polypeptides having the following sequences:

SEQ ID No. 4; SEQ ID No. 15; SEQ ID No. 16; SEQ ID No. 141; SEQ ID No. 173; SEQ ID No. 205; SEQ BD No. 205; SEQ ID No. 206; SEQ ID No. 207; SEQ ID No. 208; SEQ ID No. 312; SEQ ID No. 355; SEQ ID No. 415; SEQ ID No. 550; SEQ ID No. 558; SEQ ID No. 560; SEQ ID No. 561; SEQ ID No. 574; SEQ ID No. 574; SEQ ID No. 577; SEQ ID No. 578; SEQ ID No. 590; SEQ ID No. 614; SEQ ID No. 772; SEQ ID No. 808; SEQ ID No. 809; SEQ ID No. 904; SEQ ID No. 905; SEQ ID No. 905; SEQ ID No. 933; SEQ ID No. 934; SEQ ID No. 934; SEQ ID No. 936 and one of their representative fragments.

Preferably, the invention relates to a polypeptide according to the invention, characterized in that it is a *Chlamydia trachomatis* polypeptide or one of its representative fragments which is involved in the synthesis of the wall, and in that it is chosen from the polypeptides having the following sequences:

SEQ ID No. 87; SEQ ID No. 196; SEQ ID No. 242; SEQ ID No. 269; SEQ ID No. 628; SEQ ID No. 629; SEQ ID No.

634; SEQ ID No. 635; SEQ ID No. 637; SEQ ID No. 638; SEQ ID No. 1019 and one of their representative fragments.

Preferably, the invention relates to a polypeptide according to the invention, characterized in that it is a *Chlamydia trachomatis* polypeptide or one of its representative fragments which is involved in the transcription, translation and/or maturation process, and in that it is chosen from the polypeptides having the following sequences:

SEQ ID No. 112; SEQ ID No. 113; SEQ ID No. 332; SEQ ID No. 212; SEQ ID No. 213; SEQ ID No. 350; SEQ ID No. 362; SEQ ID No. 363; SEQ ID No. 364; SEQ ID No. 407; SEQ ID No. 451; SEQ ID No. 546; SEQ ID No. 643; SEQ ID No. 744; SEQ ID No. 746; SEQ ID No. 833; SEQ ID No. 868; SEQ ID No. 981; SEQ ID No. 982; SEQ ID No. 1003; SEQ ID No. 1011; SEQ ID No. 1042 and one of their representative fragments.

Preferably, the invention relates to a polypeptide according to the invention, characterized in that it is a *Chlamydia trachomatis* ribosomal polypeptide or one of its representative fragments, and in that it is chosen from the polypeptides having the following sequences:

SEQ ID No. 114; SEQ ID No. 115; SEQ ID No. 116; SEQ ID No. 328; SEQ ID No. 361; SEQ ID No. 375; SEQ ID No. 445; SEQ ID No. 543; SEQ ID No. 584; SEQ ID No. 585; SEQ ID No. 743; SEQ ID No. 813; SEQ ID No. 941; SEQ ID No. 942; SEQ ID No. 944; SEQ ID No. 946; SEQ ID No. 947; SEQ ID No. 948; SEQ ID No. 950; SEQ ID No. 951; SEQ ID No. 952; SEQ ID No. 953; SEQ ID No. 954; SEQ ID No. 955; SEQ ID No. 955; SEQ ID No. 957; SEQ ID No. 958; SEQ ID No. 960; SEQ ID No. 961; SEQ ID No. 1040; SEQ ID No. 1041; SEQ ID No. 1043; SEQ ID No. 1063; SEQ ID No. 1064 and one of their fragments.

Preferably, the invention also relates to a polypeptide according to the invention, characterized in that it is a *Chlamydia trachomatis* transport polypeptide or one of its representative fragments, and in that it is chosen from the polypeptides having the following sequences:

SEQ ID No. 6; SEQ ID No. 50; SEQ ID No. 51; SEQ ID No. 80; SEQ ID No. 125; SEQ ID No. 126; SEQ ID No. 128; SEQ ID No. 129; SEQ ID No. 215; SEQ ID No. 246; SEQ ID No. 248; SEQ ID No. 249; SEQ ID No. 251; SEQ ID No. 252; SEQ ID No. 253; SEQ ID No. 255; SEQ ID No. 271; SEQ ID No. 275; SEQ ID No. 293; SEQ ID No. 309; SEQ ID No. 323; SEQ ID No. 324; SEQ ID No. 398; SEQ ID No. 401; SEQ ID No. 449; SEQ ID No. 511; SEQ ID No. 512; SEQ ID No. 564; SEQ ID No. 565; SEQ ID No. 667; SEQ ID No. 679; SEQ ID No. 680; SEQ ID No. 711; SEQ ID No. 712; SEQ ID No. 713; SEQ ID No. 714; SEQ ID No. 715; SEQ ID No. 730; SEQ ID No. 731; SEQ ID No. 736; SEQ ID No. 737; SEQ ID No. 738; SEQ ID No. 870; SEQ ID No. 908; SEQ ID No. 919; SEQ ID No. 977; SEQ ID No. 987; SEQ ID No. 988; SEQ ID No. 992; SEQ ID No. 993; SEQ ID No. 994; SEQ ID No. 1028; SEQ ID No. 1029 and one of their representative fragments.

Preferably, the invention relates to a polypeptide according to the invention, characterized in that it is a *Chlamydia trachomatis* polypeptide or one of its representative fragments which is involved in the virulence process, and in that it is chosen from the polypeptides having the following sequences:

SEQ ID No. 20; SEQ ID No. 815; SEQ ID No. 816; SEQ ID No. 898; SEQ ID No. 1059; SEQ ID No. 1060 and one of their representative fragments.

Preferably, the invention relates to a polypeptide according to the invention, characterized in that it is a *Chlamydia trachomatis* polypeptide or one of its representative fragments which is involved in the secretory system and/or which is secreted, and in that it is chosen from the polypeptides having the following sequences:

SEQ ID No. 758; SEQ ID No. 888; SEQ ID No. 889; SEQ ID No. 890; SEQ ID No. 891; SEQ ID No. 896; SEQ ID No. 897; SEQ ID No. 898 and one of their representative fragments.

The secreted polypeptides, including the Type III and other, non-Type III secreted polypeptides, of the present invention, as well as the corresponding nucleotide sequences, may be detected by techniques known to persons skilled in the art, such as for example the techniques using cloning combined with vectors allowing the expression of the said polypeptides fused to export markers such as the luc gene for luciferase or the PhoA gene for alkaline phosphatase.

Preferably, the invention relates to a polypeptide according to the invention, characterized in that it is a polypeptide specific to *Chlamydiae* or one of its representative fragments, and in that it is chosen from the polypeptides having the following sequences:

SEQ ID No. 22; SEQ ID No. 29; SEQ ID No. 31; SEQ ID No. 32; SEQ ID No. 34; SEQ ID No. 35; SEQ ID No. 39; SEQ ID No. 40; SEQ ID No. 43; SEQ ID No. 48; SEQ ID No. 49; SEQ ID No. 50; SEQ ID No. 52; SEQ ID No. 53; SEQ ID No. 54; SEQ ID No. 72; SEQ ID No. 77; SEQ ID No. 78; SEQ ID No. 87; SEQ ID No. 90; SEQ ID No. 95; SEQ ID No. 108; SEQ ID No. 110; SEQ ID No. 111; SEQ ID No. 122; SEQ ID No. 123; SEQ ID No. 124; SEQ ID No. 127; SEQ ID No. 138; SEQ ID No. 144; SEQ ID No. 146; SEQ ID No. 153; SEQ ID No. 155; SEQ ID No. 164; SEQ ID No. 166; SEQ ID No. 175; SEQ ID No. 182; SEQ ID No. 184; SEQ ID No. 186; SEQ ID No. 187; SEQ ID No. 188; SEQ ID No. 202; SEQ ID No. 210; SEQ ID No. 247; SEQ ID No. 258; SEQ ID No. 266; SEQ ID No. 267; SEQ ID No. 270; SEQ ID No. 273; SEQ ID No. 274; SEQ ID No. 295; SEQ ID No. 296; SEQ ID No. 305; SEQ ID No. 306; SEQ ID No. 309; SEQ ID No. 318; SEQ ID No. 319; SEQ ID No. 322; SEQ ID No. 326; SEQ ID No. 342; SEQ ID No. 357; SEQ ID No. 376; SEQ ID No. 379; SEQ ID No. 380; SEQ ID No. 388; SEQ ID No. 390; SEQ ID No. 400; SEQ ID No. 431; SEQ ID No. 433; SEQ ID No. 438; SEQ ID No. 443; SEQ ID No. 456; SEQ ID No. 457; SEQ ID No. 458; SEQ ID No. 464; SEQ ID No. 468; SEQ ID No. 470; SEQ ID No. 473; SEQ ID No. 486; SEQ ID No. 489; SEQ ID No. 497; SEQ ID No. 501; SEQ ID No. 503; SEQ ID No. 504; SEQ ID No. 508; SEQ ID No. 512; SEQ ID No. 521; SEQ ID No. 522; SEQ ID No. 523; SEQ ID No. 524; SEQ ID No. 533; SEQ ID No. 535; SEQ ID No. 536; SEQ ID No. 537; SEQ ID No. 538; SEQ ID No. 539; SEQ ID No. 540; SEQ ID No. 554; SEQ ID No. 563; SEQ ID No. 572; SEQ ID No. 579; SEQ ID No. 595; SEQ ID No. 603; SEQ ID No. 604; SEQ ID No. 606; SEQ ID No. 607; SEQ ID No. 615; SEQ ID No. 616; SEQ ID No. 622; SEQ ID No. 641; SEQ ID No. 642; SEQ ID No. 659; SEQ ID No. 668; SEQ ID No. 670; SEQ ID No. 693; SEQ ID No. 695; SEQ ID No. 696; SEQ ID No. 699; SEQ ID No. 703; SEQ ID No. 704; SEQ ID No. 716; SEQ ID No. 726; SEQ ID No. 728; SEQ ID No. 739; SEQ ID No. 742; SEQ ID No. 747; SEQ ID No. 750; SEQ ID No. 751; SEQ ID No. 755; SEQ ID No. 757; SEQ ID No. 759; SEQ ID No. 761; SEQ ID No. 762; SEQ ID No. 763; SEQ ID No. 764; SEQ ID No. 773; SEQ ID No. 780; SEQ ID No. 781; SEQ ID No. 789; SEQ ID No. 800; SEQ ID No. 803; SEQ ID No. 804; SEQ ID No. 818; SEQ ID No. 820; SEQ ID No. 822; SEQ ID No. 823; SEQ ID No. 824; SEQ ID No.

827; SEQ ID No. 828; SEQ ID No. 839; SEQ ID No. 849; SEQ ID No. 850; SEQ ID No. 851; SEQ ID No. 852; SEQ ID No. 855; SEQ ID No. 856; SEQ ID No. 857; SEQ ID No. 858; SEQ ID No. 859; SEQ ID No. 860; SEQ ID No. 861; SEQ ID No. 862; SEQ ID No. 863; SEQ ID No. 865; SEQ ID No. 868; SEQ ID No. 869; SEQ ID No. 870; SEQ ID No. 871; SEQ ID No. 872; SEQ ID No. 873; SEQ ID No. 874; SEQ ID No. 875; SEQ ID No. 877; SEQ ID No. 878; SEQ ID No. 880; SEQ ID No. 882; SEQ ID No. 884; SEQ ID No. 886; SEQ ID No. 893; SEQ ID No. 901; SEQ ID No. 906; SEQ ID No. 910; SEQ ID No. 912; SEQ ID No. 915; SEQ ID No. 916; SEQ ID No. 917; SEQ ID No. 926; SEQ ID No. 929; SEQ ID No. 933; SEQ ID No. 965; SEQ ID No. 967; SEQ ID No. 968; SEQ ID No. 984; SEQ ID No. 986; SEQ ID No. 989; SEQ ID No. 990; SEQ ID No. 996; SEQ ID No. 997; SEQ ID No. 1001; SEQ ID No. 1002; SEQ ID No. 1013; SEQ ID No. 1016; SEQ ID No. 1031; SEQ ID No. 1033; SEQ ID No. 1035; SEQ ID No. 1049; SEQ ID No. 1051; SEQ ID No. 1052; SEQ ID No. 1054; SEQ ID No. 1056; SEQ ID No. 1057; SEQ ID No. 1058; SEQ ID No. 1062; SEQ ID No. 1070; SEQ ID No. 1071; SEQ ID No. 1073 and one of their representative fragments.

In general, in the present invention, the functional group to which a polypeptide of the invention belongs, as well as its corresponding nucleotide sequence, may be determined either by comparative analogy with sequences already known, or by the use of standard techniques of biochemistry, of cytology combined with the techniques of genetic engineering such as immunoaffinity, localization by immunolabelling, differential extraction, measurement of enzymatic activity, study of the activity inducing or repressing expression or the study of expression in *E. coli.*

It is clearly understood, on the one hand, that, in the present invention, the nucleotide sequences (ORF) and the amino acid sequences (SEQ ID No. 2 to SEQ ID No. 1197) which are listed by functional group, are not exhaustive within the group considered. Moreover, it is also clearly understood that, in the present invention, a nucleotide sequence (ORF) or an amino acid sequence mentioned within a given functional group may also be part of another group taking into account, for example, the interrelationship between the groups listed. Accordingly, and as an example of this interrelationship, an exported and/or secreted polypeptide as well as its coding nucleotide sequence may also be involved in the *Chlamydia trachomatis* virulence process by modifying the defense mechanism of the infected host cell, or a transmembrane polypeptide or its coding nucleotide sequence is also part of the polypeptides or coding nucleotide sequences of the cellular envelope.

The subject of the present invention is also the nucleotide and/or polypeptide sequences according to the invention, characterized in that the said sequences are recorded on a medium, called recording medium, whose type and nature facilitate the reading, the analysis and the exploitation of the said sequences. These media may of course also contain other information extracted from the present invention, such as in particular the analogies with already known sequences, such as those mentioned in Table 1 of the present description, and/or may contain, in addition, information relating to the nucleotide and/or polypeptide sequences of other microorganisms so as to facilitate the comparative analysis and the exploitation of the results obtained.

Among these recording media, computer-readable media, such as magnetic, optical, electrical and hybrid media such as, for example, floppy disks, CD-ROMs or recording cassettes, are preferred in particular.

The invention also relates to nucleotide sequences which can be used as primer or probe, characterized in that the said sequences are chosen from the nucleotide sequences according to the invention.

The invention relates, in addition, to the use of a nucleotide sequence according to the invention, as primer or probe, for the detection and/or amplification of nucleic acid sequences.

The nucleotide sequences according to the invention may thus be used to amplify nucleotide sequences, in particular by the PCR technique (polymerase chain reaction) (Erlich, 1989; Innis et al., 1990; Rolfs et al., 1991, and White et al., 1997).

These oligodeoxyribonucleotide or oligoribonucleotide primers correspond to representative nucleotide fragments, and are advantageously at least 8 nucleotides, preferably at least 12 nucleotides, 15 nucleotides and still more preferably at least 20 nucleotides long.

Other techniques for amplifying the target nucleic acid may be advantageously used as alternatives to PCR.

The nucleotide sequences of the invention, in particular the primers according to the invention, may also be used in other methods for amplifying a target nucleic acid, such as:

- the TAS (Transcription-based Amplification System) technique described by Kwoh et al. in 1989;
- the 3SR (Self-Sustained Sequence Replication) technique described by Guatelli et al. in 1990;
- the NASBA (Nucleic Acid Sequence Based Amplification) technique described by Kievitis et al. in 1991;
- the SDA (Strand Displacement Amplification) technique (Walker et al., 1992);
- the TMA (Transcription Mediated Amplification) technique.

The polynucleotides of the invention may also be used in techniques for amplifying or for modifying the nucleic acid serving as probe, such as:

- the LCR (Ligase Chain Reaction) technique described by Landegren et al. in 1988 and perfected by Barany et al. in 1991, which uses a thermostable ligase;
- the RCR (Repair Chain Reaction) technique described by Segev in 1992;
- the CPR (Cycling Probe Reaction) technique described by Duck et al. in 1990;
- the Q-beta-replicase amplification technique described by Miele et al. in 1983 and perfected in particular by Chu et al. in 1986, Lizardi et al. in 1988, and then by Burg et al. as well as by Stone et al. in 1996.

The invention also relates to the nucleotide sequences of fragments which can be obtained by amplification with the aid of at least one primer according to the invention. The present invention encompasses both hybridization probes and primers. In general, the complementary probes should be of the length sufficient to form a stable hybrid complex with the target sequences. Primers, while complementary to the target sequences need not form stable hybridization complexes with the target sequences alone. Rather, primers form stable complexes with the target sequences in the presence of polymerase to permit extension of the primer.

In the case where the target polynucleotide to be detected is possibly an RNA, for example an mRNA, it will be possible to use, prior to the use of an amplification reaction with the aid of at least one primer according to the invention or to the use of a method of detection with the aid of at least one probe of the invention, a reverse transcriptase-type enzyme so as to obtain a cDNA from the RNA contained in the biological sample. The cDNA obtained will then serve as target for the primer(s) or the probe(s) used in the amplification or detection method according to the invention.

The detection probe will be chosen so that it hybridizes with the target sequence or the amplicon generated from the target sequence. Such a detection probe will advantageously have as sequence a sequence of at least 12 nucleotides, 15 nucleotides, in particular of at least 20 nucleotides, and preferably at least 100 nucleotides.

The invention also comprises the nucleotide sequences which can be used as probe or primer according to the invention, characterized in that they are labelled with a radioactive compound or with a nonradioactive compound.

The nonlabelled nucleotide sequences may be used directly as probes or primers;

however, the sequences are generally labelled with a radioactive element ($^{32}P$, $^{35}S$, $^{3}H$, $^{125}I$) or with a nonradioactive molecule (biotin, acetylaminofluorene, digoxigenin, 5-bromo-deoxyuridine, fluorescein) so as to obtain probes which can be used in numerous applications.

Examples of nonradioactive labelling of nucleotide sequences are described, for example, in French patent No. 78,10975 or by Urdea et al. or by Sanchez-Pescador et al. in 1988.

In the latter case, one of the labelling methods described in patents FR-2 422 956 and FR-2 518 755 may also be used.

The invention also relates to the nucleotide sequences of fragments which can be obtained by hybridization with the aid of at least one probe according to the invention.

The hybridization technique may be performed in various ways (Matthews et al., 1988). The most common method consists in immobilizing the nucleic acid extracted from *C. trachomatis* cells on a support (such as nitrocellulose, nylon, polystyrene) and in incubating, under well-defined conditions, the target nucleic acid immobilized with the probe. After hybridization, the excess probe is removed and the hybrid molecules formed are detected by the appropriate method (measurement of the radioactivity, of the fluorescence or of the enzymatic activity linked to the probe).

The invention also comprises the nucleotide sequences according to the invention, characterized in that they are covalently or noncovalently immobilized on a support.

According to another advantageous embodiment of the nucleic sequences according to the invention, the latter may be used immobilized on a support and may thus serve to capture, through specific hybridization, the target nucleic acid obtained from the biological sample to be tested. If necessary, the solid support is separated from the sample and the hybridization complex formed between the so-called capture probe and the target nucleic acid is then detected by means of a second probe, called detection probe, labelled with an easily detectable element.

The nucleotide sequences according to the invention may also be used in new analytical systems, DNA chips, which allow sequencing, the study of mutations and of the expression of genes, and which are currently of interest given their very small size and their high capacity in terms of number of analyses.

The principle of the operation of these chips is based on molecular probes, most often oligonucleotides, which are attached onto a miniaturized surface, generally of the order of a few square centimeters. During an analysis, a sample containing fragments of a target nucleic acid to be analysed, for example DNA or RNA labelled, for example, after amplification, is deposited onto the DNA chip in which the support has been coated beforehand with probes. Bringing the labelled target sequences into contact with the probes leads to the formation, through hybridization, of a duplex according to the rule of pairing defined by J. D. Watson and F. Crick. After a washing step, analysis of the surface of the chip allows the effective hybridizations to be located by means of the signals emitted by the labels tagging the target. A hybridization fingerprint results from this analysis which, by appropriate computer processing, will make it possible to determine information such as the presence of specific fragments in the sample, the determination of sequences and the presence of mutations.

The chip consists of a multitude of molecular probes, precisely organized or arrayed on a solid support whose surface is miniaturized. It is at the centre of a system where other elements (imaging system, microcomputer) allow the acquisition and interpretation of a hybridization fingerprint.

The hybridization supports are provided in the form of flat or porous surfaces (pierced with wells) composed of various materials. The choice of a support is determined by its physicochemical properties, or more precisely, by the relationship between the latter and the conditions under which the support will be placed during the synthesis or the attachment of the probes or during the use of the chip. It is therefore necessary, before considering the use of a particular support (R. S. Matson et al., 1994), to consider characteristics such as its stability to pH, its physical strength, its reactivity and its chemical stability as well as its capacity to nonspecifically bind nucleic acids. Materials such as glass, silicon and polymers are commonly used. Their surface is, in a first step, called <<functionalization>>, made reactive towards the groups which it is desired to attach thereon. After the functionalization, so-called spacer molecules are grafted onto the activated surface. Used as intermediates between the surface and the probe, these molecules of variable size render unimportant the surface properties of the supports, which often prove to be problematic for the synthesis or the attachment of the probes and for the hybridization.

Among the hybridization supports, there may be mentioned glass which is used, for example, in the method of in situ synthesis of oligonucleotides by photochemical addressing developed by the company Affymetrix (E. L. Sheldon, 1993), the glass surface being activated by silane. Genosensor Consortium (P. Merel, 1994) also uses glass slides carrying wells 3 mm apart, this support being activated with epoxysilane.

Polymers or silicon may also be mentioned among these hybridization supports. For example, the Andrein Mirzabekov team has developed a chip consisting of polyacrylamide squares polymerized on a silanized glass surface (G. Yershov et al., 1996). Several teams use silicon, in particular the IFOS laboratory of Ecole Centrale of Lyon which uses a silicon semiconductor substrate which is p-doped by introducing it into its crystalline structure atoms whose valency is different from that of silicon. Various types of metals, in particular gold and platinum, may also be used as support (Genosensor Consortium (K. Beattie et al., 1993)).

The probes according to the invention may be synthesized directly in situ on the supports of the DNA chips. This in situ synthesis may be carried out by photochemical addressing (developed by the company Affymax (Amsterdam, Holland) and exploited industrially by its subsidiary Affymetrix (United States)) or based on the VLSIPS (very large scale immobilized polymer synthesis) technology (S. P. A. Fodor et al., 1991) which is based on a method of photochemically directed combinatory synthesis and the principle of which combines solid-phase chemistry, the use of photolabile protecting groups and photolithography.

The probes according to the invention may be attached to the DNA chips in various ways such as electrochemical addressing, automated addressing or the use of probe printers (T. Livache et al., 1994; G. Yershov et al., 1996; J. Derisi et al., 1996, and S. Borman, 1996).

The revealing of the hybridization between the probes of the invention, deposited or synthesized in situ on the supports of the DNA chips, and the sample to be analysed, may be determined, for example, by measurement of fluorescent signals, by radioactive counting or by electronic detection.

The use of fluorescent molecules such as fluorescein constitutes the most common method of labelling the samples. It allows direct or indirect revealing of the hybridization and allows the use of various fluorochromes.

Affymetrix currently provides an apparatus or a scanner designed to read its Gene Chip? chips. It makes it possible to detect the hybridizations by scanning the surface of the chip in confocal microscopy (R. J. Lipshutz et al., 1995). Other methods of detecting fluorescent signals have been tested: coupling of an epifluorescence microscope and a CCD camera (G. Yershov et al., 1996), the use of an optical fibre collecting system (E. L. Sheldon, 1993). A conventional method consists in carrying out an end labelling, with phosphorus 32, of the target sequences, by means of an appropriate apparatus, the Phosphorimager (marketed by Molecular Dynamics). The electronic detection is based on the principle that the hybridization of two nucleic acid molecules is accompanied by physical phenomena which can be quantified under certain conditions (system developed by Ecole Centrale of Lyon and called GEN-FET (GEN field effect transistor)). Genosensor Consortium and the company Beckman Instruments who are developing an electronic chip or Permittivity Chips? may also be mentioned (K. Beattie et al., 1993).

The nucleotide sequences according to the invention may thus be used in DNA chips to carry out the analysis of mutations. This analysis is based on the production of chips capable of analysing each base of a nucleotide sequence according to the invention. It is possible, in particular to this end, to use the microsequencing techniques on a DNA chip. The mutations are detected by extending immobilized primers which hybridize to the template of sequences analysed, just at the position adjacent to that of the mutated nucleotide to be detected. A single-stranded template, RNA or DNA, of the sequences to be analysed will be advantageously prepared according to conventional methods, from products amplified according to PCR-type techniques. The templates of single-stranded DNA, or of RNA thus obtained are then deposited on the DNA chip, under conditions allowing their specific hybridization to the immobilized primers. A thermostable polymerase, for example Tth or T7 DNA polymerase, specifically extends the 3' end of the immobilized primer with a labelled nucleotide analogue complementary to the nucleotide at the position of the variable site. For example a thermal cycling is performed in the presence of fluorescent dideoxyribonucleotides. The experimental conditions will be adapted in particular to the chips used, to the immobilized primers, to the polymerases used and to the labelling system chosen. One advantage of microsequencing, compared with techniques based on the hybridization of probes, is that it makes it possible to identify all the variable nucleotides with optimal discrimination under homogeneous reaction conditions; used on DNA chips, it allows optimal resolution and specificity for the routine and industrial detection of mutations in multiplex.

The nucleotide sequences according to the invention may also be used in DNA chips to carry out the analysis of the expression of the *Chlamydia trachomatis* genes. This analysis of the expression of *Chlamydia trachomatis* genes is based on the use of chips where probes of the invention, chosen for their specificity to characterize a given gene, are present (D. J. Lockhart et al., 1996; D. D. Shoemaker et al., 1996). For the methods of analysis of gene expression using the DNA chips, reference may, for example, be made to the methods described by D. J. Lockhart et al. (1996) and Sosnowsky et al. (1997) for the synthesis of probes in situ or for the addressing and the attachment of previously synthesized probes. The target sequences to be analysed are labelled and in general fragmented into sequences of about 50 to 100 nucleotides before being hybridized onto the chip. After washing as described, for example, by D. J. Lockhart et al. (1996) and application of different electric fields (Sosnowsky et al., 1997), the labelled compounds are detected and quantified, the hybridizations being carried out at least in duplicate. Comparative analyses of the signal intensities obtained with respect to the same probe for different samples and/or for different probes with the same sample, determine the differential expression of RNA or of DNA derived from the sample.

The nucleotide sequences according to the invention may, in addition, be used in DNA chips where other nucleotide probes specific for other microorganisms are also present, and may allow the carrying out of a serial test allowing rapid identification of the presence of a microorganism in a sample.

Accordingly, the subject of the invention is also the nucleotide sequences according to the invention, characterized in that they are immobilized on a support of a DNA chip.

The DNA chips, characterized in that they contain at least one nucleotide sequence according to the invention, immobilized on the support of the said chip, also form part of the invention.

The said chips will preferably contain several probes or nucleotide sequences of the invention of different length and/or corresponding to different genes so as to identify, with greater certainty, the specificity of the target sequences or the desired mutation in the sample to be analysed.

Accordingly, the analyses carried out by means of primers and/or probes according to the invention, immobilized on supports such as DNA chips, will make it possible, for example, to identify, in samples, mutations linked to variations such as intraspecies variations. These variations may be correlated or associated with pathologies specific to the variant identified and will make it possible to select the appropriate treatment.

The invention thus comprises a DNA chip according to the invention, characterized in that it contains, in addition, at least one nucleotide sequence of a microorganism different from *Chlamydia trachomatis*, immobilized on the support of the said chip; preferably, the different microorganism will be chosen from an associated microorganism, a bacterium of the *Chlamydia* family, and a variant of the species *Chlamydia trachomatis.*

Another subject of the present invention is a vector for the cloning and/or the expression of a sequence, characterized in that it contains a nucleotide sequence according to the invention.

Among the said vectors according to the invention, the vectors containing a nucleotide sequence encoding a polypeptide of the cellular, preferably outer, envelope of *Chlamydia trachomatis* or one of its representative fragments, are preferred.

In a specific embodiment, the vectors contain a nucleotide sequence encoding a *Chlamydia trachomatis* secreted polypeptide or one of its representative fragments or encoding a transport polypeptide, a surface exposed polypeptide, a lipoprotein or one of its representative fragments, a polypeptide involved in lipopolysaccharide (LPS) biosynthesis, a Type III or non-Type III secreted polypeptide, a polypeptide containing RGD attachment sites, a cell wall anchored surface polypeptide, a polypeptide not found in *Chlamydia pneumoniae*, a ribosomal polypeptide or a polypeptide involved in secretion, transcription, translation, maturation of proteins, a polypeptide involved in the synthesis of the wall, a polypeptide involved in the virulence, a polypeptide involved in the intermediate metabolism, in particular in the metabolism of sugars and/or of cofactors, a polypeptide involved in the metabolism of nucleotides, of amino acids, of nucleic acids or of fatty acids of *Chlamydia trachomatis* or one of their representative fragments, or a polypeptide specific to *Chlamydiae*, are also preferred.

According to the invention, the vectors comprise the elements necessary to allow the expression and/or the secretion of the said nucleotide sequences in a given host cell, and also form part of the invention.

The vector should, in this case, comprise a promoter, signals for initiation and for termination of translation, as well as appropriate regions for regulation of transcription. It should be capable of being stably maintained in the host cell and may optionally possess particular signals specifying the secretion of the translated protein. These different elements are chosen according to the host cell used. To this effect, the nucleotide sequences according to the invention may be inserted into autonomously-replicating vectors within the chosen host, or integrative vectors in the chosen host.

Any of the standard methods known to those skilled in the art for the insertion of DNA fragments into a vector may be used to construct expression vectors containing a chimeric gene consisting of appropriate transcriptional/translational control signals and the protein coding sequences. These methods may include in vitro recombinant DNA and synthetic techniques and in vivo recombinants (genetic recombination). Expression of a polypeptide, peptide or derivative, or analogs thereof encoded by a polynucleotide sequence in SEQ ID No. 1 or ORFs contained within SEQ ID No. 1 may be regulated by a second nucleic acid sequence so that the protein or peptide is expressed in a host transformed with the recombinant DNA molecule. For example, expression of a protein or peptide may be controlled by any promoter/enhancer element known in the art. Promoters which may be used to control expression include, but are not limited to, the CMV promoter, the SV40 early promoter region (Bernoist and Chambon, 1981, Nature 290:304–310), the promoter contained in the 3' long terminal repeat of Rous sarcoma virus (Yamamoto, et al., 1980, Cell 22:787–797), the herpes thymidine kinase promoter (Wagner et al., 1981, Proc. Natl. Acad. Sci. U.S.A. 78:1441–1445), the regulatory sequences of the metallothionein gene (Brinster et al., 1982, Nature 296:39–42); prokaryotic expression vectors such as the β-lactamase promoter (Villa-Kamaroff, et al., 1978, Proc. Natl. Acad. Sci. U.S.A. 75:3727–3731), or the tac promoter (DeBoer, et al., 1983, Proc. Natl. Acad. Sci. U.S.A. 80:21–25); see also "Useful proteins from recombinant bacteria" in Scientific American, 1980, 242:74–94; plant expression vectors comprising the nopaline synthetase promoter region (Herrera-Estrella et al., 1983, Nature 303: 209–213) or the cauliflower mosaic virus $^{35}$S RNA promoter (Gardner, et al., 1981, Nucl. Acids Res. 9:2871), and the promoter of the photosynthetic enzyme ribulose biphosphate carboxylase (Herrera-Estrella et al., 1984, Nature 310:115–120); promoter elements from yeast or other fungi such as the Gal 4 promoter, the ADC (alcohol dehydrogenase) promoter, PGK (phosphoglycerol kinase) promoter, alkaline phosphatase promoter, and the following animal transcriptional control regions, which exhibit tissue specificity and have been utilized in transgenic animals: elastase I gene control region which is active in pancreatic acinar cells (Swift et al., 1984, Cell 38:639–646; Ornitz et al., 1986, Cold Spring Harbor Symp. Quant. Biol. 50:399409; MacDonald, 1987, Hepatology 7:425–515); insulin gene control region which is active in pancreatic beta cells (Hanahan, 1985, Nature 315:115–122), immunoglobulin gene control region which is active in lymphoid cells (Grosschedl et al., 1984, Cell 38:647–658; Adames et al., 1985, Nature 318: 533–538; Alexander et al., 1987, Mol. Cell. Biol. 7:1436–1444), mouse mammary tumor virus control region which is active in testicular, breast, lymphoid and mast cells (Leder et al., 1986, Cell 45:485495), albumin gene control region which is active in liver (Pinkert et al., 1987, Genes and Devel. 1:268–276), alpha-fetoprotein gene control region which is active in liver (Krumlauf et al., 1985, Mol. Cell. Biol. 5:1639–1648; Hammer et al., 1987, Science 235:53–58; alpha 1-antitrypsin gene control region which is active in the liver (Kelsey et al., 1987, Genes and Devel. 1: 161–171), beta-globin gene control region which is active in myeloid cells (Mogram et al., 1985, Nature 315:338–340; Kollias et al., 1986, Cell 46:89–94; myelin basic protein gene control region which is active in oligodendrocyte cells in the brain (Readhead et al., 1987, Cell 48:703–712); myosin light chain-2 gene control region which is active in skeletal muscle (Sani, 1985, Nature 314:283–286), and gonadotropic releasing hormone gene control region which is active in the hypothalamus (Mason et al., 1986, Science 234:1372–1378).

The vectors according to the invention are, for example, vectors of plasmid or viral origin. In a specific embodiment, a vector is used that comprises a promoter operably linked to a protein or peptide-encoding nucleic acid sequence in SEQ ID No. 1, or ORFs contained within SEQ ID No. 1, one or more origins of replication, and, optionally, one or more selectable markers (e.g., an antibiotic resistance gene). Expression vectors comprise regulatory sequences that control gene expression, including gene expression in a desired host cell. Preferred vectors for the expression of the polypeptides of the invention include the pET-type plasmid vectors (Promega) or pBAD plasmid vectors (Invitrogen). Furthermore, the vectors according to the invention are useful for transforming host cells so as to clone or express the nucleotide sequences of the invention.

Expression can also be achieved using targeted homologous recombination to activate *Chlamydia trachomatis* genes present in the cloned genomic DNA. A heterologous regulatory element may be inserted into a stable cell line or cloned microorganism, such that it is operatively linked with an endogenous *Chlamydia trachomatis* gene present in the cloned genome, using techniques, such as targeted homologous recombination, which are well known to those of skill in the art (See, e.g., Chappel, U.S. Pat. No. 4,215,051 and Skoultchi, WO 91/06667 each of which is incorporated herein in its entirety).

Expression vector/host cell systems containing inserts of polynucleotide sequences in SEQ ID No. 1 or ORFs within SEQ ID No. 1, which encode polypeptides, peptides or derivatives, or analogs thereof, can be identified by three general approaches: (a) nucleic acid hybridization, (b) presence or absence of "marker" gene functions, and (c) expression of inserted sequences. In the first approach, the presence of a polynucleotide sequence inserted in an expression vector can be detected by nucleic acid hybridization using probes comprising sequences that are homologous to an inserted polynucleotide sequence. In the second approach, the recombinant vector/host system can be identified and selected based upon the presence or absence of certain "marker" gene functions (e.g., thymidine kinase activity, resistance to antibiotics, transformation phenotype, occlusion body formation in baculovirus, etc.) caused by the insertion of a polynucleotide sequence in the vector. For example, if the polynucleotide sequence in SEQ ID No. 1 or ORFs within SEQ ID No. 1 is inserted within the marker gene sequence of the vector, recombinants containing the insert can be identified by the absence of the marker gene function. In the third approach, recombinant expression vectors can be identified by assaying the product of the polynucleotide sequence expressed by the recombinant. Such assays can be based, for example, on the physical or functional properties of the expressed polypeptide in in vitro assay systems, e.g., binding with antibody, promotion of cell proliferation.

Once a particular recombinant DNA molecule is identified and isolated, several methods known in the art may be used to propagate it. The clones identified may be introduced into an appropriate host cell by standard methods, such as for example lipofection, electroporation, and heat shock. Once a suitable host system and growth conditions are established, recombinant expression vectors can be propagated and prepared in quantity.

The invention also encompasses the host cells transformed by a vector according to the invention. These cells may be obtained by introducing into host cells a nucleotide sequence inserted into a vector as defined above, and then culturing the said cells under conditions allowing the replication and/or the expression of the transfected nucleotide sequence.

The host cell may be chosen from eukaryotic or prokaryotic systems, such as for example bacterial cells (Olins and Lee, 1993), but also yeast cells (Buckholz, 1993), as well as animal cells, in particular cultures of mammalian cells (Edwards and Aruffo, 1993), and in particular Chinese hamster ovary (CHO) cells, but also insect cells in which methods using baculoviruses for example may be used (Luckow, 1993).

Furthermore, a host cell strain may be chosen which modulates the expression of the inserted sequences, or modifies and processes the gene product in the specific fashion desired. Expression from certain promoters can be elevated in the presence of certain inducers; thus, expression of the genetically engineered polypeptide may be controlled. Furthermore, different host cells have characteristic and specific mechanisms for the translational and post-translational processing and modification (e.g., glycosylation, phosphorylation) of proteins. Appropriate cell lines or host systems can be chosen to ensure the desired modification and processing of the foreign protein expressed. For example, expression in a bacterial system can be used to produce an unglycosylated core protein product. Expression in yeast will produce a glycosylated product. Expression in mammalian cells can be used to ensure "native" glycosylation of a heterologous protein. Furthermore, different vector/host expression systems may effect processing reactions to different extents.

A preferred host cell for the expression of the proteins of the invention consists of prokaryotic cells, such as Gram negative bacteria.

A further preferred host cell according to the invention is a bacterium belonging to the *Chlamydia* family, more preferably belonging to the species *Chlamydia trachomatis* or chosen from a microorganism associated with the species *Chlamydia trachomatis*.

In other specific embodiments, the polypeptides, peptides or derivatives, or analogs thereof may be expressed as a fusion, or chimeric protein product (comprising the protein, fragment, analog, or derivative joined via a peptide bond to a heterologous protein sequence (of a different protein)). Such a chimeric product can be made by ligating the appropriate nucleic acid sequences encoding the desired amino acid sequences to each other by methods known in the art, in the proper coding frame, and expressing the chimeric product by methods commonly known in the art. Alternatively, such a chimeric product may be made by protein synthetic techniques, e.g., by use of a peptide synthesizer.

Genomic sequences can be cloned and expressed as translational gene products (i.e., peptides, polypeptides, and proteins) or transcriptional gene products (i.e., antisense and ribozymes).

The invention further relates to the intracellular production of an antisense nucleic acid sequence of SEQ ID No. 1 by transcription from an exogenous sequence. For example, a vector can be introduced in vivo such that it is taken up by a cell, within which cell the vector or a portion thereof is transcribed, producing an antisense nucleic acid (RNA) of the invention. Such a vector would contain a sequence encoding an antisense nucleic acid. Such a vector can remain episomal or become chromosomally integrated, as long as it can be transcribed to produce the desired antisense RNA. Such vectors can be constructed by recombinant DNA technology methods standard in the art. Vectors can be plasmid, viral, or others known in the art, used for replication and expression in mammalian cells. Expression of the sequence encoding the antisense RNA can be by any promoter known in the art to act in mammalian, preferably human, cells. Such promoters can be inducible or constitutive. Such promoters include but are not limited to: the CMV promoter, the SV40 early promoter region (Bernoist and Chambon, 1981, Nature 290:304–310), the promoter contained in the $3_N$ long terminal repeat of Rous sarcoma virus (Yamamoto et al., 1980, Cell 22:787–797), the herpes thymidine kinase promoter (Wagner et al., 1981, Proc. Natl. Acad. Sci. U.S.A. 78:1441–1445), the regulatory sequences of the metallothionein gene (Brinster et al., 1982, Nature 296:3942), etc.

In a specific embodiment, the antisense oligonucleotide comprises catalytic RNA, or a ribozyme (see, e.g., PCT International Publication WO 90/11364, published Oct. 4, 1990; Sarver et al., 1990, Science 247:1222–1225). In another embodiment, the oligonucleotide is a $2_N$-0 -methylribonucleotide (Inoue et al., 1987, Nucl. Acids Res. 15:6131–6148), or a chimeric RNA-DNA analog (Inoue et al., 1987, FEBS Lett. 215:327–330).

In another embodiment, the antisense nucleic acids of the invention comprise a sequence complementary to at least a portion of an RNA transcript of a polynucleotide sequence in SEQ ID No. 1. However, absolute complementarity, although preferred, is not required. A sequence "complementary to at least a portion of an RNA," as referred to herein, means a sequence having sufficient complementarity to be able to hybridize with the RNA, forming a stable duplex; in the case of double-stranded antisense nucleic acid sequence, a single strand of the duplex DNA may thus be tested, or triplex formation may be assayed. The ability to hybridize will depend on both the degree of complementarity and the length of the antisense nucleic acid. Generally, the longer the hybridizing nucleic acid, the more base mismatches with an RNA transcribed from SEQ ID No. 1 may contain and still form a stable duplex (or triplex, as the case may be). One skilled in the art can ascertain a tolerable degree of mismatch by use of standard procedures to determine the melting point of the hybridized complex.

The invention also relates to the animals, except humans, comprising one of the above-described transformed cells according to the invention.

The production of transgenic animals according to the invention overexpressing one or more of the *Chlamydia trachomatis* genes will be preferably carried out on rats, mice or rabbits according to methods well known to persons skilled in the art such as viral or nonviral transfections. The transgenic animals overexpressing one or more of the said genes may be obtained by transfection of multiple copies of the said genes under the control of a powerful promoter of a ubiquitous nature, or which is selective for one type of tissue. The transgenic animals may also be obtained by homologous recombination on embryonic stem cells, transfer of these stem cells to embryos, selection of the chimeras affected at the level of the reproductive lines, and growth of the said chimeras.

The transformed cells as well as the transgenic animals according to the invention can be used in methods of preparing the recombinant polypeptide.

It is now possible to produce recombinant polypeptides in a relatively large quantity by genetic engineering using the cells transformed with expression vectors according to the invention or using transgenic animals according to the invention.

The methods of preparing a polypeptide of the invention in recombinant form, characterized in that they use a vector and/or a cell transformed with a vector according to the invention and/or a transgenic animal comprising one of the said transformed cells according to the invention, are themselves included in the present invention.

Among the said methods of preparing a polypeptide of the invention in recombinant form, the methods of preparation using a vector, and/or a cell transformed with the said vector and/or a transgenic animal comprising one of the said transformed cells, containing a nucleotide sequence encoding a polypeptide of the cellular envelope of *Chlamydia trachomatis* or one of its representative fragments, more preferably encoding a polypeptide of the outer cellular envelope of *Chlamydia trachomatis* or one of its fragment, are preferred.

Among the said methods of preparing a polypeptide of the invention in recombinant form, the methods of preparation using a vector, and/or a cell transformed with the said vector and/or a transgenic animal comprising one of the said transformed cells, containing a nucleotide sequence encoding a *Chlamydia trachomatis* secreted polypeptide or one of its representative fragments, or encoding a transport polypeptide, a surface exposed polypeptide, a lipoprotein or one of its representative fragments, a polypeptide involved in lipopolysaccharide biosynthesis, a Type III or other secreted polypeptide, a polypeptide containing RGD attachment sites, a cell wall anchored surface polypeptide, a polypeptide not found in *Chlamydia pneumoniae*, a ribosomal polypeptide or a polypeptide involved in secretion, transcription, translation, maturation of proteins, a polypeptide involved in the synthesis of the wall, a polypeptide involved in the virulence, a polypeptide involved in the intermediate metabolism, in particular in the metabolism of sugars and/or of cofactors, a polypeptide involved in the metabolism of nucleotides, of amino acids, of nucleic acids or of fatty acids of *Chlamydia trachomatis* or one of their representative fragments, or a polypeptide specific to *Chlamydiae*, are also preferred.

The recombinant polypeptides obtained as indicated above may be provided either in glycosylated or nonglycosylated form and may or may not have the natural tertiary structure.

A preferred variant consists in producing a recombinant polypeptide fused to a <<carrier>> protein (chimeric protein). The advantage of this system is that it allows a stabilization and a reduction in proteolysis of the recombinant product, an increase in solubility during renaturation in vitro and/or a simplification of purification when the fusion partner has affinity for a specific ligand.

More particularly, the invention relates to a method of preparing a polypeptide of the invention comprising the following steps:

a) culture of the transformed cells under conditions allowing the expression of a recombinant polypeptide having a nucleic acid sequence according to the invention;
b) where appropriate, recovery of the said recombinant polypeptide.

When the method of preparing a polypeptide of the invention uses a transgenic animal according to the invention, the recombinant polypeptide is then extracted from the said animal.

The subject of the invention is also a polypeptide capable of being obtained by a method of the invention as described above.

The invention also comprises a method of preparing a synthetic polypeptide, characterized in that it uses an amino acid sequence of polypeptides according to the invention.

The invention also relates to a synthetic polypeptide obtained by a method according to the invention.

Polypeptides according to the invention may also be prepared by conventional techniques in the field of peptide synthesis under conditions suitable to produce the polypeptides encoded by the polynucleotide of the invention. This synthesis may be carried out in and recovered from a homogeneous solution or on a solid phase.

For example, the synthesis technique in a homogeneous solution described by Houbenweyl in 1974 may be used.

This method of synthesis consists in successively condensing, in pairs, the successive amino acids in the required order, or in condensing amino acids and fragments previously formed and already containing several amino acids in the appropriate order, or alternatively several fragments thus previously prepared, it being understood that care will have been taken to protect beforehand all the reactive functional groups carried by these amino acids or fragments, with the exception of the amine functional groups of one and the carboxyl functional groups of the other or vice versa, which should normally take part in the formation of the peptide bonds, in particular after activation of the carboxyl functional group, according to methods well known in peptide synthesis.

According to another preferred technique of the invention, the one described by Merrifield is used.

To manufacture a peptide chain according to the Merrifield method, a highly porous polymer resin is used, onto which the first C-terminal amino acid of the chain is attached. This amino acid is attached onto a resin via its carboxyl group and its amine functional group is protected. The amino acids which will constitute the peptide chain are thus attached, one after another, onto the amine group, each time deprotected beforehand, of the portion of the peptide chain already formed, and which is attached to the resin. When the entire peptide chain desired is formed, the protecting groups are removed from the various amino acids constituting the peptide chain and the peptide is detached from the resin with the aid of an acid.

The invention relates, in addition, to hybrid (fusion) polypeptides having at least one polypeptide or one of its representative fragments according to the invention, and a sequence of a polypeptide capable of eliciting an immune response in humans or animals.

Advantageously, the antigenic determinant is such that it is capable of eliciting a humoral and/or cellular response.

An antigenic determinant may be identified by screening expression libraries of the *Chlamydia trachomatis* genome with antibodies contained in the serum of patients infected with a bacterium belonging to the species *Chlamydia trachomatis*. An antigenic determinant may comprise a polypeptide or one of its fragments according to the invention, in glycosylated form, used in order to obtain immunogenic compositions capable of inducing the synthesis of antibodies directed against multiple epitopes. The said polypeptides or their glycosylated fragments also form part of the invention.

These hybrid molecules may consist, in part, of a carrier molecule for polypeptides or for their representative fragments according to the invention, combined with a portion which may be immunogenic, in particular an epitope of the diphtheria toxin, the tetanus toxin, a hepatitis B virus surface antigen (patent FR 79 21811), the poliomyelitis virus VP1 antigen or any other viral or bacterial toxin or antigen.

The methods of synthesizing the hybrid molecules include the methods used in genetic engineering to construct hybrid nucleotide sequences encoding the desired polypeptide sequences. Reference may be advantageously made, for example, to the technique for producing genes encoding fusion proteins described by Minton in 1984.

The said hybrid nucleotide sequences encoding a hybrid polypeptide as well as the hybrid polypeptides according to the invention, characterized in that they are recombinant polypeptides obtained by the expression of the said hybrid nucleotide sequences, also form part of the invention.

The invention also comprises the vectors characterized in that they contain one of the said hybrid nucleotide sequences. The host cells transformed by the said vectors, the transgenic animals comprising one of the said transformed cells as well as the methods of preparing recombinant polypeptides using the said vectors, the said transformed cells and/or the said transgenic animals of course also form part of the invention.

The polypeptides according to the invention, the antibodies according to the invention described below and the nucleotide sequences according to the invention may advantageously be used in in vitro and/or in vivo methods for the detection and/or the identification of bacteria belonging to the species *Chlamydia trachomatis*, in a biological sample (biological tissue or fluid) which is likely to contain them. These methods, depending on the specificity of the polypeptides, of the antibodies and of the nucleotide sequences according to the invention which will be used, may in particular detect and/or identify the bacterial variants belonging to the species *Chlamydia trachomatis* as well as the associated microorganisms capable of being detected by the polypeptides, the antibodies and the nucleotide sequences according to the invention which will be chosen. It may, for example, be advantageous to choose a polypeptide, an antibody or a nucleotide sequence according to the invention, which is capable of detecting any bacterium of the *Chlamydia* family by choosing a polypeptide, an antibody and/or a nucleotide sequence according to the invention which is specific to the family or, on the contrary, it will be most particularly advantageous to target a variant of the species *Chlamydia trachomatis*, which is responsible, for example, for the induction or the worsening of pathologies specific to the targeted variant, by choosing a polypeptide, an antibody and/or a nucleotide sequence according to the invention which is specific to the said variant.

The polypeptides according to the invention may advantageously be used in a method for the detection and/or the identification of bacteria belonging to the species *Chlamydia trachomatis* or to an associated microorganism, in a biological sample (biological tissue or fluid) which is likely to contain them, characterized in that it comprises the following steps:

a) bringing this biological sample into contact with a polypeptide or one of its representative fragments according to the invention (under conditions allowing an immunological reaction between the said polypeptide and the antibodies which may be present in the biological sample);

b) detecting the antigen-antibody complexes which may be formed.

Preferably, the biological sample consists of a fluid, for example a human or animal serum, blood or biopsies.

Any conventional procedure may be used to carry out such a detection of the antigen-antibody complexes which may be formed.

By way of example, a preferred method uses immunoenzymatic procedures based on the ELISA technique, immunofluorescence procedures or radioimmunological procedures (RIA), and the like.

Accordingly, the invention also relates to the polypeptides according to the invention, labelled with the aid of a suitable label such as a label of the enzymatic, fluorescent or radioactive type.

Such methods comprise, for example, the following steps:

deposition of defined quantities of a polypeptide composition according to the invention into the wells of a microtitre plate, introduction, into the said wells, of increasing dilutions of serum, or of a different biological sample as defined above, which has to be analysed, incubation of the microplate, introduction, into the wells of the microtitre plate, of labelled antibodies directed against human or animal immunoglobulins, these antibodies having been labelled with the aid of an enzyme selected from those which are capable of hydrolyzing a substrate, thereby modifying the absorption of the radiation of the latter, at least at a defined wavelength, for example at 550 nm, detection, by comparison with a control, of the quantity of substrate hydrolyzed.

The invention also relates to a kit or set for the detection and/or the identification of bacteria belonging to the species *Chlamydia trachomatis* or to an associated microorganism, characterized in that it comprises the following components:

a polypeptide according to the invention, where appropriate, the reagents for constituting the medium appropriate for the immunological or specific reaction, the reagents allowing the detection of the antigen-antibody complexes produced by the immunological reaction between the polypeptide(s) of the invention and the antibodies which may be present in the biological sample, it being possible for these reagents also to carry a label, or to be capable of being recognized in turn by a labelled reagent, more particularly in the case where the polypeptide according to the invention is not labelled, where appropriate, a reference biological sample (negative control) free of antibodies recognized by a polypeptide according to the invention, where appropriate, a reference biological sample (positive control) containing a predetermined quantity of antibodies recognized by a polypeptide according to the invention.

According to the invention, the polypeptides, peptides, fusion proteins or other derivatives, or analogs thereof encoded by a polynucleotide sequence in SEQ ID No. 1, may be used as an immunogen to generate antibodies which immunospecifically bind such an immunogen. Such antibodies may include, but are not limited to, polyclonal and monoclonal antibodies, humanized or chimeric antibodies, single chain antibodies, Fab fragments, $F(ab')_2$ fragments, fragments produced by a Fab expression library, anti-idiotypic (anti-Id) antibodies, and epitope-binding fragments of any of the above. In a specific embodiment, the antibody to a polypeptide, peptide or other derivative, or analog thereof encoded by a polynucleotide sequence in SEQ ID No. 1 is a bispecific antibody (see generally, e.g. Fanger and Drakeman, 1995, *Drug News and Perspectives* 8: 133–137). Such a bispecific antibody is genetically engineered to recognize both (1) an epitope and (2) one of a variety of "trigger" molecules, e.g. Fc receptors on myeloid cells, and CD3 and CD2 on T cells, that have been identified as being able to cause a cytotoxic T-cell to destroy a particular target. Such bispecific antibodies can be prepared either by chemical conjugation, hybridoma, or recombinant molecular biology techniques known to the skilled artisan.

Various procedures known in the art may be used for the production of polyclonal antibodies to a polypeptide, peptide or other derivative, or analog thereof encoded by a polynucleotide sequence in SEQ ID No. 1. For the production of antibody, various host animals can be immunized by injection with a polypeptide, or peptide or other derivative, or analog thereof, including but not limited to rabbits, mice, rats, etc. Various adjuvants, depending on the host species, may be used to increase the immunological response, including but not limited to Stimulon™ QS-21 (Aquila Biopharmaceuticals, Inc., Framingham, Mass.), MPL™ (3-O-deacylated monophosphoryl lipid A; RIBI ImmunoChem Research, Inc., Hamilton, Mont.), aluminum phosphate, IL-12 (Genetics Institute, Cambridge, Mass.), Freund's (complete and incomplete), mineral gels such as aluminum hydroxide, surface active substances such as lysolecithin, pluronic polyols, polyanions, peptides, oil emulsions, keyhole limpet hemocyanins, dinitrophenol, BCG (bacille Calmette-Guerin), and *corynebacterium parvum*. Alternatively, polyclonal antibodies may be prepared by purifying, on an affinity column onto which a polypeptide according to the invention has been previously attached, the antibodies contained in the serum of patients infected with a bacterium belonging to the species *Chlamydia trachomatis*.

For preparation of monoclonal antibodies directed toward a polypeptide, peptide or other derivative, or analog, any technique which provides for the production of antibody molecules by continuous cell lines in culture may be used. For example, the hybridoma technique originally developed by Kohler and Milstein (1975, Nature 256:495497), as well as the trioma technique, the human B-cell hybridoma technique (Kozbor et al., 1983, Immunology Today 4:72), and the EBV-hybridoma technique to produce human monoclonal antibodies (Cole et al., 1985, in Monoclonal Antibodies and Cancer Therapy, Alan R. Liss, Inc., pp. 77–96). In an additional embodiment of the invention, monoclonal antibodies can be produced in germ-free animals utilizing technology described in PCT/US90/02545. In another embodiment of the invention, transgenic non-human animals can be used for the production of human antibodies utilizing technology described in WO 98/24893 and WO 96/33735. According to the invention, human antibodies may be used and can be obtained by using human hybridomas (Cote et al., 1983, Proc. Natl. Acad. Sci. U.S.A. 80:2026–2030) or by transforming human B cells with EBV virus in vitro (Cole et al., 1985, in Monoclonal Antibodies and Cancer Therapy, Alan R. Liss, pp. 77–96). In fact, according to the invention, techniques developed for the production of <<chimeric antibodies>>, (Morrison et al., 1984, PROC.

NATL. ACAD. SCI. U.S.A. 81:6851–6855; Neuberger et al., 1984, Nature 312:604–608; Takeda et al., 1985, Nature 314:452454) by splicing the genes from a mouse antibody molecule specific for a polypeptide, peptide or other derivative, or analog together with genes from a human antibody molecule of appropriate biological activity can be used; such antibodies are within the scope of this invention.

According to the invention, techniques described for the production of single chain antibodies (U.S. Pat. No. 4,946,778) can be adapted to produce polypeptide or peptide-specific single chain antibodies. An additional embodiment of the invention utilizes the techniques described for the construction of Fab expression libraries (Huse et al., 1989, Science 246:1275–1281) to allow rapid and easy identification of monoclonal Fab fragments with the desired specificity for polypeptides, derivatives, or analogs.

Antibody fragments which contain the idiotype of the molecule can be generated by known techniques. For example, such fragments include but are not limited to: the $F(ab')_2$ fragment which can be produced by pepsin digestion of the antibody molecule; the Fab' fragments which can be generated by reducing the disulfide bridges of the $F(ab')_2$ fragment, the Fab fragments which can be generated by treating the antibody molecule with papain and a reducing agent, and Fv fragments.

In addition, techniques have been developed for the production of chimerized (See, e.g., Boss, M. et al., U.S. Pat. No. 4,816,397; and Cabilly, S. et al., U.S. Pat. No. 5,585,089 each of which is incorporated herein by reference in its entirety) humanized antibodies (See, e.g., Queen, U.S. Pat. No. 5,585,089, which is incorporated herein by reference in its entirety.) An immunoglobulin light or heavy chain variable region consists of a "framework" region interrupted by three hypervariable regions, referred to as complementarily determining regions (CDRs). The extent of the framework region and CDRs have been precisely defined (See, "Sequences of Proteins of Immunological Interest", Kabat, E. et al., U.S. Department of Health and Human Services (1983)). Briefly, humanized antibodies are antibody molecules from non-human species having one or more CDRs from the non-human species and a framework from a human immunoglobulin molecule.

The antibodies of the invention may also be labelled in the same manner as described above for the nucleic probes of the invention such as an enzymatic, fluorescent or radioactive type labelling.

The invention relates, in addition, to a method for the detection and/or the identification of bacteria belonging to the species *Chlamydia trachomatis* or to an associated microorganism in a biological sample, characterized in that it comprises the following steps:

a) bringing the biological sample (biological tissue or fluid) into contact with a mono- or polyclonal antibody according to the invention (under conditions allowing an immunological reaction between the said antibodies and the polypeptides of the bacterium belonging to the species *Chlamydia trachomatis* or to an associated microorganism which may be present in the biological sample, that is, under conditions suitable for the formation of immune complexes);

b) detecting the antigen-antibody complex which may be formed.

Also falling within the scope of the invention is a kit or set for the detection and/or the identification of bacteria belonging to the species *Chlamydia trachomatis* or to an associated microorganism, characterized in that it comprises the following components:

a polyclonal or monoclonal antibody according to the invention, labelled where appropriate;

where appropriate, a reagent for constituting the medium appropriate for carrying out the immunological reaction;

a reagent allowing the detection of the antigen-antibody complexes produced by the immunological reaction, it being possible for this reagent also to carry a label, or to be capable of being recognized in turn by a labelled reagent, more particularly in the case where the said monoclonal or polyclonal antibody is not labelled;

where appropriate, reagents for carrying out the lysis of the cells in the sample tested.

The principle of the DNA chip which was explained above may also be used to produce protein <<chips>> on which the support has been coated with a polypeptide or an antibody according to the invention, or arrays thereof, in place of the DNA. These protein <<chips>> make it possible, for example, to analyse the biomolecular interactions (BIA) induced by the affinity capture of target analytes onto a support coated, for example, with proteins, by surface plasma resonance (SPR). Reference may be made, for example, to the techniques for coupling proteins onto a solid support which are described in EP 524 800 or to the methods describing the use of biosensor-type protein chips such as the BIAcore-type technique (Pharmacia) (Arlinghaus et al., 1997, Krone et al., 1997, Chatelier et al., 1995). These polypeptides or antibodies according to the invention, capable of specifically binding antibodies or polypeptides derived from the sample to be analysed, may thus be used in protein chips for the detection and/or the identification of proteins in samples. The said protein chips may in particular be used for infectious diagnosis and may preferably contain, per chip, several polypeptides and/or antibodies of the invention of different specificity, and/or polypeptides and/or antibodies capable of recognizing microorganisms different from *Chlamydia trachomatis*.

Accordingly, the subject of the present invention is also the polypeptides and the antibodies according to the invention, characterized in that they are immobilized on a support, in particular of a protein chip.

The protein chips, characterized in that they contain at least one polypeptide or one antibody according to the invention immobilized on the support of the said chip, also form part of the invention.

The invention comprises, in addition, a protein chip according to the invention, characterized in that it contains, in addition, at least one polypeptide of a microorganism different from *Chlamydia trachomatis* or at least one antibody directed against a compound of a microorganism different from *Chlamydia trachomatis*, immobilized on the support of the said chip.

The invention also relates to a kit or set for the detection and/or the identification of bacteria belonging to the species *Chlamydia trachomatis* or to an associated microorganism, or for the detection and/or the identification of a microorganism characterized in that it comprises a protein chip according to the invention.

The subject of the present invention is also a method for the detection and/or the identification of bacteria belonging to the species *Chlamydia trachomatis* or to an associated microorganism in a biological sample, characterized in that it uses a nucleotide sequence according to the invention.

More particularly, the invention relates to a method for the detection and/or the identification of bacteria belonging to the species *Chlamydia trachomatis* or to an associated microorganism in a biological sample, characterized in that it comprises the following steps:

a) where appropriate, isolation of the DNA from the biological sample to be analysed, or optionally production of a cDNA from the RNA in the biological sample;

b) specific amplification of the DNA of bacteria belonging to the species *Chlamydia trachomatis* or to an associated microorganism with the aid of at least one primer according to the invention;

c) detection of the amplification products.

These may be detected, for example, by the molecular hybridization technique using a nucleic probe according to the invention. This probe will be advantageously labelled with a nonradioactive (cold probe) or radioactive element.

For the purposes of the present invention, <<DNA in the biological sample>> or <<DNA contained in the biological sample>> will be understood to mean either the DNA present in the biological sample considered, or optionally the cDNA obtained after the action of a reverse transcriptase-type enzyme on the RNA present in the said biological sample.

Another aim of the present invention consists in a method according to the invention, characterized in that it comprises the following steps:

a) bringing a nucleotide probe according to the invention into contact with a biological sample, the DNA contained in the biological sample having, where appropriate, been previously made accessible to hybridization, under conditions allowing the hybridization of the probe to complementary base pairs of the DNA of a bacterium belonging to the species *Chlamydia trachomatis* or to an associated microorganism;

b) detecting the hybridization complex formed between the nucleotide probe and the DNA in the biological sample.

The present invention also relates to a method according to the invention, characterized in that it comprises the following steps:

a) bringing a nucleotide probe immobilized on a support according to the invention into contact with a biological sample, the DNA in the sample having, where appropriate, been previously made accessible to hybridization, under conditions allowing the hybridization of the probe to the DNA of a bacterium belonging to the species *Chlamydia trachomatis* or to an associated microorganism;

b) bringing the hybrid formed between the nucleotide probe immobilized on a support and the DNA contained in the biological sample, where appropriate after removal of the DNA in the biological sample which has not hybridized with the probe, into contact with a labelled nucleotide probe according to the invention;

c) detecting the new hybrid formed in step b).

According to an advantageous embodiment of the method for the detection and/or the identification defined above, it is characterized in that, prior to step a), the DNA in the biological sample is primer-extended and/or amplified beforehand with the aid of at least one primer according to the invention.

The invention relates, in addition, to a kit or set for the detection and/or the identification of bacteria belonging to the species *Chlamydia trachomatis* or to an associated microorganism, characterized in that it comprises the following components:

a) a nucleotide probe according to the invention;

b) where appropriate, the reagents necessary for carrying out a hybridization reaction;

c) where appropriate, at least one primer according to the invention as well as the reagents (e.g., polymerase and/or deoxynucleotide triphosphates) necessary for a DNA amplification reaction.

The invention also relates to a kit or set for the detection and/or the identification of bacteria belonging to the species *Chlamydia trachomatis* or to an associated microorganism, characterized in that it comprises the following components:

a) a nucleotide probe, called capture probe, according to the invention;

b) an oligonucleotide probe, called detection probe, according to the invention;

c) where appropriate, at least one primer according to the invention as well as the reagents (e.g., polymerase and/or deoxynucleotide triphosphates) necessary for a DNA amplification reaction.

The invention also relates to a kit or set for the detection and/or the identification of bacteria belonging to the species *Chlamydia trachomatis* or to an associated microorganism, characterized in that it comprises the following components:

a) at least one primer according to the invention;

b) where appropriate, the reagents necessary for carrying out a DNA amplification reaction;

C) where appropriate, a component which makes it possible to check the sequence of the amplified fragment, more particularly an oligonucleotide probe according to the invention.

The invention relates, in addition, to a kit or set for the detection and/or the identification of bacteria belonging to the species *Chlamydia trachomatis* or to an associated microorganism, or for the detection and/or the identification of a microorganism characterized in that it comprises a DNA chip according to the invention.

The invention also relates to a method or to a kit or set according to the invention for the detection and/or the identification of bacteria belonging to the species *Chlamydia trachomatis*, characterized in that the said primer and/or the said probe according to the invention are chosen from the nucleotide sequences specific to the species *Chlamydia trachomatis*, in that the said polypeptides according to the invention are chosen from the polypeptides specific to the species *Chlamydia trachomatis* and in that the said antibodies according to the invention are chosen from the antibodies directed against the polypeptides according to the invention chosen from the polypeptides specific to the species *Chlamydia trachomatis*.

Preferably, the said method or the said kit or set above according to the invention, for the detection and/or the identification of bacteria belonging to the species *Chlamydia trachomatis* is characterized in that the said primer and/or the said probe or the said polypeptides are chosen from the nucleotide sequences or polypeptides according to the invention which have been identified as being specific to the species *Chlamydia trachomatis* and in that the said antibodies according to the invention are chosen from the antibodies directed against the polypeptides according to the invention chosen from the polypeptides identified as being specific to the species *Chlamydia trachomatis*.

The invention relates, in addition, to a method or a kit or set according to the invention for the diagnosis of predispositions to, or of a condition caused by, genital diseases which are induced or worsened by a *Chlamydia trachomatis* infection.

The invention also relates to a method or a kit or set according to the invention for the diagnosis of predispositions to, or of conditions caused by, eye diseases induced or worsened by a *Chlamydia trachomatis* infection.

The invention also relates to a method or a kit or set according to the invention for the diagnosis of predispositions to, or of conditions caused by, systemic diseases, in particular of the lymphatic system, which are induced or worsened by a *Chlamydia trachomatis* infection.

According to another aspect, the subject of the invention is the use of polypeptides according to the invention, of cells transformed with a vector according to the invention and/or of transformed animals according to the invention, for the biosynthesis or the biodegradation of organic or inorganic compounds.

As has been mentioned above, the nucleotide sequences of the invention were identified by homology with sequences known to encode, for example, polypeptides or fragments of enzymatic polypeptides involved in the biosynthesis or the biodegradation of organic or inorganic molecules.

It is thus possible to use the said polypeptides of the invention in a similar manner for the biosynthesis or the biodegradation of organic or inorganic compounds of industrial or therapeutic interest (called compounds of interest).

Among these polypeptides, there may be mentioned in particular the enzymes involved in metabolism, such as the proteolytic enzymes, amino transferases, glucose metabolism, or the enzymes which may be used in the biosynthesis of sugars, amino acids, fatty acids, polypeptides, nucleotides, nucleic acids or any other organic or inorganic compound or in the biodegradation of organic or inorganic compounds.

Among these polypeptides, there may be mentioned, in addition, the mutated or modified enzymes corresponding to mutated or modified polypeptides according to the invention which may also be used for the biosynthesis or the biodegradation of organic or inorganic compounds at the industrial level, such as, for example, the production of compounds of interest, the reprocessing of manufacturing residues applied to the food industries, to the papermaking industry or to the chemical and pharmaceutical industries.

The methods of biosynthesis or biodegradation of organic or inorganic compounds, characterized in that they use a polypeptide or one of its representative fragments according to the invention, transformed cells according to the invention and/or a transformed animal according to the invention, also form part of the invention.

The invention relates, in addition, to the use of a nucleotide sequence according to the invention, of a polypeptide according to the invention, of an antibody according to the invention, of a cell according to the invention, and/or of a transformed animal according to the invention, for the selection of an organic or inorganic compound capable of modulating, regulating, inducing or inhibiting the expression of genes, and/or of modifying the cellular replication of eukaryotic or prokaryotic cells or capable of inducing, inhibiting or worsening the pathologies linked to an infection by *Chlamydia trachomatis* or one of its associated microorganisms.

The invention also comprises screening assays that comprise method of selecting compounds capable of binding to a polypeptide, fusion polypeptide, or one of its representative fragments according to the invention, capable of binding to a nucleotide sequence according to the invention, or capable of recognizing an antibody according to the invention, and/or capable of modulating, regulating, inducing or inhibiting the expression of genes, and/or of modifying the growth or the cellular replication of eukaryotic or prokaryotic cells, or capable of inducing, inhibiting or worsening, in an animal or human organism, the pathologies linked to an infection by *Chlamydia trachomatis* or one of its associated microorganisms, characterized in that it comprises the following steps:

a) bringing the said compound into contact with the said polypeptide, the said nucleotide sequence, with a transformed cell according to the invention and/or administering the said compound to a transformed animal according to the invention;

b) determining the capacity of the said compound to bind with the said polypeptide or the said nucleotide sequence, or to modulate, regulate, induce or inhibit the expression of genes, or to modulate growth or cellular replication, or to induce, inhibit or worsen in the said transformed animal, the pathologies linked to an infection by *Chlamydia trachomatis* or one of its associated microorganisms.

The transformed cells and/or animals according to the invention may advantageously serve as a model and may be used in methods for studying, identifying and/or selecting compounds capable of being responsible for pathologies induced or worsened by *Chlamydia trachomatis*, or capable of preventing and/or of treating these pathologies such as, for example, genital, eye or systemic diseases, especially of the lymphatic system. In particular, the transformed host cells, in particular bacteria of the *Chlamydia* family whose transformation with a vector according to the invention may, for example, increase or inhibit its infectivity, or modulate the pathologies usually induced or worsened by the infection, may be used to infect animals in which the onset of pathologies will be monitored. These nontransformed animals, infected for example with transformed *Chlamydia* bacteria, may serve as a study model. In the same manner, the transformed animals according to the invention may, for example, exhibit predispositions to genital and/or eye and/or systemic diseases, especially of the lymphatic system, and thus be used in methods for selecting compounds capable of preventing and/or of treating the said diseases. The said methods using the said transformed cells and/or transformed animals form part of the invention.

The compounds capable of being selected may be organic compounds such as polypeptides or carbohydrates or any other organic or inorganic compounds already known, or new organic compounds produced using molecular modelling techniques and obtained by chemical or biochemical synthesis, these techniques being known to persons skilled in the art.

The said selected compounds may be used to modulate the growth and/or the cellular replication of *Chlamydia trachomatis* or any other associated microorganism and thus to control infection by these microorganisms. The said compounds according to the invention may also be used to modulate the growth and/or the cellular replication of all eukaryotic or prokaryotic cells, in particular tumour cells and infectious microorganisms, for which the said compounds will prove active, the methods which make it possible to determine the said modulations being well known to persons skilled in the art.

Compound capable of modulating the growth of a microorganism is understood to designate any compound which makes it possible to act, to modify, to limit and/or to reduce the development, the growth, the rate of proliferation and/or the viability of the said microorganism.

This modulation may be achieved, for example, by an agent capable of binding to a protein and thus of inhibiting or of potentiating its biological activity, or capable of binding to a membrane protein of the outer surface of a microorganism and of blocking the penetration of the said microorganism into the host cell or of promoting the action of the immune system of the infected organism directed against the said microorganism. This modulation may also be achieved by an agent capable of binding to a nucleotide sequence of a DNA or RNA of a microorganism and of blocking, for example, the expression of a polypeptide whose biological or structural activity is necessary for the growth or for the reproduction of the said microorganism.

Associated microorganism is understood to designate in the present invention any microorganism whose gene expression may be modulated, regulated, induced or inhibited, or whose growth or cellular replication may also be modulated by a compound of the invention. Associated microorganism is also understood to designate in the present invention any microorganism containing nucleotide sequences or polypeptides according to the invention. These microorganisms may, in some cases, contain polypeptides or nucleotide sequences identical or homologous to those of the invention may also be detected and/or identified by the detection and/or identification methods or kit according to the invention and may also serve as a target for the compounds of the invention.

The invention relates to the compounds capable of being selected by a method of selection according to the invention.

The invention also relates to a pharmaceutical composition comprising a compound chosen from the following compounds:

a nucleotide sequence according to the invention;

a polypeptide or fusion polypeptide according to the invention;

a vector according to the invention;

an antibody according to the invention; and a compound capable of being selected by a method of selection according to the invention, optionally in combination with a pharmaceutically acceptable vehicle or carrier.

An effective quantity is understood to designate a sufficient quantity of the said compound or antibody, or of a polypeptide of the invention, which makes it possible to modulate the growth of *Chlamydia trachomatis* or of an associated microorganism.

The invention also relates to a pharmaceutical composition according to the invention for the prevention or the treatment of an infection by a bacterium belonging to the species *Chlamydia trachomatis* or by an associated microorganism.

The invention relates, in addition, to an immunogenic and/or vaccine composition, characterized in that it comprises one or more polypeptides according to the invention and/or one or more hybrid polypeptides according to the invention.

The invention also comprises the use of a transformed cell according to the invention, for the preparation of a vaccine composition.

The invention also relates to a vaccine composition, characterized in that it contains a nucleotide sequence according to the invention, a vector according to the invention and/or a transformed cell according to the invention.

The invention also relates to the vaccine compositions according to the invention, for the prevention or the treatment of an infection by a bacterium belonging to the species *Chlamydia trachomatis* or by an associated microorganism.

The invention also relates to the use of DNA encoding polypeptides of *Chlamydia trachomatis*, in particular antigenic determinants, to be formulated as vaccine compositions. In accordance with this aspect of the invention, the DNA of interest is engineered into an expression vector under the control of regulatory elements, which will promote expression of the DNA, i.e., promoter or enhancer elements. In one preferred embodiment, the promoter element may be cell-specific and permit substantial transcription of the DNA only in predetermined cells. The DNA may be introduced directly into the host either as naked DNA (U.S. Pat. No. 5,679,647 incorporated herein by reference in their entirety) or formulated in compositions with other agents which may facilitate uptake of the DNA including viral vectors, i.e., adenovirus vectors, or agents which facilitate immunization, such as bupivicaine and other local anesthetics (U.S. Pat. No. 5,593,972 incorporated herein by reference in their entirety), saponins (U.S. Pat. No. 5,739,118 incorporated herein by reference in their entirety) and cationic polyamines (published international application WO 96/10038 incorporated herein by reference in their entirety).

The DNA sequence encoding the antigenic polypeptide and regulatory element may be inserted into a stable cell line or cloned microorganism, using techniques, such as targeted homologous recombination, which are well known to those of skill in the art, and described e.g., in Chappel, U.S. Pat. No. 4,215,051; Skoultchi, WO 91/06667 each of which is incorporated herein by reference in its entirety.

Such cell lines and microorganisms may be formulated for vaccine purposes. In yet another embodiment, the DNA sequence encoding the antigenic polypeptide and regulatory element may be delivered to a mammalian host and introduced into the host genome via homologous recombination (See, Chappel, U.S. Pat. No. 4,215,051; Skoultchi, WO 91/06667 each of which is incorporated herein by reference in its entirety.

Preferably, the immunogenic and/or vaccine compositions according to the invention intended for the prevention and/or the treatment of an infection by *Chlamydia trachomatis* or by an associated microorganism will be chosen from the immunogenic and/or vaccine compositions comprising a polypeptide or one of its representative fragments corresponding to a protein, or one of its representative fragments, of the cellular envelope of *Chlamydia trachomatis*. The vaccine compositions comprising nucleotide sequences will also preferably comprise nucleotide sequences encoding a polypeptide or one of its fragments corresponding to a protein, or one of its representative fragments, of the cellular envelope of *Chlamydia trachomatis*.

Among these preferred immunogenic and/or vaccine compositions, the most preferred are those comprising a polypeptide or one of its representative fragments, or a nucleotide sequence or one of its representative fragments whose sequences are chosen from the nucleotide or amino acid sequences identified in this functional group and listed above.

The polypeptides of the invention or their representative fragments entering into the immunogenic compositions according to the invention may be selected by techniques known to persons skilled in the art, such as for example on the capacity of the said polypeptides to stimulate T cells, which results, for example, in their proliferation or the secretion of interleukins, and which leads to the production of antibodies directed against the said polypeptides.

In mice, in which a weight dose of the vaccine composition comparable to the dose used in humans is administered, the antibody reaction is tested by collecting serum followed by a study of the formation of a complex between the antibodies present in the serum and the antigen of the vaccine composition, according to the customary techniques.

According to the invention, the said vaccine compositions will be preferably in combination with a pharmaceutically acceptable vehicle and, where appropriate, with one or more appropriate immunity adjuvants.

Various types of vaccines are currently available for protecting humans against infectious diseases: attenuated live microorganisms (*M. bovis*—BCG for tuberculosis), inactivated microorganisms (influenza virus), acellular extracts (*Bordetella pertussis* for whooping cough), recombinant proteins (hepatitis B virus surface antigen), polysaccharides (pneumococci). Experiments are underway on vaccines prepared from synthetic peptides or from genetically modified microorganisms expressing heterologous antigens. Even more recently, recombinant plasmid DNAs carrying genes encoding protective antigens were proposed as an alternative vaccine strategy. This type of vaccination is carried out with a particular plasmid derived from an *E. coli* plasmid which does not replicate in vivo and which encodes only the vaccinal protein. Animals were immunized by simply injecting the naked plasmid DNA into the muscle. This technique leads to the expression of the vaccine protein in situ and to a cell-type (CTL) and a humoral type (antibody) immune response. This double induction of the immune response is one of the main advantages of the technique of vaccination with naked DNA.

The vaccine compositions of the present invention can be evaluated in in vitro and in vivo animal models prior to host, e.g., human, administration. For example, in vitro neutralization assays such as those described by Peterson et al. (1988) can be utilized. The assay described by Peterson et al. (1988) is suitable for testing vaccine compositions directed toward either *Chlamydia trachomatis* or *Chlamydia pneumoniae.*

Briefly, hyper-immune antisera is diluted in PBS containing 5% guinea pig serum, as a complement source. Chlamydiae ($10^4$ IFU; inclusion forming units) are added to the antisera dilutions. The antigen-antibody mixtures are incubated at 37° C. for 45 minutes and inoculated into duplicate confluent Hep-2 or HeLa cell monolayers contained in glass vials (e.g., 15 by 45 mm), which have been washed twice with PBS prior to inoculation. The monolayer cells are infected by centrifugation at 1000×g for 1 hour followed by stationary incubation at 37° for 1 hour. Infected monolayers are incubated for 48 or 72 hours, fixed and stained with a *Chlamydiae* specific antibody, such as anti-MOMP for *C. trachomatis*, etc. Inclusion-bearing cells are counted in ten fields at a magnification of 200×. Neutralization titer is assigned based on the dilution that gives 50% inhibition as compared to control monolayers/IFU.

The efficacy of vaccine compositions can be determined in vivo by challenging animal models of *Chlamydia trachomatis* infection, e.g., guinea pigs or mice, with the vaccine compositions. For example, in vivo vaccine composition challenge studies in the guinea pig model of *Chlamydia trachomatis* infection can be performed. Briefly, female guinea pigs weighing 450 to 500 g are housed in an enviornmentally controlled room with a 12 hour light-dark cycle and immunized with vaccine compositions via a variety of immunization routes. Post-vaccination, guinea pigs are infected in the genital tract with the agent of guinea pig inclusion conjunctivitis (GPIC), which has been grown in HeLa or McCoy cells (Rank et al. (1988)). Each animal receives approximately $1.4\times10^7$ inclusion forming units (IFU) contained in 0.05 ml of sucrose-phosphate-glutamate buffer, pH 7.4 (Schacter, J. (1980)). The course of infection monitored by determining the percentage of inclusion-bearing cells by indirect immunofluorescence with GPIC specific antisera, or by Giemsa-stained smear from a scraping from the genital tract (Rank et al. (1988)). Antibody titers in the serum is determined by an enzyme-linked immunosorbent assay.

Alternatively, in vivo vaccine composition challenge studies can be performed in the murine model of *Chlamydia trachomatis* (Morrison et al., 1995). Briefly, female mice 7 to 12 weeks of age receive 2.5 mg of depoprovera subcutaneously at 10 and 3 days before vaginal infection. Post-vaccination, mice are infected in the genital tract with 1,500 inclusion-forming units of *Chlamydia trachomatis* contained in 5 ml of sucrose-phosphate-glutamate buffer, pH. 7.4. The course of infection is monitored by determining the percentage of inclusion-bearing cells by indirect immunofluorence with *Chlamydia trachomatis* specific antisera, or by a Giemsa-stained smear from a scraping from the genital tract of an infected mouse. The presence of antibody titers in the serum of a mouse is determined by an enzyme-linked immunosorbent assay.

The vaccine compositions comprising nucleotide sequences or vectors into which the said sequences are inserted are in particular described in International Application No. WO 90/11092 and also in International Application No. WO 95/11307.

The nucleotide sequence constituting the vaccine composition according to the invention may be injected into the host after having been coupled to compounds which promote the penetration of this polynucleotide inside the cell or its transport up to the cell nucleus. The resulting conjugates may be encapsulated into polymeric microparticles, as described in International Application No. WO 94/27238 (Medisorb Technologies International).

According to another embodiment of the vaccine composition according to the invention, the nucleotide sequence, preferably a DNA, is complexed with the DEAE-dextran (Pagano et al., 1967) or with nuclear proteins (Kaneda et al., 1989), with lipids (Felgner et al., 1987) or encapsulated into liposomes (Fraley et al., 1980) or alternatively introduced in the form of a gel facilitating its transfection into the cells (Midoux et al., 1993, Pastore et al., 1994). The polynucleotide or the vector according to the invention may also be in suspension in a buffer solution or may be combined with liposomes.

Advantageously, such a vaccine will be prepared in accordance with the technique described by Tacson et al. or Huygen et al. in 1996 or alternatively in accordance with the technique described by Davis et al. in International Application No. WO 95/11307.

Such a vaccine may also be prepared in the form of a composition containing a vector according to the invention, placed under the control of regulatory elements allowing its expression in humans or animals. It is possible, for example, to use, as vector for the in vivo expression of the polypeptide antigen of interest, the plasmid pcDNA3 or the plasmid pcDNA1/neo, both marketed by Invitrogen (R & D Systems, Abingdon, United Kingdom). It is also possible to use the plasmid V1Jns.tPA, described by Shiver et al. in 1995. Such a vaccine will advantageously comprise, in addition to the recombinant vector, a saline solution, for example a sodium chloride solution.

The immunogenic compositions of the invention can be utilized as part of methods of immunization, wherein such methods comprise administering to a host, e.g., a human host, an immunizing amount of the immunogenic compositions of the invention. In a preferred embodiment, the method of immunizing is a method of immunizing against *Chlamydia trachomatis.*

A pharmaceutically acceptable vehicle is understood to designate a compound or a combination of compounds entering into a pharmaceutical or vaccine composition which does not cause side effects and which makes it possible, for example, to facilitate the administration of the active compound, to increase its life and/or its efficacy in the body, to increase its solubility in solution or alternatively to enhance its preservation. These pharmaceutically acceptable vehicles are well known and will be adapted by persons skilled in the art according to the nature and the mode of administration of the active compound chosen.

As regards the vaccine formulations, these may comprise appropriate immunity adjuvants which are known to persons skilled in the art, such as, for example, aluminium hydroxide, a representative of the family of muramyl peptides such as one of the peptide derivatives of N-acetyl-muramyl, a bacterial lysate, or alternatively incomplete Freund's adjuvant, Stimulon™ QS-21 (Aquila Biopharmaceuticals, Inc., Framinham, Mass.), MPL™ (3-O-deacylated monophosphoryl lipid A; RIBI ImmunoChem Research, Inc., Hamilton, Mont.), aluminum phosphate, IL-12 (Genetics Institute, Cambridge, Mass.).

Preferably, these compounds will be administered by the systemic route, in particular by the intravenous route, by the intranasal, intramuscular, intradermal or subcutaneous route, or by the oral route. More preferably, the vaccine composition comprising polypeptides according to the invention will be administered several times, spread out over time, by the intradermal or subcutaneous route.

Their optimum modes of administration, dosages and galenic forms may be determined according to criteria which are generally taken into account in establishing a treatment adapted to a patient, such as for example the patient's age or body weight, the seriousness of his general condition, tolerance of the treatment and the side effects observed.

The invention comprises the use of a composition according to the invention for the treatment or the prevention of genital diseases which are induced or worsened by *Chlamydia trachomatis.*

Finally, the invention comprises the use of a composition according to the invention for the treatment or the prevention of eye diseases which are induced or worsened by the presence of *Chlamydia trachomatis.*

Finally, the invention comprises the use of a composition according to the invention for the treatment or the prevention of systemic diseases, especially of the lymphatic system, which are induced or worsened by the presence of *Chlamydia trachomatis*.

Other characteristics and advantages of the invention appear in the following examples and figures:

LEGEND TO THE FIGURES

FIG. 1 Line for the production of *Chlamydia trachomatis* sequences (SEQ ID NO: 5182)

Figure 2:
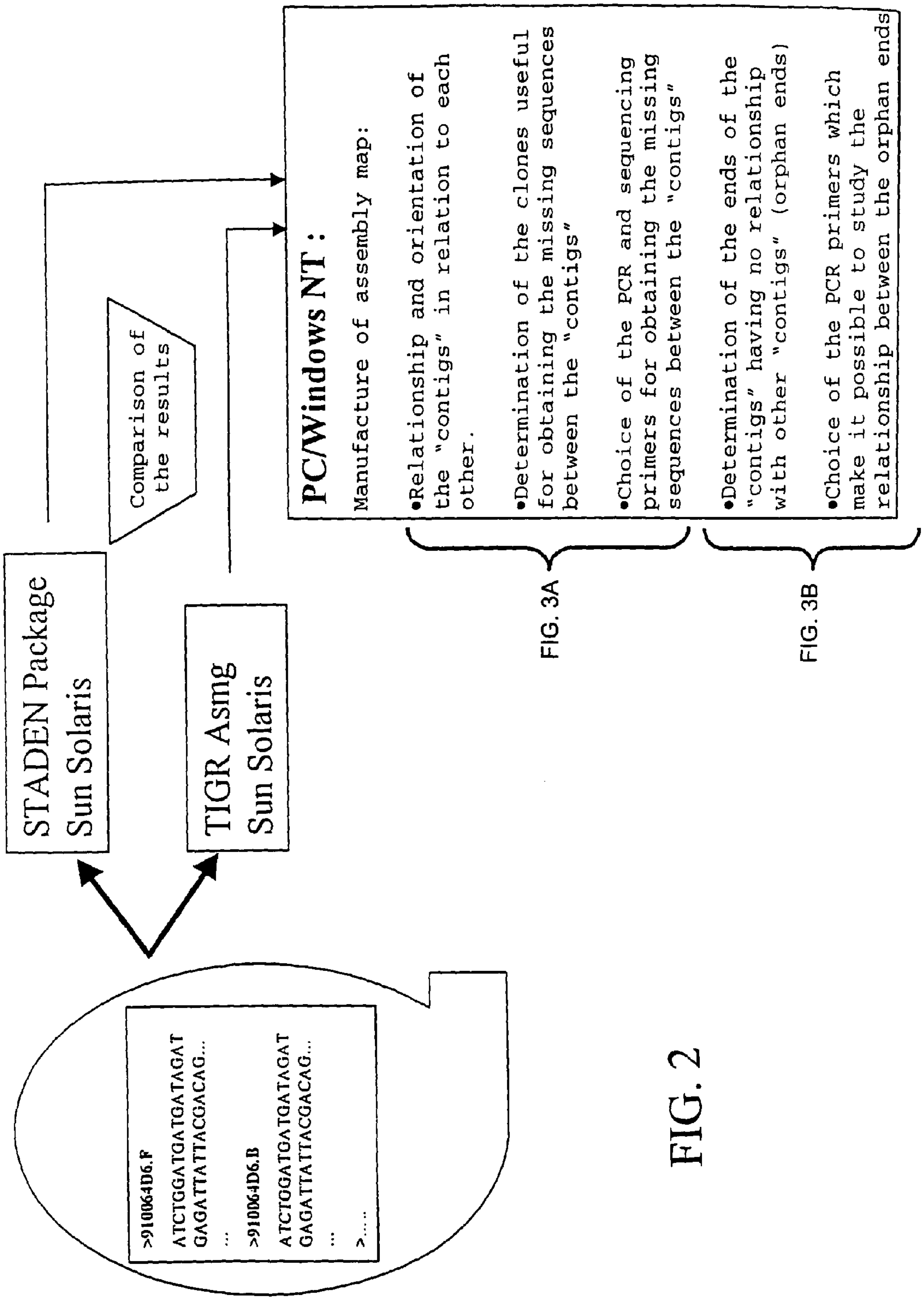

FIG. 2 Analysis of the sequences and assembling (SEQ ID NO: 5182)

FIG. 3 Finishing techniques

FIG. 3*a*) Assembly map

FIG. 3*b*) Determination and use of the orphan ends of the contigs

EXAMPLES

Cells

The *Chlamydia trachomatis* LGV2 strain used is identified to have over 98% homology with the outer membrane protein sequences omp1 (CHTMOMPA) and omp2 (CHTOMP2A) of the *Chlamydia trachomatis* serovar L2/434/Bu strain.

The *Chlamydia trachomatis* LGV2 strain is cultured on mouse fibroblasts (McCoy cells), obtained from the American Type Culture Collection, under the reference ATCC CRL-1696.

Culture of the Cells

The mouse fibroblasts are cultured in 75-ml cell culture flasks (Corning). The culture medium is Dulbecco's modified cell culture medium (Gibco BRL No. 04101965) supplemented with MEM amino acids (Gibco BRL-No. 04301140) L (5 ml per 500 ml of medium) and 5% foetal calf serum (Gibco BRL No. 10270 batch 40G8260K) without antibiotics or antifungals.

The cell culture stock is maintained in the following manner. The cell cultures are examined under an inverted microscope. 24 hours after confluence, each cellular lawn is washed with PBS (Gibco BRL No. 04114190), rinsed and then placed for 5 min in an oven in the presence of 3 ml of trypsine (Gibco BRL No. 25200056). The cellular lawn is then detached and then resuspended in 120 ml of culture medium, the whole is stirred in order to make the cellular suspension homogeneous. 30 ml of this suspension are then distributed per cell culture flask. The flasks are kept in a $CO_2$ oven (5%) for 48 hours at a temperature of 37° C. The cell stock is maintained so as to have available daily 16 flasks of subconfluent cells. It is these subconfluent cells which will be used so as to be infected with *Chlamydia*. 25-ml cell culture flasks are also used, these flasks are prepared in a similar manner but the volumes used for maintaining the cells are the following: 1 ml of trypsine, 28 ml of culture medium to resuspend the cells, 7 ml of culture medium are used per 25-ml flask.

Infection of the Cells with *Chlamydia*

Initially, the Chlamydiae are obtained frozen (at −70° C.), in suspension in a volume of 1 milliliter. This preparation is slowly thawed, 500 μl are collected and brought into contact with subconfluent cells, which are obtained as indicated above, in a 25-ml cell culture flask, containing 1 ml of medium, so as to cover the cells. The flask is then centrifuged at 2000 rpm in a <<swing>> rotor for microtitre plates, the centrifuge being maintained at a temperature of 35° C. After centrifugation, the two flasks are placed in an oven at 35° C. for three hours. 6 ml of culture medium containing cycloheximide (1 μg/ml) are then added and the flask is stored at 35° C. After 48 hours, the level of infection is evaluated by direct immunofluorescence and by the cytopathogenic effect caused to the cells.

Direct Immunofluorescence

Starting with infected cells, which were obtained as indicated above, a cellular smear is deposited with a Pasteur pipette on a microscope slide. The cellular smear is fixed with acetone for 10 minutes; after draining the acetone, the smear is covered with 30 μl of murine monoclonal antibodies directed against MOMP (major outer membrane protein) of *Chlamydia* (Syva, Biomérieux) labelled with fluorescein isothiocyanate. The whole is then incubated in a humid chamber at a temperature of 37° C. The slides are then rinsed with water, slightly dried, and then after depositing a drop of mounting medium, a coverslip is mounted before reading. The reading is carried out with the aid of a fluorescence microscope equipped with the required filters (excitation at 490 nm, emission at 520 nm).

Harvesting of the *Chlamydia Trachomatis*

After checking the infection by direct immunofluorescence, carried out as indicated above, the culture flasks are opened under a sterile cabinet, sterile glass beads with a diameter of the order of a millimeter are placed in the flask. The flask is closed and then vigorously stirred while being maintained horizontally, the cellular lawn at the bottom, so that the glass beads can have a mechanical action on the cellular lawn. Most of the cells are thus detached or broken; the effect of the stirring is observed under an optical microscope so as to ensure proper release of *Chlamydiae*.

Large-Scale Infection of the Cell Cultures

The product of the Chlamydiae harvest (culture medium and cellular debris) is collected with a pipette, and distributed into three cell culture flasks containing subconfluent L cells, obtained as indicated above. The cells thus inoculated are placed under gentle stirring (swing) in an oven at 35° C. After one hour, the flasks are kept horizontally in an oven so that the culture medium covers the cells for 3 hours. 30 ml of culture medium containing actydione (1 μg/ml) are then added to each of the flasks. The culture flasks are then stored at 35° C. for 48 hours. The cells thus infected are examined under an optical microscope after 24 hours, the cytopathogenic effect is evaluated by the appearance of cytoplasmic inclusions which are visible under an inverted optical microscope. After 48 hours, the vacuoles containing the *Chlamydiae* occupy the cytoplasm of the cell and push the cell nucleus sideways. At this stage, numerous cells are spontaneously destroyed and have left free elementary bodies in the culture medium. The *Chlamydiae* are harvested as described above and are either frozen at −80° C. or used for another propagation.

Purification of the *Chlamydiae*

The product of the *Chlamydia* harvests, stored at −80° C., is thawed on a water bath at room temperature. After thawing, each tube is vigorously stirred for one minute and immersed for one minute in an ultrasound tank (BRANSON 1200); the tubes are then stirred by inverting before being centrifuged for 5 min at 2000 rpm. The supernatant is carefully removed and kept at cold temperature (ice). The supernatant is vigorously stirred and then filtered on nylon filters having pores of 5 microns in diameter on a support (Nalgene) allowing a delicate vacuum to be established under the nylon filter. For each filtration, three nylon filters are superposed; these filters are replaced after every 40 ml of filtrate. Two hundred milliliters of filtration product are kept at cold temperature, and then after stirring by inverting, are centrifuged at 10,000 rpm for 90 min, the supernatant is removed and the pellet is taken up in 10 ml of 10 mM Tris, vigorously vortexed and then centrifuged at 10,000 rpm for 90 min. The supernatant is removed and the pellet is taken up in a buffer (20 mM Tris pH 8.0, 50 mM KCl, 5 mM $MgCl_2$) to which 800 units of DNAse I (Boehringer) are added. The whole is kept at 37° C. for one hour. One ml of 0.5 M EDTA is then added, and the whole is vortexed and frozen at −20° C.

Preparation of the DNA

The *Chlamydiae* purified above are thawed and subjected to a proteinase K (Boehringer) digestion in a final volume of 10 ml. The digestion conditions are the following:

0.1 mg/ml proteinase K, 0.1% SDS at 55° C., stirring every 10 min. The product of digestion is then subjected to a double extraction with phenol-chloroform, two volumes of ethanol are added and the DNA is directly recovered with a Pasteur pipette having one end in the form of a hook. The DNA is dried on the edge of the tube and then resuspended in 500 µl of 2 mM Tris pH 7.5. The DNA is stored at 4° C. for at least 24 hours before being used for the cloning.

Cloning of the DNA

After precipitation, the DNA is quantified by measuring the optical density at 260 nm. Thirty µg of *Chlamydia* DNA are distributed into 10 tubes of 1.5 ml and diluted in 300 µl of water. Each of the tubes is subjected to 10 applications of ultrasound lasting for 0.5 sec in a sonicator (Unisonix XL2020). The contents of the 10 tubes are then grouped and concentrated by successive extractions with butanol (Sigma B1888) in the following manner: two volumes of butanol are added to the dilute DNA mixture. After stirring, the whole is centrifuged for five minutes at 2500 rpm and the butanol is removed. This operation is repeated until the volume of the aqueous phase is less than 11 ml. The DNA is then precipitated in the presence of ethanol and of 0.5 M sodium acetate pH 5.4, and then centrifuged for thirty minutes at 15,000 rpm at cold temperature (4° C.). The pellet is washed with 75% ethanol, centrifuged for five minutes at 15,000 rpm and dried at room temperature. A tenth of the preparation is analysed on a 0.8% agarose gel. Typically, the size of the DNA fragments thus prepared is between 200 and 8000 base pairs.

To allow the cloning of the DNA obtained, the ends are repaired. The DNA is distributed in an amount of 10 µg/tube, in the following reaction medium: 100 µl final volume, 1H buffer (Biolabs 201L), 0.5 µl BSA 0.05 mg/ml, 0.1 mM dATP, 0.1 mM each of dGTP, dCTP or dTTP, 60,000 IU T4 DNA polymerase. The reaction is incubated for thirty minutes at 16° C. The contents of each of the tubes are then grouped before carrying out an extraction with phenol-chloroform and then precipitating the aqueous phase as described above. After this step, the DNA thus prepared is phosphorylated. For that, the DNA is distributed into tubes in an amount of 101 g per tube, and then in a final volume of 50 µl, the reaction is prepared in the following manner: 1 mM ATP, 1×kinase buffer, 10 IU T4 polynucleotide kinase (Biolabs 201L). The preparation is incubated for thirty minutes at 37° C. The contents of the tubes are combined and a phenol-chloroform extraction and then a precipitation are carried out in order to precipitate the DNA. The latter is then suspended in 1 µl of water and then the DNA fragments are separated according to their size on a 0.8% agarose gel (1×TAE). The DNA is subjected to an electric field of 5 V/cm and then visualized on a UV table.

The fragments whose size varies between 1200 and 2000 base pairs are selected by cutting out the gel. The gel fragment thus isolated is placed in a tube and then the DNA is purified with the Qiaex kit (20021 Qiagen), according to the procedure provided by the manufacturer.

Preparation of the Vector

14 µg of the cloning vector pGEM-5Zf (Promega P2241) are diluted in a final volume of 150 µl and are subjected to digestion with the restriction enzyme EcoRV 300 IU (Biolabs 195S) according to the protocol and with the reagents provided by the manufacturer. The whole is placed at 37° C. for 150 min and then distributed in the wells of a 0.8% agarose gel subjected to an electric field of 5 V/cm. The linearized vector is visualized on a UV table, isolated by cutting out the gel and then purified by the Qiaex kit (Qiagen 20021) according to the manufacturer's recommendations. The purification products are grouped in a tube, the volume is measured and then half the volume of phenol is added and the whole is vigorously stirred for 1 min. Half the volume of chloroform-isoamyl alcohol 24:1 is added and vigorously stirred for 1 min. The whole is centrifuged at 15,000 rpm for 5 min at 4° C., the aqueous phase is recovered and transferred into a tube. The DNA is precipitated in the presence of 0.3 M sodium acetate, pH 5.4 and 3 volumes of ethanol and placed at −20° C. for 1 hour. The DNA is then centrifuged at 15,000 rpm for 30 min at 4° C., the supernatant is removed while preserving the pellet, washed twice with 70% ethanol. After drying at room temperature, the DNA is suspended in 25 µl of water.

Phosphorylation of the Vector

25 µl of the vector prepared in the preceding step are diluted in a final volume of 500 µl of the following reaction mixture:

After repair, the DNA is subjected to a phenol-chloroform extraction and a precipitation, the pellet is then taken up in 10 µl of water, the DNA is quantified by measuring the optical density at 260 nm. The quantified DNA is ligated into the vector PGEm-5Zf(+) prepared by the restriction enzyme EcoRV and dephosphorylated (see preparation of the vector). The ligation is carried out under three conditions which vary in the ratio between the number of vector molecules and the number of insert molecules. Typically, an equimolar ratio, a ratio of 1:3 and a ratio of 3:1 are used for the ligations which are, moreover, carried out under the following conditions: vector PGEm-5Zf(+) 25 ng, cut DNA, ligation buffer in a final volume of 20 µl with T4 DNA ligase (Amersham E70042X); the whole is then placed in a refrigerator overnight and then a phenol-chloroform extraction and a precipitation are carried out in a conventional manner. The pellet is taken up in 5 µl of water.

Transformation of the Bacteria

Plating of the bacteria

Petri dishes containing LB Agar medium containing ampicillin (50 µg/ml), Xgal (280 µg/ml) [5-bromo-4-chloro-indolyl-beta-D-galactopyranoside (Sigma B4252)], IPTG (140 µg/ml) [isopropyl-beta-D-thiogalactoside (Sigma I-6758)] are used, 50 and 100 µl of bacteria are plated for each of the ligations. The Petri dishes are placed upside down at 37° C. for 15 to 16 hours in an oven. The number of <<recombinant>> positive clones is evaluated by counting the white colonies and the blue colonies which are thought to contain the vector alone.

Evaluation of the <<Recombinant>> Positive Clones:

Ninety-four white colonies and two blue colonies are collected with the aid of sterile cones and are deposited at the bottom of the wells of plates designed for carrying out the amplification techniques. 30 µl of the following reaction mixture are added to each well: 1.7 mM $MgCl_2$, 0.2 mM each of dATP, dCTP, dGTP and dTTP, two synthetic oligonucleotides corresponding to sequences flanking the cloning site on either side and orienting the synthesis of the DNA in a convergent manner (0.5 μM RP and PU primers, 1 U TAQ polymerase (GibcoBRL 18038-026)).

The colonies thus prepared are subjected to a temperature of 94° C. for 5 min and then to 30 thermal cycles composed of the following steps: 94° C. for 40 s, 50° C. for 30 s, 72° C. for 180 s. The reaction is then kept for 7 min at 72° C. and then kept at 4° C.

The amplification products are deposited on an agarose gel (0.8%), stained with ethidium bromide, subjected to electrophoresis, and then analysed on an ultraviolet table. The presence of an amplification fragment having a size greater than 500 base pairs indicates the presence of an insert. The bacterial clones are then prepared so as to study the sequence of their insert.

Sequencing

To sequence the inserts of the clones obtained as above, these were amplified by PCR on bacteria cultures carried out overnight using the primers for the vectors flanking the inserts. The sequence of the ends of these inserts (on average 500 bases on each side) was determined by automated fluorescent sequencing on an ABI 377 sequencer, equipped with the ABI Prism DNA Sequencing Analysis software (version 2.1.2).

Analysis of the Sequences

The sequences obtained by sequencing in a high-yield line (FIG. 1) are stored in a database; this part of the production is independent of any treatment of the sequences. The sequences are extracted from the database, avoiding all the regions of inadequate quality, that is to say the regions for which uncertainties are observed on the sequence at more than 95%. After extraction, the sequences are introduced into a processing line, the diagram of which is described in FIG. 2. In a first path of this processing line, the sequences are assembled by the Gap4 software from R. Staden (Bonfield et al., 1995) (OS UNIX/SUN Solaris); the results obtained by this software are kept in the form of two files which will be used for a subsequent processing. The first of these files provides information on the sequence of each of the contigs obtained. The second file represents all the clones participating in the composition of all the contigs as well as their positions on the respective contigs.

The second processing path uses a sequence assembler (TIGR-Asmg assembler UNIX/SUN Solaris); the results of this second processing path are kept in the form of a file in the TIGR-Asmg format which provides information on the relationship existing between the sequences selected for the assembly. This assembler is sometimes incapable of linking contigs whose ends overlap over several hundreds of base pairs.

The results obtained from these two assemblers are compared with the aid of the BLAST program, each of the contigs derived from one assembly path being compared with the contigs derived from the other path.

For the two processing paths, the strict assembly parameters are fixed (95% homology, 30 superposition nucleotides). These parameters avoid 3 to 5% of the clones derived from eukaryotic cells being confused with sequences obtained from the clones derived from *Chlamydia trachomatis*. The eukaryotic sequences are however preserved during the course of this project; the strategy introduced, which is described below, will be designed, inter alia, not to be impeded by these sequences derived from contaminating clones.

The results of these two assemblers are processed in a software developed for this project. This software operates on a Windows NT platform and receives, as data, the results derived from the STADEN software and/or the results derived from the TIGR-Asmg assembler, the software, results, after processing of the data, in the determination of an assembly map which gives the proximity relationship and the orientation of the contigs in relation to one another (FIG. 3*a*). Using this assembly map, the software determines all the primers necessary for finishing the project. This treatment, which will be detailed below, has the advantage of distinguishing the isolated sequences derived from the contaminations, by the DNA eukaryotic cells, of the small-sized sequences clearly integrated into the project by the relationships which they establish with contigs. In order to allow, without any risk of error, the arrangement and the orientation of the contigs in relation to one another, a statistical evaluation of the accuracy of the names <<naming>> of sequence is made from the results of <<contigation>>. This evaluation makes it possible to give each of the clone plates, as well as each of the subsets of plates, a weight which is inversely proportional to probable error rate existing in the <<naming>> of the sequences obtained from this plate or from a subset of this plate. In spite of a low error rate, errors may occur throughout the steps of production of the clones and of the sequences. These steps are numerous, repetitive and although most of them are automated, others, like the deposition in the sequencers, are manual; it is then possible for the operator to make mistakes such as the inversion of two sequences. This type of error has a repercussion on the subsequent processing of the data, by resulting in relationships (between the contigs) which do not exist in reality, then in attempts at directed sequencing between the contigs which will end in failure. It is because of this that the evaluation of the naming errors is of particular importance since it allows the establishment of a probabilistic assembly map from which it becomes possible to determine all the clones which will serve as template to obtain sequences separating two adjacent contigs. Table 2 of parent U.S. Application Ser. No. 60/107,077 filed Nov. 4, 1998, French application 97-15041 filed Nov. 28, 1997 and French application 97-16034 filed Dec. 17, 1997, each of which is incorporated by reference herein in its entirety, gives the clones and the sequences of the primers initially used during the initial operations.

To avoid the step which consists in ordering and then preparing the clones by conventional microbiological means, outer and inner primers oriented towards the regions not yet sequenced are defined by the software. The primers thus determined make it possible to prepare, by PCR, a template covering the nonsequenced region. It is the so-called outer primers (the ones most distant from the region to be sequenced) which are used to prepare this template. The template is then purified and a sequence is obtained on each of the two strands during 2 sequencing reactions which each use one of the 2 inner primers. In order to facilitate the use of this approach, the two outer primers and the two inner primers are prepared and then stored on the same position of 4 different 96-well plates. The two plates containing the outer primers are used to perform the PCRs which serve to prepare the templates. These templates will be purified on purification columns preserving the topography of the plates. Each of the sequences are obtained using primers situated on one and then on the other of the plates containing the inner primers. This distribution allows a very extensive automation of the process and results in a method which is simple to use for finishing the regions not yet sequenced. Table 3 of parent U.S. Application Ser. No. 60/107,077 filed Nov. 4, 1998, French application 97-15041 filed Nov. 28, 1997 and French application 97-16034 filed Dec. 17, 1997, each of which is incorporated by reference herein in its entirety, gives the names and the sequences of the primers used for finishing *Chlamydia trachomatis*.

Finally, a number of contigs exist in a configuration where one of their ends is not linked to any other contig end (FIG. 3*b*) by a connecting clone relationship (a connecting clone is defined as a clone having one sequence end on a contig and the other end of its sequence on another contig; furthermore, this clone must be derived from a plate or a subset of plates with adequate naming quality). For the *Chlamydia trachomatis* project, this particular case occurred 37 times. Two adjacent PCR primers orienting the synthesis of the DNA towards the end of the consensus sequence are defined for each of the orphan ends of the consensus sequence. The primer which is closest to the end of the sequence is called the inner primer whereas the primer which is more distant from the end of the sequence is called the outer primer. The outer primers are used to explore the mutual relationship between the orphan ends of the different contigs. The presence of a single PCR product and the possibility of amplifying this product unambiguously using the inner primers evokes the probable relationship between the contigs on which the primers which allowed the amplification are situated. This relationship will be confirmed by sequencing and will allow the connection between the orphan ends of the consensus sequences. This strategy has made it possible to obtain a complete map of the *Chlamydia trachomatis* chromosome and then to finish the project.

Quality Control

All the bases not determined with certainty in the chromosomal sequence were noted and the density of uncertainties was measured on the entire chromosome. The regions with a high density of uncertainties were noted and the PCR primers spanning these regions were drawn and are represented in Table 4 of parent U.S. Application Ser. No. 60/107,077 filed Nov. 4, 1998, French application 97-15041 filed Nov. 28, 1997 and French application 97-16034 filed Dec. 17, 1997 each of which is incorporated by reference herein in its entirety.

Data Banks

Local reorganizations of major public banks were used. The protein bank used consists of the nonredundant fusion of the Genpept bank (automated translation of GenBank, NCBI; Benson et al., 1996).

The entire BLAST software (public domain, Altschul et al., 1990) for searching for homologies between a sequence and protein or nucleic data banks was used. The significance levels used depend on the length and the complexity of the region tested as well as the size of the reference bank. They were adjusted and adapted to each analysis.

The results of the search for homologies between a sequence according to the invention and protein or nucleic data banks are presented and summarized in Table 1 below.

Table 1: List of Coding Chromosome Regions and Homologies Between These Regions and the Sequence Banks.

Legend to Table 1: Open reading frames are identified with the GenMark software version 2.3A (GenePro), the template used is *Chlamydia trachomatis* of order 4 on a length of 196 nucleotides with a window of 12 nucleotides and a minimum signal of 0.5. These reading frames are numbered in order of appearance on the chromosome, starting with ORF2 (ORF column). The positions of the beginning and of the end are then given in column 2 (position). When the position of the beginning is greater than the position of the end, this means that the region is encoded by the strand complementary to the sequence which was given in the sequence SEQ ID No. 1.

All the putative products were subjected to a search for homology on GENPEPT (release 103 for SEQ ID No. 2 to SEQ ID No. 1076 and release 108 for SEQ ID No. 1077 to SEQ ID No. 1197 with the BLASTp software (Altschul et al. 1990), with, as parameters, the default parameters with the exception of the expected value E set at $10^{-5}$ (for SEQ ID No. 2 to SEQ ID No. 1076) and P value set at $e^{-10}$ (for SEQ ID No. 1077 to SEQ ID No. 1197). Subsequently, only the identities greater than 30% (1% column) were taken into account. The description of the most homologous sequence is given in the Homology column; the identifier for the latter sequence is given in the ID column and the animal species to which this sequence belongs is given in the Species column. The Homology score is evaluated by the sum of the blast scores for each region of homology and reported in the Score column. Table 1 also reflects data from additional ORF finder programs as defined below.

Materials and Methods: Transmembrane Domains:

The DAS software was used as recommended by the authors (Cserzo et al., 1997).

This method uses, to predict the transmembrane domains, templates derived from a sampling of selected proteins. All the regions for which a <<Cutoff>> greater than 1.5 was found by the program were taken into account.

Additional ORF Finder Programs

For this analysis, two additional ORF finder programs were used to predict potential open reading frames of a minimum length of 74 amino acids; Glimmer (Salzberg, S. L., Delcher, A., Kasif, S., and W. White. 1998. Microbial gene identification using interpolated Markov models. Nucleic Acids Res. 26:544–548.), and an in-house written program. The in-house program used a very simple search algorithm. The analysis required the that the genomic DNA sequence text be in the 5' to 3' direction, the genome is circular, and that TAA, TAG, and TGA are stop codons. The search parameters were as follows:

(1) A search for an ORF that started with a GTG codon was performed. If no GTG codons were found, then a search for an ATG codon was performed. However, if a GTG codon was found, then a search downstream for a ATG codon was performed. All start and stop nucleotide positions were recorded.

(2) A search for an ORF that started with a TTG codon was performed. If no TTG codons were found, then a search for a ATG codon was performed. However, if a TTG codon was found, then a search downstream for a ATG codon was performed. All start and stop nucleotide positions were recorded.

(3) The analysis described in steps 1 and 2 were repeated for the opposite strand of DNA sequence.

(4) A search for ORFs that determined all ORF lengths using start and stop positions in the same reading frames was performed.

(5) All ORFs whose DNA length was less than 225 nucleotides were eliminated from the search.

Surface Exposed Protein Search Criteria

Potential cell surface vaccine targets are outer membrane proteins such as porins, lipoproteins, adhesions and other non-integral proteins. In *Chlamydia psittaci*, the major immunogens is a group of putative outer membrane proteins (POMPs) and no homologs have been found in *Chlamydia trachomatis* and *Chlamydia trachomatis* by traditional analysis (Longbottom, D., Russell, M., Dunbar, S. M., Jones, G. E., and A. J. Herring. 1998. Molecular Cloning and Characterization of the Genes Coding for the Highly Immunogenic Cluster of 90-Kilodalton Envelope Proteins from *Chlamydia psittaci* Subtype That Causes Abortion in Sheep. Infect Immun 66:1317–1324.) However, utilizing the criteria described below, several ORFs encoding outer membrane proteins have been identified in *Chlamydia trachomatis*, all of which may represent vaccine candidates. Any ORF which met any one of the criteria described below were considered to encode a surface exposed protein.

Protein homology searches of the translated ORFs were done using the Blastp 2.0 tool (Altschul, S. F., Madden, T. L., Schaffer, A. A., Zhang, J., Zhang, Z., Miller, W., and D. J. Lipman. 1997. Gapped BLAST and PSI-BLAST: a new generation of protein database search programs. Nucleic Acids Res. 25:3389–3402). An ORF was labeled surface exposed if the translated ORF had homology to a known, or hypothetical, or putative surface exposed protein with a P score less than $e^{-10}$.

Most, if not all, proteins that are localized to the membrane of bacteria, via a secretory pathway, contain a signal peptide. The software program SignalP, was used to analyze the amino acid sequence of an ORF for such a signal peptide (Nielsen, H., Engelbrecht. J., Brunak, S., and G. von Heijne. 1997. Identification of prokaryotic and eukaryotic signal peptides and prediction of their cleavage sites. Protein Engineering 10:1–6.) The first 60 N-terminal amino acids of each ORF were analyzed by SignalP using the Gram-negative software database. The output generates four separate values, maximum C, maximum Y, maximum S, and mean S. The S-score, or signal region, is the probability of the position belonging to the signal peptide. The C-score, or cleavage site, is the probability of the position being the first in the mature protein. The Y-score is the geometric average of the C-score and a smoothed derivative of the S-score. A conclusion of either a Yes or No is given next to each score. If all four conclusions are Yes and the C-terminal amino acid is either a phenylalanine (F) or a tyrosine (Y), the ORF was labelled outer membrane (Struyve, M., Moons, M., and J. Tommassen. 1991. Carboxy-terminal Phenylalanine is Essential for the Correct Assembly of a Bacterial Outer Membrane Protein. J. Mol. Biol. 218:141–148.)

The program called Psort was used to determine the localization of a protein based on its signal sequence, recognition of transmembrane segments, and analysis of its amino acid composition (Nakai, K., and M. Kanehisa. 1991. Expert system for predicting protein localization sites in gram-negative bacteria. Proteins 11:95–110.) An ORF is considered to be an outer membrane protein if the output data predicts the ORF encoded protein as outer membrane with a certainty value of 0.5 or better and whose value is at least twice as large as the next predicted localized certainty value.

Finally, ORFs that were not predicted to be outer membrane or surface exposed, based on the above criteria, were further analyzed. The Blastp output data for these ORFs were searched using various general and specific keywords, suggestive of known cell surface exposed proteins. An ORF was labeled surface exposed if the keywords matched had a Blastp hit with a P score less than $e^{-10}$, and there was no better data indicating otherwise. The following is a list of the searched keywords:

| | | |
|---|---|---|
| Adhesion | Adhesin | Invasin |
| Invasion | Extension | Omp |
| Outer Surface | Porin | Outer Membrane |
| Cell Surface | Cell Wall | Pilin |

-continued

| | | |
|---|---|---|
| Flagellar sheath | Cir | ChuA |
| CopB | ExeD | FadL |
| FecA | FepA | FhuA |
| FmdC | FomA | FrpB |
| GspD | HemR | HgbA |
| Hgp | HmbR | HmuR |
| HMW | HrcC | Hrp |
| InvG | LamB | LbpA |
| LcrQ | Lmp1 | MxiD |
| MOMP | PilE | HpaA |
| NolW | NspA | OpcP |
| OpnP | Opr | OspA |
| PhoE | PldA | Por |
| PscC | PulD | PupA |
| QuiX | RafY | ScrY |
| SepC | ShuA | SomA |
| SpiA | Tbp1 | Yop |
| YscC | mip | Tol |
| Pilus | BtuB | |

Those ORFs that did not meet the minimum requirement for being an outer membrane protein based on the above search criteria but which were homologous to identified outer membrane ORFs in *Chlamydia pneumoniae* were included. The *Chlamydia pneumoniae* genome (French patent application No. 97-14673, filed 21 Nov. 1997) was analyzed using the above search criteria and a number of outer membrane ORFs were identified. These *Chlamydia pneumoniae* ORFs were then tested against the *Chlamydia trachomatis* genome using Blastp. Any *Chlamydia trachomatis* ORF with a Blastp P value less than $e^{-10}$ against a *Chlamydia pneumoniae* outer membrane was included in this section, if there was no better data indicating otherwise. A list of ORFs in the *Chlamydia trachomatis* genome encoding putative surface exposed proteins is set forth above in the specification.

Identification of Putative Lipoproteins in the Genome of *Chlamydia Trachomatis*

Lipoproteins are the most abundant post-translationally modified bacterial secretory proteins (Pugsley, A. P. 1993. The complete general secretory pathway in Gram-negative bacteria. Microbiol. Rev. 57:50–108). The characteristic features of lipoproteins are a thiol-linked diacylglyceride and an amine-linked monoacyl group on the cysteine that becomes the amino-terminal residue after signal peptide cleavage by Signal Peptidase II. (Pugsley, A. P. 1993. The complete general secretory pathway in Gram-negative bacteria. Microbiol. Rev. 57:50–108). The identification of putative lipoproteins from the genomic sequencing of *Chlamydia trachomatis* was done by examining the deduced amino acid sequence of identified ORFs for the presence of a signal peptide with a Signal Peptidase II cleavage site analogous to the consensus sequence for prolipoprotein modification and processing reactions (Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York; Sutcliffe, I. C. and R. R. B. Russell. 1995. Lipoproteins of Gram-positive bacteria. J. Bacteriol. 177:1123–1128).

The deduced amino acid sequences of *Chlamydia trachomatis* ORFs were initially screened for the most basic of lipoprotein characteristics, a cysteine in the first 30 amino acids of the deduced protein. ORFs with a standard start codon (ATG, GTG, or TTG) and having one or more of the following characteristics were selected for direct analysis of their first 30 amino acids:

(a) Significant Signal P value (at least two out-of-the four values are Yes)

(b) PSORT value indicating membrane passage (IM-inner membrane, Peri-periplasm, or OM-outer membrane)

(c) Identification of the word lipoprotein among the ORF Blastp data set.

(d) A Blastp value of $<e^{-10}$ with a putative lipoprotein from *Chlamydia pneumoniae* (French application No. 97-14673 filed 21 Nov. 1997).

The first 30 amino acids encoded by each ORF in this set were analyzed for the characteristics commonly found in lipoprotein signal peptides (Pugsley, A. P. 1993. The complete general secretory pathway in Gram-negative bacteria. Microbiol. Rev. 57:50–108; Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York; Sutcliffe, I. C. and R. R. B. Russell. 1995. Lipoproteins of Gram-positive bacteria. J. Bacteriol. 177:1123–1128.) Putative lipoprotein signal peptides were required to have a cysteine between amino acid 10 and 30 and reach a minimum score of three based on the following criteria for lipoprotein signal peptides:

(a) Identification of specific amino acids in specific positions around the cysteine which are part of the consensus Signal Peptidase II cleavage site (Hayashi, S., and H. C. Wu. 1992. Identification and characterization of lipid-modified proteins in bacteria, p. 261–285. In N. M. Hooper and A. J. Turner (ed.) Lipid modification of proteins: A practical approach. Oxford University Press, New York); Sutcliffe, I. C. and R. R. B. Russell. 1995. Lipoproteins of Gram-positive bacteria. J. Bacteriol. 177:1123–1128). Since the identification of the cleavage site is the most important factor in identifying putative lipoproteins, each correctly positioned amino acid contributed toward reaching the minimum score of three.

(b) A hydrophobic region rich in alanine and leucine prior to the cleavage site (Pugsley, A. P. 1993. The complete general secretory pathway in Gram-negative bacteria. Microbiol. Rev. 57:50–108) contributed toward reaching the minimum score of three.

(c) A short stretch of hydrophilic amino acids greater than or equal to 1, usually lysine or arginine, following the N-terminal methionine (Pugsley, A. P. 1993. The complete general secretory pathway in Gram-negative bacteria. Microbiol. Rev. 57:50–108) contributed toward reaching the minimum score of three.

A list of ORFs in the *Chlamydia trachomatis* genome encoding putative lipoproteins is set forth above in the specification.

LPS-Related ORFs of *Chlamydia Trachomatis*

Lipopolysaccharide (LPS) is an important major surface antigen of *Chlamydia* cells. Monoclonal antibodies (Mab) directed against LPS of *Chlamydia pneumoniae* have been identified that can neutralize the infectivity of *Chlamydia pneumoniae* both in vitro and in vivo (Peterson et al. 1988). Similar results are expected utilizing monoclonal antibodies against LPS of *Chlamydia trachomatis*. LPS is composed of lipid A and a core oligosaccharide portion and is phenotypically of the rough type (R-LPS) (Lukacova, M., Baumann, M., Brade, L., Mamat, U., Brade, H. 1994. Lipopolysaccharide Smooth-Rough Phase Variation in Bacteria of the Genus *Chlamydia*. Infect. Immun. June 62(6):2270–2276.) The lipid A component is composed of fatty acids which serve to anchor LPS in the outer membrane. The core component contains sugars and sugar derivatives such as a trisaccharide of 3-deoxy-D-manno-octulosonic acid (KDO) (Reeves, P. R., Hobbs, M., Valvano, M. A., Skurnik, M., Whitfield, C., Coplin, D., Kido, N., Klena, J., Maskell, D., Raetz, C. R. H., Rick, P. D. 1996. Bacterial Polysaccharide Synthesis and Gene Nomenclature pp. 10071–10078, Elsevier Science Ltd.). The KDO gene product is a multifunctional glycosyltransferase and represents a shared epitope among the *Chlamydia*. For a review of LPS biosynthesis see, e.g., Schnaitman, C. A., Klena, J. D. 1993. Genetics of Lipopolysaccharide Biosynthesis in Enteric Bacteria. Microbiol. Rev. 57:655–682.

A text search of the ORF Blastp results identified several genes that are involved in Chlamydial LPS production with a P score less than $e^{-}$ . The following key-terms were used in the text search: KDO, CPS (Capsular Polysaccharide Biosynthesis), capsule, LPS, rfa, rfb, rfc, rfe, rha, rhl, core, epimerase, isomerase, transferase, pyrophosphorylase, phosphatase, aldolase, heptose, manno, glucose, IpxB, fibronectin, fibrinogen, fucosyltransferase, lic, lgt, pgm, tolC, rol, ChoP, phosphorylcholine, waaF, PGL-Tb1. A list of ORFs in the *Chlamydia trachomatis* genome encoding putative polypeptides involved in LPS biosynthesis is set forth above in the specification.

Type III and Other Secreted Products

Type III secretion enables gram-negative bacteria to secrete and inject pathogenicity proteins into the cytosol of eukaryotic host cells (Hueck, C. J., 1998. Type III Protein Secretion Systems in Bacterial Pathogens of Animals and Plants. In Microbiology and Molecular Biology Reviews. 62:379–433.) These secreted factors often resemble eukaryotic signal transduction factors, thus enabling the bacterium to redirect host cell functions (Lee, C. A., 1997. Type III secretion systems: machines to deliver bacterial proteins into eukaryotic cells? Trends Microbiol. 5:148–156.) In an attempt to corrupt normal cellular functions, Chlamydial pathogenicity factors injected into the host cytosol will nonetheless, as cytoplasmic constituents be processed and presented in the context of the Major Histocompatibility Complex (MHC class I). As such, these pathogenicity proteins represent MHC class I antigens and will play an important role in cellular immunity. Also included in this set are secreted non-type III products that may play a role as vaccine components.

A text search of the ORF Blastp results identified genes that are involved in *Chlamydia trachomatis* protein secretion with a P score less than $e^{-10}$. The following key-terms were used in the text search in an effort to identify surface localized or secreted products: Yop, Lcr, Ypk, Exo, Pcr, Pop, Ipa, Vir, Ssp, Spt, Esp, Tir, Hrp, Mxi, hemolysin, toxin, IgA protease, cytolysin, tox, hap, secreted and Mip.

*Chlamydia trachomatis* ORFs that did not meet the above keyword search criteria, but have homologs in *Chlamydia pneumoniae* that do meet the search criteria are included herein. The *Chlamydia pneumoniae* genome (French patent application No. 97–14673, filed 21 Nov. 1997) was analyzed using the above search criteria and a number of ORFs were identified. These *Chlamydia pneumoniae* ORFs were tested against the *Chlamydia trachomatis* genome using Blastp. Any *Chlamydia trachomatis* ORF with a Blastp P value$<e^{-10}$ against a *Chlamydia pneumoniae* homolog, identified using the above search criteria, was included. A list of ORFs in the *Chlamydia trachomatis* genome encoding putative secreted proteins is set forth above in the specification.

*Chlamydia* Trachomatis RGD Recognition Sequence

Proteins that contain Arg-Gly-Asp (RGD) attachment site, together with integrins that serve as their receptor constitute a major recognition system for cell adhesion. The RGD sequence is the cell attachment site of a large number of adhesive extracellular matrix, blood, and cell surface proteins and nearly half of the known integrins recognize this sequence in their adhesion protein ligands. There are many RGD containing microbial proteins such as the penton protein of adenovirus, the coxsackie virus, the foot and mouth virus and pertactin, a 69 kDa (kilodalton) surface protein of *Bordetella pertussis*, that serve as ligands through which these microbes bind to integrins on the cell surfaces and gain entry into the cell. The following provides evidence supporting the importance of RGD in microbial adhesion:

a) The adenovirus penton base protein has a cell rounding activity and when penton base was expressed in *E. coli*, it caused cell rounding and cells adhered to polystyrene wells coated with the protein. Mutant analysis showed that both these properties required an RGD sequence. Virus mutants with amino acid substitutions in the RGD sequence, showed much less adherence to HeLa S3 cells, and also were delayed in virus reproduction (Bai, M., Harfe, B., and Freimuth, P. 1993. Mutations That Alter an RGD Sequence in the Adenovirus Type 2 Penton Base Protein Abolish Its Cell-Rounding Activity and Delay Virus Reproduction in Flat Cells. J. Virol. 67:5198–5205).

b) It has been shown that attachment and entry of coxsackie virus A9 to GMK cells were dependent on an RGD motif in the capsid protein VP1. VP1 has also been shown to bind $\alpha_v\beta_3$ integrin, which is a vitronectin receptor (Roivainen, M., Piirainen, L., Hovi, T., Virtanen, I., Riikonen, T., Heino, J., and Hyypia, T. 1994. Entry of Coxsackievirus A9 into Host Cells: Specific Interactions with $\alpha_v\beta_3$ Integrin, the Vitronectin Receptor Virology, 203:357–65).

c) During the course of whooping cough, *Bordetella pertussis* interacts with alveolar macrophages and other leukocytes on the respiratory epithelium. Whole bacteria adheres by means of two proteins, filamentous hemagglutinin (FHA) and pertussis toxin. FHA interacts with two classes of molecules on macrophages, galactose containing glycoconjugates and the integrin CR3. The interaction between CR3 and FHA involves recognition of RGD sequence at the positions 1097–1099 in FHA (Relman, D., Tuomanen, E., Falkow, S., Golenbock, D. T., Saukkonen, K., and Wright, S. D. "Recognitition of a Bacterial Adhesin by an Integrin: Macrophage CR3 Binds Filamentous Hemagglutinin of *Bordetella Pertussis*." Cell, 61:1375–1382 (1990)).

d) Pertactin, a 69 kDa outer membrane protein of *Bordetella pertussis*, has been shown to promote attachment of Chinese hamster ovary cells (CHO). This attachment is mediated by recognition of RGD sequence in pertactin by integrins on CHO cells and can be inhibited by synthetic RGD containing peptide homologous to the one present in pertactin (Leininger, E., Roberts, M., Kenimer, J. G., Charles, I. G., Fairweather, N., Novotny, P., and Brennan, M. J. 1991. Pertactin, an Arg-Gly-Asp containing *Bordetella pertussis* surface protein that promotes adherence of mammalian cells Proc. Natl. Acad. Sci. USA, 88:345–349).

e) The RGD sequence is highly conserved in the VP1 protein of foot and mouth disease virus (FMDV). Attachment of FMDV to baby hamster kidney cells (BHK) has been shown to be mediated by VP1 protein via the RGD sequence. Antibodies against the RGD sequence of VP1 blocked attachment of virus to BHK cells (Fox, G., Parry, N. R., Barnett, P. V., McGinn, B., Rowland, D. J., and Brown, F. 1989. The Cell Attachment Site on Foot-and-Mouth Disease Virus Includes the Amino Acid Sequence RGD (Arginine-Glycine-Aspartic Acid) J. Gen. Virol., 70:625–637).

It has been demonstrated that bacterial adherence can be based on interaction of a bacterial adhesin RGD sequence with an integrin and that bacterial adhesins can have multiple binding site characteristic of eukaryotic extracellular matrix proteins. RGD recognition is one of the important mechanisms used by microbes to gain entry into eukaryotic cells.

The complete deduced protein sequence of the *Chlamydia trachomatis* genome was searched for the presence of RGD sequence. There were a total of 38 ORFs that had one or more RGD sequences. Not all RGD containing proteins mediate cell attachment. It has been shown that RGD containing peptides that have proline immediately following the RGD sequence are inactive in cell attachment assays (Pierschbacher & Ruoslahti. 1987. Influence of stereochemistry of the sequence Arg-Gly-Asp-Xaa on binding specificity in cell adhesion. J. Biol. Chem. 262:17294–98). ORFs that had RGD, with proline as the amino acid following the RGD sequence were excluded from the list. Also, RGD sequence may not be available at the surface of the protein or may be present in a context that is not compatible with integrin binding. Since not all RGD-containing proteins are involved in cell attachment, several other criteria were used to refine the list of RGD-containing proteins. A list of ORFs in the *Chlamydia trachomatis* genome encoding polypeptides with RGD recognition sequence(s) is set forth above in the specification.

Non-*Chlamydia Pneumoniae* ORFs

*Chlamydia trachomatis* ORFs were compared to the ORFs in the *Chlamydia pneumoniae* genome (French patent application No. 97-14673, filed 21 Nov. 1997) using Blastp. Any *Chlamydia trachomatis* ORF with a Blastp <<P>> value greater than $e^{-10}$ (i.e. $>e^{-10}$) against *Chlamydia pneumoniae* ORFs are included in this section. A list of ORFs in the *Chlamydia trachomatis* genome which are not found in *Chlamydia pneumoniae* is set forth above in the specification.

Cell Wall Anchor Surface ORFs

Many surface proteins are anchored to the cell wall of Gram-positive bacteria via the conserved LPXTG motif (Schneewind, O., Fowler, A., and Faull, K. F. 1995. Structure of the Cell Wall Anchor of Surface Proteins in *Staphylococcus aureus*. Science 268:103–106). A search of the proteins encoded by the *Chlamydia trachomatis* ORFs was done using the motif LPXTG. A list of ORFs in the *Chlamydia trachomatis* genome encoding polypeptides anchored to the cell wall is set forth above in the specification.

ECACC Deposits

Samples of *Chlamydia trachomatis* were deposited with the European Collection of Cell Cultures (ECACC), Salisbury, Wiltshire SP4 OJG, UK on Nov. 26, 1998 and assigned the provisional accession number 98112618. Cells can be grown, harvested and purified, and DNA can be prepared as discussed above. In order to enable recovery of specific fragments of the chromosome, one can run targeted PCR reactions, whose amplification products can then be sequenced and/or cloned into any suitable vector, according to standard procedures known to those skilled in the art.

In addition, a pool of clones covering the *Chlamydia trachomatis* genome was deposited with the ECACC on Nov. 26, 1998 and assigned provisional accession number 98112617. The pool of clones contains a series of clones, which when taken together, cover the whole chromosome, with a redundancy of slightly more than ten. The total number of clones in the sample is 13,572.

Table 4 lists groups of oligonucleotides to be used to amplify each of ORFs 2–1197 according to standard procedures known to those skilled in the art. Such oligonucleotides are listed as SEQ ID Nos. 1198 to 5981. For each ORF, the following is listed: one forward primer positioned 2,000 bp upstream of the beginning of the ORF; one forward primer positioned 200 bp upstream of the beginning of the ORF; one reverse primer positioned 2,000 bp downstream at the end of ORF, which is 2,000 bp upstream of the end site of the ORF on the complementary strand; and one reverse primer 200 bp downstream at the end of ORF, which is 200 bp upstream of the end site of the ORF on the complementary strand. The corresponding SEQ ID Nos. for the primers are listed in Table 4, where Fp is the proximal forward primer; Fd is the distal forward primer; Bp is the proximal reverse primer; and Bd is the distal reverse primer. The positions of the 5' ends of each of these primers on the nucleotide sequence of SEQ ID No. 1 are shown in Table 5.

The present invention is not to be limited in scope by the specific embodiments described herein, which are intended as single illustrations of individual aspects of the invention, and functionally equivalent methods and components are within the scope of the invention. Indeed, various modifications of the invention, in addition to those shown and described herein will become apparent to those skilled in the art from the foregoing description and accompanying drawings. Such modifications are intended to fall within the scope of the appended claims.

All publications and patent applications mentioned in this specification are herein incorporated by reference to the same extent as if each individual publication or patent application was specifically and individually indicated to be incorporated by reference.

TABLE 1

| ORF | begin | stop | Homology | ID | Species | Score | I % |
|---|---|---|---|---|---|---|---|
| ORF2 | 501 | 208 | putative | | | | |
| ORF3 | 3276 | 505 | putative 98 kDa outer membrane protein | U72499 | *Chlamydia psittaci* | 379 | 37 |
| ORF4 | 5068 | 3242 | lipid A disaccharide synthetase (lpxB) | U32786 | *Haemophilus influenzae* | 285 | 40 |
| ORF5 | 6400 | 5126 | poly(A) polymerase | AE000123 | *Escherichia coli* | 552 | 46 |
| ORF6 | 7977 | 6619 | D-alanine permease (dagA) | U32770 | *Haemophilus influenzae* | 265 | 36 |
| ORF7 | 8582 | 8082 | signalpeptidase II | X78084 | *Staphylococcus carnosus* | 174 | 36 |
| ORF8 | 8995 | 8591 | YteA | AF008220 | *Bacillus subtilis* | 157 | 43 |
| ORF9 | 9440 | 8979 | ORF 168 | D28752 | *Synechococcus* sp. | 318 | 42 |
| ORF10 | 9828 | 10430 | unknown | Z80108 | *Mycobacterium tuberculosis* | 324 | 46 |
| ORF11 | 10367 | 11254 | hypothetical protein (SP:P39587) | U67605 | *Methanococcus jannaschii* | 152 | 38 |
| ORF12 | 11245 | 11916 | rRNA methylase | D90913 | *Synechocystis* sp. | 209 | 40 |
| ORF13 | 12068 | 13324 | hypothetical | U32691 | *Haemophilus influenzae* | 367 | 45 |
| ORF14 | 13532 | 14413 | neutral amino acid transporter B0. | U75284 | *Oryctolagus cuniculus* | 410 | 39 |
| ORF15 | 14807 | 15019 | dihydrolipoamide acetyltransferase | L38646 | *Saccharopolyspora erythraea* | 324 | 47 |
| ORF16 | 14932 | 15969 | branched chain alpha-keto acid dehydrogenase E2 | M97391 | *Bacillus subtilis* | 577 | 44 |
| ORF17 | 15995 | 16501 | ORF_o328 | U18997 | *Escherichia coli* | 223 | 44 |
| ORF18 | 16467 | 16138 | putative | | | | |
| ORF19 | 18190 | 17417 | putative outer membrane protein | U80956 | *Borrelia burgdorferi* | 86 | 36 |
| ORF20 | 20521 | 18437 | ORF-2 | D11024 | *Shigella flexneri* | 642 | 37 |
| ORF21 | 22202 | 20814 | dnaK like protein (AA 1-660) | X52175 | *Chlamydia trachomatis* | 2214 | 99 |
| ORF22 | 22602 | 22153 | ORF, 82 kDa protein | L22180 | *Chlamydia trachomatis* | 558 | 89 |
| ORF23 | 22804 | 22478 | heat shock protein | M62819 | *Chlamydia trachomatis* | 503 | 99 |
| ORF24 | 23183 | 22824 | GrpE-like protein | L25105 | *Chlamydia trachomatis* | 580 | 98 |
| ORF25 | 23394 | 23110 | GrpE-like protein | L25105 | *Chlamydia trachomatis* | 373 | 87 |
| ORF26 | 24569 | 23394 | has homology to putative heat shock proteins of *Bacillus subtilis* and *Clostridium acetobutylicum*; ORFA; putative | L25105 | *Chlamydia trachomatis* | 1999 | 99 |
| ORF27 | 26383 | 24641 | aminoacyl-tRNA synthetase | L25105 | *Chlamydia trachomatis* | 3044 | 99 |
| ORF28 | 26640 | 27710 | ORFB; putative | L25105 | *Chlamydia trachomatis* | 1298 | 99 |
| ORF29 | 28780 | 27725 | putative | | | | |
| ORF30 | 29957 | 28740 | hypothetical protein | D64004 | *Synechocystis* sp. | 786 | 46 |
| ORF31 | 30721 | 30032 | putative | | | | |
| ORF32 | 31281 | 30520 | putative | | | | |
| ORF33 | 31436 | 31780 | putative | L46591 | *Bartonella bacilliformis* | 126 | 45 |
| ORF34 | 33356 | 31800 | putative | | | | |
| ORF35 | 33901 | 33314 | putative | | | | |
| ORF36 | 34116 | 35027 | Yer156cp | U18917 | *Saccharomyces cerevisiae* | 175 | 32 |
| ORF37 | 34988 | 35359 | F21C3.3 | Z71261 | *Caenorhabditis elegans* | 245 | 44 |
| ORF38 | 35167 | 35919 | putative | | | | |

TABLE 1-continued

| ORF | begin | stop | Homology | ID | Species | Score | I % |
|---|---|---|---|---|---|---|---|
| ORF39 | 35923 | 36996 | putative | | | | |
| ORF40 | 37810 | 37013 | putative | | | | |
| ORF41 | 38207 | 39085 | DAPH synthase-chorismate mutase | AF008220 | *Bacillus subtilis* | 529 | 48 |
| ORF42 | 39151 | 39927 | arginine binding protein | X67753 | *Escherichia coli* | 192 | 44 |
| ORF43 | 39923 | 40756 | putative | | | | |
| ORF44 | 40760 | 42007 | hypothetical protein MTCY154.05c | Z98209 | *Mycobacterium tuberculosis* | 663 | 43 |
| ORF45 | 42175 | 43116 | phophoglucoisomerase-like protein | L40822 | *Chlamydia trachomatis* | 681 | 95 |
| ORF46 | 42999 | 43802 | phophoglucoisomerase-like protein | L40822 | *Chlamydia trachomatis* | 959 | 91 |
| ORF47 | 44211 | 45227 | NADP-malate dehydrogenase | L40958 | *Flaveria bidentis* | 755 | 42 |
| ORF48 | 46072 | 45275 | putative | | | | |
| ORF49 | 46340 | 45975 | putative | | | | |
| ORF50 | 46895 | 46506 | putative | | | | |
| ORF51 | 47955 | 46882 | membrane protein (arcD) | M33223 | *Pseudomonas aeruginosa* | 892 | 47 |
| ORF52 | 48585 | 48178 | putative | | | | |
| ORF53 | 50072 | 48630 | putative | | | | |
| ORF54 | 50710 | 50099 | putative | | | | |
| ORF55 | 52439 | 50925 | dehydroquinate dehydratase/shikimate dehydrogenase | L32794 | *Nicotiana tabacum* | 142 | 36 |
| ORF56 | 53484 | 52348 | 3-dehydroquinate synthase | D90911 | *Synechocystis* sp. | 462 | 39 |
| ORF57 | 54536 | 53466 | chorismate synthase | X67516 | *Synechocystis* sp. | 801 | 56 |
| ORF58 | 55086 | 54595 | shikimate kinase II | M13045 | *Escherichia coli* | 154 | 38 |
| ORF59 | 56350 | 55031 | 5-enolpyruvylshikimate 3-phosphate synthase | U67500 | *Methanococcus jannaschii* | 355 | 37 |
| ORF60 | 55659 | 56084 | putative | | | | |
| ORF61 | 56847 | 58235 | putative | | | | |
| ORF62 | 58423 | 59181 | dihydrodipicolinate reductase | U47017 | *Pseudomonas syringae* pv. *tabaci* | 350 | 40 |
| ORF63 | 59185 | 60195 | aspartate-semialdehyde dehydrogenase | U67476 | *Methanococcus jannaschii* | 590 | 44 |
| ORF64 | 60188 | 61483 | aspartokinase III | U00006 | *Escherichia coli* | 312 | 41 |
| ORF65 | 61496 | 62353 | dihydrodipicolinate synthetase (dapA) | AE000609 | *Helicobacter pylori* | 345 | 42 |
| ORF66 | 62500 | 63141 | putative | | | | |
| ORF67 | 63396 | 63983 | hypothetical protein | Y14084 | *Bacillus subtilis* | 148 | 42 |
| ORF68 | 64628 | 64071 | putative | | | | |
| ORF69 | 64285 | 64656 | putative | | | | |
| ORF70 | 64944 | 64609 | putative | | | | |
| ORF71 | 65347 | 67269 | unknown | D26185 | *Bacillus subtilis* | 733 | 44 |
| ORF72 | 67656 | 68873 | putative | | | | |
| ORF73 | 68877 | 69233 | KsgA | Z94752 | *Mycobacterium tuberculosis* | 156 | 38 |
| ORF74 | 69212 | 69721 | high level kasgamycin resistance | D26185 | *Bacillus subtilis* | 306 | 43 |
| ORF75 | 69958 | 70455 | polypeptide deformylase | Y10305 | Calothrix PCC7601 | 272 | 43 |
| ORF76 | 70701 | 71006 | protein translocation protein, low temperature (secG) | U32727 | *Haemophilus influenzae* | 90 | 32 |
| ORF77 | 73191 | 71086 | putative | | | | |
| ORF78 | 74900 | 73497 | putative | | | | |
| ORF79 | 75463 | 74876 | homologous to unidentified *E. coli* protein | M96343 | *Bacillus subtilis* | 283 | 34 |
| ORF80 | 77124 | 75502 | o530; This 530 aa ORF is 33 pct identical (14 gaps) to 525 residues of an approx. 640 aa protein YHES_HAEIN SW: P44808 | AE000184 | *Escherichia coli* | 1447 | 42 |
| ORF81 | 77000 | 77299 | putative | | | | |
| ORF82 | 78095 | 77145 | integrase-recombinase protein (xerC) | U32750 | *Haemophilus influenzae* | 495 | 38 |
| ORF83 | 79065 | 78154 | hypothetical protein | D64001 | *Synechocystis* sp. | 400 | 40 |
| ORF84 | 81971 | 79878 | LON protease homolog | U88087 | *Arabidopsis thaliana* | 1927 | 48 |
| ORF85 | 82639 | 83271 | putative | | | | |
| ORF86 | 83792 | 84850 | DnaJ | U58360 | *Salmonella typhimurium* | 822 | 42 |
| ORF87 | 84876 | 86921 | putative | | | | |
| ORF88 | 88650 | 87313 | putative | | | | |
| ORF89 | 87440 | 87805 | putative | | | | |
| ORF90 | 88400 | 88747 | putative | | | | |
| ORF91 | 88717 | 89265 | putative | | | | |
| ORF92 | 89355 | 89732 | Hpr protein | X12832 | *Bacillus subtilis* | 128 | 32 |
| ORF93 | 89735 | 91447 | PTS enzyme I | U12340 | *Bacillus stearothermophilus* | 671 | 34 |
| ORF94 | 91749 | 91435 | ORF107 | X17014 | *Bacillus subtilis* | 120 | 35 |

TABLE 1-continued

| ORF | begin | stop | Homology | ID | Species | Score | I % |
|---|---|---|---|---|---|---|---|
| ORF95 | 92392 | 91745 | putative | | | | |
| ORF96 | 93138 | 92344 | dnaZX-like ORF put. DNA polymerase III | X06803 | *Bacillus subtilis* | 542 | 53 |
| ORF97 | 94134 | 93361 | excinuclease ABC subunit A (uvrA) | AE000583 | *Helicobacter pylori* | 326 | 36 |
| ORF98 | 94637 | 94071 | excinuclease ABC subunit A (uvrA) | AE000583 | *Helicobacter pylori* | 487 | 40 |
| ORF99 | 98299 | 94628 | UvrA | D49911 | *Thermus thermophilus* | 2090 | 44 |
| ORF100 | 98715 | 98113 | excinuclease ABC subunit A (uvrA) | AE000583 | *Helicobacter pylori* | 319 | 42 |
| ORF101 | 100228 | 98741 | pyruvate kinase | U83196 | *Chlamydia trachomatis* | 2411 | 97 |
| ORF102 | 101347 | 100337 | hypothetical protein | D90903 | *Synechocystis* sp. | 494 | 37 |
| ORF103 | 102210 | 101323 | YqiE | D84432 | *Bacillus subtilis* | 471 | 49 |
| ORF104 | 102485 | 102210 | putative | | | | |
| ORF105 | 104315 | 102726 | exonuclease VII, large subunit (xseA) | U32723 | *Haemophilus influenzae* | 634 | 51 |
| ORF106 | 105075 | 104254 | triose phosphate isomerase | L29475 | *Bacillus subtilis* | 558 | 48 |
| ORF107 | 105259 | 105894 | phosphoribosylanthranilate isomerase | U18969 | *Arabidopsis thaliana* | 300 | 38 |
| ORF108 | 107429 | 108460 | putative | | | | |
| ORF109 | 108665 | 108955 | putative | | | | |
| ORF110 | 109459 | 109013 | putative | | | | |
| ORF111 | 110366 | 109704 | putative | | | | |
| ORF112 | 111330 | 112520 | elongation factor Tu | L22216 | *Chlamydia trachomatis* | 2007 | 100 |
| ORF113 | 112915 | 113463 | transcription antitermination protein (nusG) | U32754 | *Haemophilus influenzae* | 313 | 37 |
| ORF114 | 113566 | 113994 | ribosomal protein L11 | D13303 | *Bacillus subtilis* | 443 | 59 |
| ORF115 | 114020 | 114604 | ribosomal protein L1 | Z11839 | *Thermotoga maritima* | 528 | 54 |
| ORF116 | 114720 | 115253 | ribosomal protein L10 | Z11839 | *Thermotoga maritima* | 143 | 38 |
| ORF117 | 115362 | 115676 | rpl12 (AA 1-128) | X53178 | *Synechocystis PCC6803* | 254 | 62 |
| ORF118 | 116022 | 119795 | DNA-directed RNA polymerase beta chain | X64172 | *Staphylococcus aureus* | 2675 | 61 |
| ORF119 | 119823 | 124010 | DNA-directed RNA polymerase beta' chain (rpoC) | U32733 | *Haemophilus influenzae* | 3486 | 50 |
| ORF120 | 124065 | 124988 | transaldolase | L19437 | *Homo sapiens* | 677 | 50 |
| ORF121 | 124873 | 125106 | transaldolase | U67611 | *Homo sapiens* | 121 | 44 |
| ORF122 | 126261 | 125536 | putative | | | | |
| ORF123 | 126328 | 126930 | putative | | | | |
| ORF124 | 127138 | 127785 | putative | | | | |
| ORF125 | 127924 | 129714 | Al isoform of vacuolar H+-ATPase subunit A | U22077 | *Gallus gallus* | 1062 | 45 |
| ORF126 | 129720 | 131033 | membrane ATPase | X79516 | *Haloferax volcanii* | 790 | 48 |
| ORF127 | 131018 | 131629 | putative | | | | |
| ORF128 | 131834 | 133156 | Na+ -ATPase subunit I | D17462 | *Enterococcus hirae* | 188 | 34 |
| ORF129 | 133075 | 133584 | v-type Na-ATPase | X76913 | *Enterococcus hirae* | 110 | 38 |
| ORF130 | 133625 | 133999 | v-type Na-ATPase | X76913 | *Enterococcus hirae* | 89 | 32 |
| ORF131 | 133861 | 134508 | putative | | | | |
| ORF132 | 134638 | 137454 | valyl-tRNA synthetase | D64006 | *Synechocystis* sp. | 1763 | 51 |
| ORF133 | 137442 | 140276 | PknD | Z95209 | *Mycobacterium tuberculosis* | 452 | 44 |
| ORF134 | 140733 | 140335 | putative | | | | |
| ORF135 | 141799 | 141077 | porphobilinogen deaminase | U22968 | Yersinia pestis | 282 | 38 |
| ORF136 | 143240 | 141780 | unknown | D26185 | *Bacillus subtilis* | 1113 | 53 |
| ORF137 | 143829 | 143128 | ORF3 | D64116 | *Bacillus subtilis* | 356 | 39 |
| ORF138 | 143923 | 144393 | putative | | | | |
| ORF139 | 144548 | 146326 | unknown | Z47210 | *Streptococcus pneumoniae* | 741 | 44 |
| ORF140 | 146413 | 147078 | manganese superoxide dismutase precursor | D12984 | *Caenorhabditis elegans* | 625 | 56 |
| ORF141 | 147140 | 148075 | acetyl-CoA carboxylase beta subunit (accD) | AE000604 | *Helicobacter pylori* | 704 | 52 |
| ORF142 | 148115 | 148549 | Dut | Z96072 | *Mycobacterium tuberculosis* | 277 | 53 |
| ORF143 | 148524 | 149027 | enzyme IIANtr | U18997 | *Escherichia coli* | 168 | 44 |
| ORF144 | 149000 | 149305 | putative | | | | |
| ORF145 | 149187 | 149708 | enzyme IIANtr | U18997 | *Escherichia coli* | 169 | 43 |
| ORF146 | 149712 | 150911 | putative | | | | |
| ORF147 | 152044 | 151004 | putative | | | | |
| ORF148 | 152664 | 151999 | putative | | | | |
| ORF149 | 152900 | 153352 | hypothetical | U32702 | *Haemophilus influenzae* | 292 | 47 |
| ORF150 | 153389 | 153997 | hypothetical protein in purB 5' region | AE000213 | *Escherichia coli* | 555 | 49 |
| ORF151 | 155276 | 153984 | ClpC adenosine triphosphatase | U02604 | *Bacillus subtilis* | 986 | 45 |
| ORF152 | 156544 | 155231 | ClpC adenosine triphosphatase | U02604 | *Bacillus subtilis* | 1535 | 53 |

TABLE 1-continued

| ORF | begin | stop | Homology | ID | Species | Score | I % |
|---|---|---|---|---|---|---|---|
| ORF153 | 156806 | 157525 | putative | | | | |
| ORF154 | 157489 | 158955 | Unknown | Y08559 | *Bacillus subtilis* | 99 | 39 |
| ORF155 | 159104 | 159961 | putative | | | | |
| ORF156 | 159916 | 161220 | putative | | | | |
| ORF157 | 161183 | 161593 | glycine cleavage protein homolog | U12980 | *Saccharomyces cerevisiae* | 175 | 35 |
| ORF158 | 162354 | 161623 | unidentified protein of Na+-translocating NADH-quinone reductase | D49364 | *Vibrio alginolyticus* | 524 | 51 |
| ORF159 | 163013 | 162363 | NADH:uniquinone oxidoreductase | Z37111 | *Vibrio alginolyticus* | 543 | 55 |
| ORF160 | 163941 | 162994 | NADH:ubiquinone oxidoreductase (GP:Z37111_4) | U32702 | *Haemophilus influenzae* | 287 | 54 |
| ORF161 | 165505 | 164474 | NADH:ubiquinone oxidoreductase subunit B | Z37111 | *Vibrio alginolyticus* | 449 | 45 |
| ORF162 | 166686 | 166093 | *H. pylori* predicted coding region HP1542 | AE000652 | *Helicobacter pylori* | 111 | 33 |
| ORF163 | 168171 | 166729 | pot. ORF 446 (aa 1-446) | X02369 | *Bacillus subtilis* | 722 | 42 |
| ORF164 | 169249 | 168848 | putative | | | | |
| ORF165 | 169586 | 170431 | hypothetical protein | D90906 | *Synechocystis* sp. | 462 | 48 |
| ORF166 | 170780 | 171334 | putative | | | | |
| ORF167 | 171333 | 172376 | penicillin-binding protein 2 | M26645 | *Neisseria flavescens* | 210 | 47 |
| ORF168 | 172309 | 172722 | penicillin-binding protein 2 | M26645 | *Neisseria flavescens* | 176 | 44 |
| ORF169 | 173048 | 174496 | murE gene product | Z15056 | *Bacillus subtilis* | 789 | 43 |
| ORF170 | 174399 | 174968 | N-acetylmuramoyl-L-alanine amidase (amiA) | AE000589 | *Helicobacter pylori* | 177 | 41 |
| ORF171 | 175267 | 175710 | integration host factor beta subunit | L35259 | *Pseudomonas aeruginosa* | 110 | 38 |
| ORF172 | 175714 | 177009 | putative | | | | |
| ORF173 | 177423 | 178115 | carboxyltransferase alpha subunit | U59236 | *Synechococcus* PCC7942 | 558 | 50 |
| ORF174 | 178084 | 180021 | ATP dependent translocator homolog (msbA) | U32691 | *Haemophilus influenzae* | 453 | 41 |
| ORF175 | 180704 | 180048 | putative | | | | |
| ORF176 | 181398 | 180631 | *H. pylori* predicted coding region HP0152 | AE000536 | *Helicobacter pylori* | 256 | 34 |
| ORF177 | 182594 | 181398 | contains similarity to DNA polymerase III, alpha chain (SP:P47277) | AF007270 | *Arabidopsis thaliana* | 173 | 50 |
| ORF178 | 182895 | 183656 | putative Ptcl protein | Y13937 | *Bacillus subtilis* | 371 | 53 |
| ORF179 | 183665 | 184786 | NifS2 | AF008220 | *Bacillus subtilis* | 452 | 43 |
| ORF180 | 186007 | 184796 | similar to [SwissProt Accession Number P37908] | D90888 | *Escherichia coli* | 93 | 30 |
| ORF181 | 186848 | 186000 | hypothetical | U32728 | *Haemophilus influenzae* | 154 | 35 |
| ORF182 | 187270 | 186749 | putative | | | | |
| ORF183 | 187426 | 187809 | regulatory protein for beta-lactamase | D90902 | *Synechocystis* sp. | 96 | 36 |
| ORF184 | 189481 | 188798 | putative | | | | |
| ORF185 | 189693 | 190352 | prolipoprotein diacylglyceryl transferase | AJ000977 | *Rhodobacter sphaeroides* | 99 | 38 |
| ORF186 | 190235 | 190510 | putative | | | | |
| ORF187 | 190785 | 191786 | putative | | | | |
| ORF188 | 191790 | 192464 | putative | | | | |
| ORF189 | 192392 | 193183 | 60 kDa inner-membrane protein | AE000645 | *Helicobacter pylori* | 373 | 40 |
| ORF190 | 193254 | 194630 | DnaA | D89066 | *Staphylococcus aureus* | 545 | 43 |
| ORF191 | 195046 | 194690 | putative | | | | |
| ORF192 | 195184 | 197031 | glycogen phosphorylase B | U47025 | *Homo sapiens* | 1758 | 56 |
| ORF193 | 197018 | 197635 | glycogen phosphorylase (AA 1-790) | X16931 | *Escherichia coli* | 580 | 53 |
| ORF194 | 197762 | 198208 | unknown | X86470 | *Saccharomyces cerevisiae* | 148 | 42 |
| ORF195 | 198963 | 197668 | F23B12.5 | Z77659 | *Caenorhabditis elegans* | 795 | 50 |
| ORF196 | 199957 | 198962 | pyruvate dehydrogenase E1 beta subunit | U09137 | *Arabidopsis thaliana* | 856 | 48 |
| ORF197 | 200327 | 199941 | pyruvate dehydrogenase E1 component, alpha subunit | U38804 | *Porphyra purpurea* | 170 | 31 |
| ORF198 | 200685 | 200266 | pyruvate dehydrogenase complex E1 alpha subunit | U81808 | *Thiobacillus ferrooxidans* | 302 | 60 |
| ORF199 | 200962 | 200585 | TPP-dependent acetoin dehydrogenase alpha-subunit | L31844 | *Clostridium magnum* | 127 | 43 |
| ORF200 | 201169 | 202377 | putative | | | | |
| ORF201 | 203441 | 202380 | UDP-3-O-[3-hydroxymyristoyl] glucosamine N-acyltransferase | U70214 | *Escherichia coli* | 577 | 38 |
| ORF202 | 203998 | 203471 | putative | | | | |
| ORF203 | 206449 | 204059 | OMP1 precursor | U51683 | *Brucella abortus* | 83 | 31 |

TABLE 1-continued

| ORF | begin | stop | Homology | ID | Species | Score | I % |
|---|---|---|---|---|---|---|---|
| ORF204 | 207425 | 206811 | recombination protein | D90916 | Synechocystis sp. | 334 | 40 |
| ORF205 | 207506 | 208528 | beta-ketoacyl-acyl carrier protein synthase III | M77744 | Escherichia coli | 706 | 50 |
| ORF206 | 208545 | 209471 | malonyl-CoA:Acyl carrier protein transacylase | U59433 | Bacillus subtilis | 522 | 48 |
| ORF207 | 209471 | 210214 | 3-ketoacyl-acyl carrier protein reductase | U59433 | Bacillus subtilis | 616 | 51 |
| ORF208 | 210586 | 210816 | acyl carrier protein (acpP) | U32701 | Haemophilus influenzae | 220 | 57 |
| ORF209 | 211332 | 210883 | protein kinase type II regulatory subunit (, EC 2.7.1.37) | J02934 | Rattus norvegicus | 150 | 31 |
| ORF210 | 212978 | 211374 | putative | | | | |
| ORF211 | 214134 | 212875 | unknown | AF017105 | Chlamydia psittaci | 852 | 63 |
| ORF212 | 214710 | 214168 | inclusion membrane protein C | AF017105 | Chlamydia psittaci | 231 | 43 |
| ORF213 | 215143 | 214754 | inclusion membrane protein B | AF017105 | Chlamydia psittaci | 181 | 47 |
| ORF214 | 216705 | 215236 | sodium-dependent transporter | AF017105 | Chlamydia psittaci | 1341 | 70 |
| ORF215 | 217917 | 216892 | amino acid transporter | AF017105 | Chlamydia psittaci | 1027 | 60 |
| ORF216 | 217088 | 217441 | putative | | | | |
| ORF217 | 218364 | 218702 | putative | | | | |
| ORF218 | 218695 | 219009 | putative | | | | |
| ORF219 | 219179 | 219748 | putative | | | | |
| ORF220 | 219891 | 220430 | putative | | | | |
| ORF221 | 220499 | 221074 | putative | | | | |
| ORF222 | 221137 | 221541 | putative | | | | |
| ORF223 | 221601 | 222092 | putative | | | | |
| ORF224 | 222472 | 223290 | putative | | | | |
| ORF225 | 223423 | 223818 | LAGLI-DADG endonuclease | U57090 | Chlamydia trachomatis | 619 | 99 |
| ORF226 | 224278 | 225171 | YqfU | D84432 | Bacillus subtilis | 530 | 46 |
| ORF227 | 225749 | 225174 | phenylacrylic acid decarboxylase | U67467 | Methanococcus jannaschii | 334 | 52 |
| ORF228 | 225334 | 225549 | Ydr537cp | U43834 | Saccharomyces cerevisiae | 96 | 42 |
| ORF229 | 226654 | 225749 | 4-hydroxybenzoate octaprenyltransferase | U61168 | Bacillus firmus | 321 | 36 |
| ORF230 | 227299 | 226769 | putative | | | | |
| ORF231 | 227646 | 227161 | stationary-phase survival protein (surE) | AE000602 | Helicobacter pylori | 274 | 48 |
| ORF232 | 228457 | 227750 | f311; This 311 aa ORF is 22 pct identical (13 gaps) to 186 residues of an approx. 488 aa protein YACA_BACSU SW: P37563; pyu1 of D21139 | AE000232 | Escherichia coli | 246 | 36 |
| ORF233 | 230001 | 228607 | GadC | AF005098 | Lactococcus lactis | 740 | 35 |
| ORF234 | 231074 | 230151 | f374; This 374 aa ORF is 30 pct identical (9 gaps) to 102 residues of an approx. 512 aa protein FLIC_SALMU SW: P06177 | AE000299 | Escherichia coli | 985 | 65 |
| ORF235 | 231348 | 233006 | putative | | | | |
| ORF236 | 233059 | 233829 | orf2 | D88555 | Methanobacterium thermoautotrophicum | 351 | 52 |
| ORF237 | 233801 | 234265 | hypothetical protein | D90906 | Synechocystis sp. | 151 | 37 |
| ORF238 | 234282 | 234854 | ORF_o211 | U28377 | Escherichia coli | 105 | 54 |
| ORF239 | 236300 | 235227 | glutamate 1-semialdehyde 2,1 aminomutase | X82072 | Pseudomonas aeruginosa | 650 | 52 |
| ORF240 | 236314 | 238209 | leucine tRNA synthetase | AF008220 | Bacillus subtilis | 1836 | 61 |
| ORF241 | 238164 | 238769 | leucine tRNA synthetase | AF008220 | Bacillus subtilis | 410 | 46 |
| ORF242 | 238769 | 240061 | 3-deoxy-D-manno-2-octulosonic acid (Kdo) transferase | Z22659 | Chlamydia trachomatis | 2240 | 100 |
| ORF243 | 242022 | 240313 | pyrophosphate-dependent phosphofructokinase beta subunit | Z32850 | Ricinus communis | 1021 | 43 |
| ORF244 | 242846 | 241941 | putative | | | | |
| ORF245 | 244480 | 242798 | pyrophosphate-dependent phosphofructokinase beta subunit | Z32850 | Ricinus communis | 1017 | 42 |
| ORF246 | 245897 | 244479 | YflS | D86417 | Bacillus subtilis | 951 | 42 |
| ORF247 | 246877 | 245924 | putative | | | | |
| ORF248 | 247731 | 246985 | ATP binding protein | L18760 | Lactococcus lactis | 442 | 47 |
| ORF249 | 248585 | 247743 | sporulation protein | M57689 | Bacillus subtilis | 532 | 38 |
| ORF250 | 249420 | 248569 | sporulation protein | M57689 | Bacillus subtilis | 601 | 38 |
| ORF251 | 250383 | 249766 | sporulation protein | M57689 | Bacillus subtilis | 464 | 47 |
| ORF252 | 251186 | 250545 | oligopeptide permease homolog AII | AF000366 | Borrelia burgdorferi | 119 | 31 |
| ORF253 | 252111 | 251095 | sporulation protein | M57689 | Bacillus subtilis | 317 | 36 |
| ORF254 | 253088 | 252066 | P. haemolytica o- | D88802 | Bacillus subtilis | 601 | 46 |

TABLE 1-continued

| ORF | begin | stop | Homology | ID | Species | Score | I % |
|---|---|---|---|---|---|---|---|
| | | | sialoglycoprotein endopeptidase; P36175 (660) transmembrane | | | | |
| ORF255 | 255153 | 256718 | Mg2+ transporter | D90905 | *Synechocystis* sp. | 103 | 35 |
| ORF256 | 256762 | 257844 | tRNA guanine transglycosylase | L33777 | *Zymomonas mobilis* | 482 | 44 |
| ORF257 | 257911 | 258690 | putative | | | | |
| ORF258 | 258780 | 259187 | putative | | | | |
| ORF259 | 259193 | 261604 | subunit B of DNA gyrase | Y07916 | *Salmonella typhimurium* | 1925 | 58 |
| ORF260 | 261622 | 264129 | DNA gyrase | L47978 | *Aeromonas salmonicida* | 1963 | 45 |
| ORF261 | 264125 | 264742 | unknown | D26185 | *Bacillus subtilis* | 307 | 37 |
| ORF262 | 264741 | 265628 | replication protein (dnaX) | U32802 | *Haemophilus influenzae* | 162 | 35 |
| ORF263 | 266416 | 265631 | putative isozyme of glucose-6-P-dehydrogenase; developmentally regulated gene in heterocyst development | U14553 | *Anabaena* sp. | 218 | 47 |
| ORF264 | 266938 | 266426 | glucose 6-phosphate dehydrogenase | U83195 | *Chlamydia trachomatis* | 914 | 99 |
| ORF265 | 267961 | 266942 | glucose 6-phosphate dehydrogenase | U83195 | *Chlamydia trachomatis* | 1770 | 99 |
| ORF266 | 268320 | 268066 | ORF3 | U15192 | *Chlamydia trachomatis* | 403 | 100 |
| ORF267 | 268510 | 268205 | ORF3 | U15192 | *Chlamydia trachomatis* | 320 | 91 |
| ORF268 | 270116 | 268500 | CTP synthetase | U15192 | *Chlamydia trachomatis* | 2828 | 100 |
| ORF269 | 270892 | 270095 | CMP-2-keto-3-deoxyoctulosonic acid synthetase | U15192 | *Chlamydia trachomatis* | 1313 | 100 |
| ORF270 | 271191 | 271613 | putative | | | | |
| ORF271 | 272219 | 272932 | nitrate transporter | X61625 | *Synechococcus* sp. | 300 | 34 |
| ORF272 | 272884 | 273588 | putative | | | | |
| ORF273 | 274816 | 273596 | putative | | | | |
| ORF274 | 274821 | 275666 | putative | | | | |
| ORF275 | 277689 | 276103 | ORF_f535 | U28377 | *Escherichia coli* | 396 | 38 |
| ORF276 | 278268 | 278816 | putative | | | | |
| ORF277 | 279771 | 279013 | tryptophan synthase alpha subunit | M15826 | *Pseudomonas aeruginosa* | 357 | 37 |
| ORF278 | 280777 | 279767 | tryptophan synthetase | M91661 | *Coprinus cinereus* | 1042 | 62 |
| ORF279 | 281603 | 281295 | tryptophan repressor | L26582 | *Enterobacter aerogenes* | 151 | 35 |
| ORP280 | 282104 | 281787 | putative | | | | |
| ORF281 | 284335 | 282794 | putative | | | | |
| ORF282 | 284460 | 284795 | putative | | | | |
| ORF283 | 284817 | 285674 | putative | | | | |
| ORF284 | 285637 | 286137 | putative | | | | |
| ORF285 | 286357 | 286677 | putative | | | | |
| ORF286 | 286681 | 287898 | hypothetical protein | U88070 | *Chlamydia psittaci* | 99 | 35 |
| ORF287 | 288127 | 289227 | comE ORF1 | D64002 | *Synechocystis* sp. | 90 | 46 |
| ORF288 | 289744 | 290679 | hypothetical protein | U88070 | *Chlamydia psittaci* | 246 | 36 |
| ORF289 | 290828 | 291535 | putative | | | | |
| ORF290 | 291514 | 292230 | endonuclease | U09868 | *Escherichia coli* | 160 | 37 |
| ORF291 | 292326 | 293048 | putative | | | | |
| ORF292 | 293330 | 294853 | putative | | | | |
| ORF293 | 295684 | 295010 | glutamine transport ATP-binding protein Q | U67524 | *Methanococcus jannaschii* | 407 | 38 |
| ORF294 | 296336 | 295692 | *H. influenzae* predicted coding region HI1555 | U32830 | *Haemophilus influenzae* | 134 | 37 |
| ORF295 | 297238 | 296243 | putative | | | | |
| ORF296 | 297791 | 298735 | putative | | | | |
| ORF297 | 298905 | 300458 | similar to putative oxygenase of *S. fradiae* | U73857 | *Escherichia coli* | 82 | 40 |
| ORF298 | 302152 | 300527 | putative | | | | |
| ORF299 | 304917 | 302071 | putative | | | | |
| ORF300 | 306157 | 304973 | DNA ligase | M74792 | *Thermus aquaticus thermophilus* | 745 | 41 |
| ORF301 | 306494 | 306111 | DNA LIGASE (EC 6.5.1.2) (POLYDEOXYRIBONUCLEOTIDE SYNTHASE (NAD+)). | D90870 | *Escherichia coli* | 197 | 40 |
| ORF302 | 306963 | 306436 | *Mycoplasma pneumoniae*, DNA ligase; similar to Swiss-Prot Accession Number P15042, from *E. coli* | AE000047 | *Mycoplasma pneumoniae* | 292 | 37 |
| ORF303 | 308773 | 306977 | unknown | Z84395 | *Mycobacterium tuberculosis* | 316 | 52 |
| ORF304 | 309881 | 309276 | putative | | | | |
| ORF305 | 310720 | 309872 | putative | | | | |
| ORF306 | 311570 | 310716 | putative | | | | |
| ORF307 | 312451 | 311972 | Preprotein translocase SecA subunit. | D90832 | *Escherichia coli* | 123 | 86 |

TABLE 1-continued

| ORF | begin | stop | Homology | ID | Species | Score | I % |
|---|---|---|---|---|---|---|---|
| ORF308 | 313435 | 314364 | sporulation protein | M57689 | *Bacillus subtilis* | 202 | 37 |
| ORF309 | 314340 | 314738 | putative | | | | |
| ORF310 | 315526 | 314741 | orfX gene product | X58778 | *Klebsiella pneumoniae* | 169 | 45 |
| ORF311 | 316507 | 315665 | Similar to *Saccharomyces cerevisiae* SUA5 protein | Z38002 | *Bacillus subtilis* | 147 | 41 |
| ORF312 | 317284 | 316529 | serine esterase [Spirulina platensis, Cl, Peptide, 207 aa] | S70419 | *Spirulina platensis* | 167 | 58 |
| ORF313 | 317592 | 317338 | putative | | | | |
| ORF314 | 318470 | 317499 | putative | | | | |
| ORF315 | 317599 | 317874 | putative | | | | |
| ORF316 | 318947 | 318477 | putative | | | | |
| ORF317 | 319342 | 320142 | ORF2 | L35036 | *Chlamydia psittaci* | 802 | 60 |
| ORF318 | 320544 | 321497 | putative | | | | |
| ORF319 | 321485 | 321937 | putative | | | | |
| ORF320 | 321901 | 322362 | putative | | | | |
| ORF321 | 322301 | 323140 | putative | | | | |
| ORF322 | 323144 | 324913 | putative | | | | |
| ORF323 | 325621 | 324977 | YqiZ | D84432 | *Bacillus subtilis* | 430 | 43 |
| ORF324 | 326268 | 325621 | integral membrane protein homolog | U97348 | *Lactobacillus fermentum* | 343 | 44 |
| ORF325 | 326469 | 327203 | adenylate kinase | AB000111 | *Synechococcus* sp. | 371 | 46 |
| ORF326 | 327281 | 328150 | putative | | | | |
| ORF327 | 328605 | 328204 | RpsI | Z95389 | *Mycobacterium tuberculosis* | 315 | 55 |
| ORF328 | 329066 | 328734 | 50S ribosomal subunit protein L13 | U18997 | *Escherichia coli* | 269 | 60 |
| ORF329 | 329663 | 329292 | YqhX | D84432 | *Bacillus subtilis* | 297 | 56 |
| ORF330 | 330666 | 329608 | biotin carboxylase | L14862 | *Anabaena* sp. | 1089 | 58 |
| ORF331 | 331161 | 330670 | YqhW | D84432 | *Bacillus subtilis* | 208 | 52 |
| ORF332 | 331731 | 331177 | elongation factor P | D64001 | *Synechocystis* sp. | 297 | 33 |
| ORF333 | 332404 | 331721 | putative CfxE protein | Y13937 | *Bacillus subtilis* | 483 | 55 |
| ORF334 | 332779 | 333021 | putative | | | | |
| ORF335 | 333005 | 333589 | putative | | | | |
| ORF336 | 334357 | 333806 | putative | | | | |
| ORF337 | 334089 | 334361 | putative | | | | |
| ORF338 | 335142 | 334729 | putative | | | | |
| ORF339 | 335195 | 335602 | putative | | | | |
| ORF340 | 335673 | 335194 | putative | | | | |
| ORF341 | 336334 | 335903 | putative | | | | |
| ORF342 | 337378 | 336338 | putative | | | | |
| ORF343 | 339947 | 337347 | ATP-dependent protease binding subunit | M29364 | *Escherichia coli* | 2005 | 53 |
| ORF344 | 340507 | 341847 | Pz-peptidase | D88209 | *Bacillus licheniformis* | 508 | 39 |
| ORF345 | 341783 | 342022 | group B oligopeptidase PepB | U49821 | *Streptococcus agalactiae* | 140 | 48 |
| ORF346 | 342249 | 342470 | hypA protein | M31739 | *Chlamydia trachomatis* | 361 | 99 |
| ORF347 | 342597 | 343370 | heat shock protein | L12004 | *Chlamydia trachomatis* | 1271 | 99 |
| ORF348 | 343361 | 344032 | hypB protein | M31739 | *Chlamydia trachomatis* | 1051 | 100 |
| ORF349 | 343956 | 344225 | hypB protein | M31739 | *Chlamydia trachomatis* | 344 | 100 |
| ORF350 | 344357 | 345142 | orf 3'of chaperonin homolog hypB [*Chlamydia psittaci*, pigeon strain P-1041, Peptide Partial, 98 aa] | S40172 | *Chlamydia psittaci* | 344 | 63 |
| ORF351 | 345934 | 345161 | o247; This 247 aa ORF is 51 pct identical (0 gaps) to 117 residues of an approx. 160 aa protein YPH7_CHRVI SW: P45371 | AE000174 | *Escherichia coli* | 387 | 41 |
| ORF352 | 347102 | 346080 | mutY homolog | U63329 | *Homo sapiens* | 492 | 46 |
| ORF353 | 347113 | 347940 | hypothetical 36.0 kD protein in rne-rpmF intergenic region | AE000209 | *Escherichia coli* | 397 | 44 |
| ORF354 | 350164 | 348146 | putative | | | | |
| ORF355 | 350423 | 351283 | enoyl-acyl carrier protein reductase [*Brassica napus*, Peptide, 385 aa] | S60064 | *Brassica napus* | 909 | 64 |
| ORF356 | 352207 | 351314 | hypothetical protein | D90914 | *Synechocystis* sp. | 113 | 42 |
| ORF357 | 352727 | 352245 | putative | | | | |
| ORF358 | 353709 | 353305 | FUNCTION UNKNOWN, SIMILAR PRODUCT IN *E. COLI* AND MYCOPLASMA PNEUMONIAE. | AB001488 | *Bacillus subtilis* | 213 | 40 |
| ORF359 | 354218 | 353670 | NADPH thioredoxin reductase | Z23108 | *Arabidopsis thaliana* | 577 | 60 |
| ORF360 | 354721 | 354140 | Thioredoxin Reductase (NADPH) | D45049 | Neurospora crassa | 417 | 60 |
| ORF361 | 354966 | 356672 | 30S ribosomal protein S1 | D90729 | *Escherichia coli* | 1305 | 44 |
| ORF362 | 356700 | 357377 | NusA | U74759 | *Chlamydia trachomatis* | 948 | 100 |

TABLE 1-continued

| ORF | begin | stop | Homology | ID | Species | Score | I % |
|---|---|---|---|---|---|---|---|
| ORF363 | 357326 | 358093 | NusA | U74759 | *Chlamydia trachomatis* | 1216 | 100 |
| ORF364 | 358035 | 360743 | | U74759 | *Chlamydia trachomatis* | 3311 | 98 |
| ORF365 | 360753 | 361121 | ORF6 gene product | Z18631 | *Bacillus subtilis* | 116 | 32 |
| ORF366 | 361162 | 361884 | tRNA pseudouridine 55 synthase | D90917 | *Synechocystis* sp. | 362 | 42 |
| ORF367 | 361826 | 362746 | protein X | M35367 | *Pseudomonas fluorescens* | 192 | 49 |
| ORF368 | 363859 | 362816 | hypothetical GTP-binding protein in pth 3' region | AE000219 | *Escherichia coli* | 978 | 52 |
| ORF369 | 364116 | 365195 | cds1 gene product | U88070 | *Chlamydia psittaci* | 1631 | 88 |
| ORF370 | 365198 | 365587 | cds2 gene product | U88070 | *Chlamydia psittaci* | 516 | 93 |
| ORF371 | 365479 | 367320 | cds2 gene product | U88070 | *Chlamydia psittaci* | 2817 | 87 |
| ORF372 | 367341 | 368603 | copN gene product | U88070 | *Chlamydia psittaci* | 585 | 37 |
| ORF373 | 368644 | 369081 | scc1 gene product | U88070 | *Chlamydia psittaci* | 528 | 67 |
| ORF374 | 369088 | 370251 | No definition line found | U88070 | *Chlamydia psittaci* | 1362 | 62 |
| ORF375 | 370769 | 371086 | ribosomal protein L28 (rpL28) | U32776 | *Haemophilus influenzae* | 182 | 46 |
| ORF376 | 371203 | 372816 | hypothetical protein | U88070 | *Chlamydia psittaci* | 1926 | 68 |
| ORF377 | 373119 | 373529 | hypothetical protein | U88070 | *Chlamydia psittaci* | 286 | 49 |
| ORF378 | 373614 | 374204 | hypothetical protein | U88070 | *Chlamydia psittaci* | 379 | 48 |
| ORF379 | 374736 | 374224 | putative | | | | |
| ORF380 | 376391 | 374703 | putative | | | | |
| ORF381 | 377062 | 376748 | corresponds to a 97 amino acid long polypeptide | L40838 | *Chlamydia trachomatis* | 490 | 98 |
| ORF382 | 377853 | 378737 | methylenetetrahydrofolate dehydrogenase | D64000 | *Synechocystis* sp. | 678 | 51 |
| ORF383 | 378626 | 379048 | putative | | | | |
| ORF384 | 379017 | 379403 | hypothetical | U32702 | *Haemophilus influenzae* | 137 | 45 |
| ORF385 | 380009 | 379641 | small protein | D90914 | Synechocystis sp. | 216 | 51 |
| ORF386 | 380187 | 381470 | DNA polymerase III beta-subunit (dnaN) | U32780 | *Haemophilus influenzae* | 76 | 39 |
| ORF387 | 381473 | 382567 | recombination protein | D26185 | *Bacillus subtilis* | 477 | 35 |
| ORF388 | 382704 | 383702 | putative | | | | |
| ORF389 | 383945 | 383655 | hypothetical | U70214 | *Escherichia coli* | 134 | 35 |
| ORF390 | 385217 | 383949 | putative | | | | |
| ORF391 | 385507 | 385178 | conserved hypothetical secreted protein | AE000606 | *Helicobacter pylori* | 185 | 45 |
| ORF392 | 386845 | 385706 | hypothetical protein | D64000 | *Synechocystis* sp. | 686 | 41 |
| ORF393 | 386127 | 386627 | putative | | | | |
| ORF394 | 387372 | 386872 | ORF1; putative | M26130 | *Streptococcus parasanguis* | 150 | 35 |
| ORF395 | 387823 | 387338 | ytgD | AF008220 | *Bacillus subtilis* | 168 | 42 |
| ORF396 | 388250 | 387816 | TroR | U55214 | *Treponema pallidum* | 134 | 40 |
| ORF397 | 389169 | 388237 | putative protein of 299 amino acids | U30821 | *Cyanophora paradoxa* | 164 | 31 |
| ORF398 | 389955 | 389173 | TroB | U55214 | *Treponema pallidum* | 592 | 51 |
| ORF399 | 390988 | 389945 | YtgA | AF008220 | *Bacillus subtilis* | 282 | 30 |
| ORF400 | 391514 | 391810 | putative | | | | |
| ORF401 | 392410 | 393996 | adenine nucleotide translocase | Z49227 | *Arabidopsis thaliana* | 1295 | 56 |
| ORF402 | 394170 | 395354 | lepA gene product | X91655 | *Bacillus subtilis* | 1235 | 60 |
| ORF403 | 395309 | 395992 | GTP-binding membrane protein (lepA) | AE000552 | *Helicobacter pylori* | 543 | 54 |
| ORF404 | 396538 | 396059 | phosphogluconate dehydrogenase | U30255 | *Homo sapiens* | 411 | 55 |
| ORF405 | 397507 | 396542 | 6-phosphogluconate dehydrogenase | AB006102 | *Candida albicans* | 908 | 51 |
| ORF406 | 398753 | 397401 | tyrosyl-tRNA synthetase | M13148 | *Bacillus caldotenax* | 844 | 45 |
| ORF407 | 399688 | 398909 | whiG-Stv gene product | X68709 | *Streptoverticillium griseocarneum* | 463 | 41 |
| ORF408 | 400167 | 399778 | FLHA gene product | X63698 | *Bacillus subtilis* | 134 | 35 |
| ORF409 | 401224 | 400034 | flbF | M73782 | *Caulobacter crescentus* | 355 | 39 |
| ORF410 | 401776 | 402021 | ferredoxin IV | M59855 | *Rhodobacter capsulatus* | 98 | 54 |
| ORF411 | 402126 | 403220 | putative | | | | |
| ORF412 | 403348 | 405180 | GcpE | D90908 | *Synechocystis* sp. | 995 | 49 |
| ORF413 | 403788 | 403276 | putative | | | | |
| ORF414 | 405165 | 405920 | YfiH | U50134 | *Escherichia coli* | 166 | 43 |
| ORF415 | 407049 | 405955 | dihydrolipoamide transsuccinylase (odhB; EC 2.3.1.61) | M27141 | *Bacillus subtilis* | 833 | 61 |
| ORF416 | 409773 | 407056 | alpha-ketoglutarate dehydrogenase | U41762 | *Rhodobacter capsulatus* | 1537 | 50 |
| ORF417 | 410532 | 411416 | YqeR | D84432 | *Bacillus subtilis* | 496 | 44 |
| ORF418 | 411707 | 413410 | putative | | | | |
| ORF419 | 413433 | 412606 | putative | | | | |
| ORF420 | 413404 | 413952 | putative | | | | |
| ORF421 | 413841 | 415112 | putative | | | | |
| ORF422 | 414379 | 413978 | putative | | | | |

TABLE 1-continued

| ORF | begin | stop | Homology | ID | Species | Score | I % |
|---|---|---|---|---|---|---|---|
| ORF423 | 416664 | 415177 | putative | | | | |
| ORF424 | 417456 | 416740 | unknown | Z94752 | *Mycobacterium tuberculosis* | 172 | 36 |
| ORF425 | 418053 | 417721 | putative | | | | |
| ORF426 | 418603 | 418031 | putative | | | | |
| ORF427 | 419531 | 418647 | Hc2 nucleoprotein | L10193 | *Chlamydia trachomatis* | 1661 | 92 |
| ORF428 | 420190 | 419672 | [karp] gene products | M86605 | *Chlamydia trachomatis* | 612 | 96 |
| ORF429 | 421171 | 420245 | aminopeptidase | D17450 | *Mycoplasma salivarium* | 269 | 41 |
| ORF430 | 421988 | 421518 | putative | L39923 | *Mycobacterium leprae* | 165 | 36 |
| ORF431 | 422486 | 423043 | putative | | | | |
| ORF432 | 423226 | 425079 | glycogen operon protein GlgX | D90908 | *Synechocystis sp.* | 1229 | 55 |
| ORF433 | 426054 | 425146 | putative | | | | |
| ORF434 | 426985 | 426245 | Holliday junction specific DNA helicase | D83138 | *Pseudomonas aeruginosa* | 633 | 53 |
| ORF435 | 427248 | 427817 | deoxycytidine triphosphate deaminase (dcd) | AE000554 | *Helicobacter pylori* | 612 | 63 |
| ORF436 | 429560 | 429886 | putative | | | | |
| ORF437 | 430360 | 429857 | biotin apo-protein ligase | U27182 | *Saccharomyces cerevisiae* | 173 | 38 |
| ORF438 | 430637 | 430323 | putative | | | | |
| ORF439 | 430933 | 431787 | putative | | | | |
| ORF440 | 431658 | 431987 | putative | | | | |
| ORF441 | 432232 | 434475 | exonuclease V alpha-subunit | U29581 | *Escherichia coli* | 289 | 53 |
| ORF442 | 436308 | 434620 | methionyl-tRNA synthetase | AB004537 | *Schizosaccharomyces* pombe | 817 | 54 |
| ORF443 | 436574 | 436272 | putative | | | | |
| ORF444 | 437685 | 436567 | RNAseH II | AF005098 | *Lactococcus lactis* | 395 | 47 |
| ORF445 | 438262 | 437894 | ribosomal protein L19 | X72627 | *Synechocystis* sp. | 287 | 47 |
| ORF446 | 439127 | 438285 | tRNA (guanine-N1)-methyltransferase (trmD) | U32705 | *Haemophilus influenzae* | 374 | 56 |
| ORF447 | 439339 | 438986 | tRNA (guanine-N1)-methyltransferase (trmD) | U32705 | *Haemophilus influenzae* | 199 | 57 |
| ORF448 | 439705 | 439358 | ribosomal protein S16 (rpS16) | U32705 | *Haemophilus influenzae* | 168 | 39 |
| ORF449 | 441042 | 439699 | signal recognition particle protein | AE000347 | *Escherichia coli* | 865 | 40 |
| ORF450 | 441911 | 441042 | product similar to *E. coli* PRFA2 protein | Z49782 | *Bacillus subtilis* | 314 | 37 |
| ORF451 | 442593 | 441898 | polypeptide chain release factor 1 (prfA) | U32830 | *Haemophilus influenzae* | 708 | 62 |
| ORF452 | 444505 | 446388 | leader peptidase I | D90904 | *Synechocystis* sp. | 268 | 44 |
| ORF453 | 448068 | 446452 | isoleucyl-tRNA synthetase | U04953 | *Homo sapiens* | 704 | 49 |
| ORF454 | 449575 | 447932 | isoleucyl-tRNA synthetase | U04953 | *Homo sapiens* | 1687 | 55 |
| ORF455 | 450546 | 451076 | putative | | | | |
| ORF456 | 451623 | 451144 | putative | | | | |
| ORF457 | 452593 | 451517 | putative | | | | |
| ORF458 | 453195 | 452632 | putative | | | | |
| ORF459 | 453567 | 454868 | product similar to *E. coli* PhoH protein | Z97025 | *Bacillus subtilis* | 820 | 50 |
| ORF460 | 455430 | 454972 | CydB | Z95554 | *Mycobacterium tuberculosis* | 105 | 31 |
| ORF461 | 456047 | 455367 | cyanide insensitive terminal oxidase | Y10528 | *Pseudomonas aeruginosa* | 388 | 38 |
| ORF462 | 457384 | 456047 | cyanide insensitive terminal oxidase | Y10528 | *Pseudomonas aeruginosa* | 537 | 52 |
| ORF463 | 457659 | 458450 | YbbP | AB002150 | *Bacillus subtilis* | 324 | 42 |
| ORF464 | 458508 | 459632 | putative | | | | |
| ORF465 | 459839 | 461203 | HtrB protein | X61000 | *Escherichia coli* | 77 | 31 |
| ORF466 | 461624 | 461196 | unknown | U87792 | *Bacillus subtilis* | 114 | 38 |
| ORF467 | 461887 | 462621 | hypothetical protein | Z75208 | *Bacillus subtilis* | 148 | 51 |
| ORF468 | 463758 | 462895 | putative | | | | |
| ORF469 | 464048 | 464629 | putative | | | | |
| ORF470 | 464721 | 465848 | putative | | | | |
| ORF471 | 467420 | 466113 | PET112 | D90913 | *Synechocystis* sp. | 892 | 48 |
| ORF472 | 468891 | 467419 | amidase | U49269 | *Moraxella catarrhalis* | 1051 | 46 |
| ORF473 | 469280 | 468906 | putative | | | | |
| ORF474 | 469349 | 469675 | putative | | | | |
| ORF475 | 471226 | 469826 | putative | | | | |
| ORF476 | 471624 | 471106 | putative | | | | |
| ORF477 | 471954 | 473267 | putative 98 kDa outer membrane protein | U72499 | *Chlamydia psittaci* | 173 | 33 |
| ORF478 | 473252 | 473695 | POMP90A precursor | U65942 | *Chlamydia psittaci* | 175 | 39 |
| ORF479 | 473982 | 474527 | putative 98 kDa outer membrane protein | U72499 | *Chlamydia psittaci* | 193 | 38 |
| ORF480 | 475198 | 474602 | putative | | | | |
| ORF481 | 476527 | 475613 | POMP91A | U65942 | *Chlamydia psittaci* | 100 | 38 |
| ORF482 | 478640 | 476517 | putative 98 kDa outer | U72499 | *Chlamydia psittaci* | 537 | 40 |

TABLE 1-continued

| ORF | begin | stop | Homology | ID | Species | Score | I % |
|---|---|---|---|---|---|---|---|
| | | | membrane protein | | | | |
| ORF483 | 479084 | 478665 | putative 98 kDa outer membrane protein | U72499 | *Chlamydia psittaci* | 234 | 35 |
| ORF484 | 479723 | 479088 | putative outer membrane protein | U72499 | *Chlamydia psittaci* | 313 | 40 |
| ORF485 | 480012 | 479668 | putative | | | | |
| ORF486 | 481466 | 479895 | putative 98 kDa outer membrane protein | U72499 | *Chlamydia psittaci* | 391 | 38 |
| ORF487 | 481732 | 481496 | putative | | | | |
| ORF488 | 481864 | 483429 | POMP90A precursor | U65942 | *Chlamydia psittaci* | 114 | 40 |
| ORF489 | 483402 | 484964 | putative 98 kDa outer membrane protein | U72499 | *Chlamydia psittaci* | 77 | 34 |
| ORF490 | 484898 | 487864 | putative 98 kDa outer membrane protein | U72499 | *Chlamydia psittaci* | 506 | 39 |
| ORF491 | 485725 | 485222 | putative | | | | |
| ORF492 | 488204 | 489247 | putative | | | | |
| ORF493 | 488571 | 488233 | putative | | | | |
| ORF494 | 489440 | 490456 | putative | | | | |
| ORF495 | 492765 | 490507 | branching enzyme | M31544 | *Synechococcus* PCC6301 | 1624 | 57 |
| ORF496 | 492357 | 492893 | putative | | | | |
| ORF497 | 493744 | 492737 | putative | | | | |
| ORF498 | 493875 | 494675 | YqkM | D84432 | *Bacillus subtilis* | 230 | 44 |
| ORF499 | 494573 | 494869 | xprB | M54884 | *Escherichia coli* | 245 | 48 |
| ORF500 | 494835 | 495365 | putative | | | | |
| ORF501 | 495174 | 494872 | putative | | | | |
| ORF502 | 495687 | 496634 | putative | | | | |
| ORF503 | 496295 | 497176 | putative | | | | |
| ORF504 | 497703 | 498515 | putative | | | | |
| ORF505 | 498280 | 499239 | putative | | | | |
| ORF506 | 499215 | 500732 | putative | | | | |
| ORF507 | 501710 | 500790 | penicillin tolerance protein (lytB) | U32781 | *Haemophilus influenzae* | 702 | 50 |
| ORF508 | 502863 | 501808 | putative | | | | |
| ORF509 | 503675 | 502692 | putative | | | | |
| ORF510 | 505002 | 503722 | hypothetical protein | Z96072 | *Mycobacterium tuberculosis* | 102 | 42 |
| ORF511 | 505739 | 506986 | hypothetical protein in pth-prs intergenic region | AE000219 | *Escherichia coli* | 740 | 44 |
| ORF512 | 506999 | 507439 | putative | | | | |
| ORF513 | 508404 | 507649 | fumarate hydratase | AF013216 | *Myxococcus xanthus* | 611 | 54 |
| ORF514 | 508291 | 508590 | putative | | | | |
| ORF515 | 508915 | 508478 | fumarase | D64000 | *Synechocystis* sp. | 386 | 57 |
| ORF516 | 509600 | 510691 | thiamine-repressed protein (nmt1) | U32720 | *Haemophilus influenzae* | 82 | 31 |
| ORF517 | 511039 | 511527 | putative | | | | |
| ORF518 | 511547 | 512185 | hypothetical protein (SP:P46851) | U67608 | *Methanococcus jannaschii* | 208 | 39 |
| ORF519 | 512382 | 513092 | methionine amino peptidase | M15106 | *Escherichia coli* | 384 | 46 |
| ORF520 | 514287 | 513055 | putative | | | | |
| ORF521 | 514789 | 515244 | putative | | | | |
| ORF522 | 514994 | 515269 | putative | | | | |
| ORF523 | 515553 | 515804 | putative | | | | |
| ORF524 | 515808 | 516422 | putative | | | | |
| ORF525 | 516476 | 517171 | putative | | | | |
| ORF526 | 517927 | 517400 | orf150 gene product | X95938 | *Porphyromonas gingivalis* | 340 | 51 |
| ORF527 | 518096 | 518380 | 30S ribosomal protein S15 | D90901 | *Synechocystis* sp. | 245 | 52 |
| ORF528 | 518403 | 518822 | polynucleotide phosphorylase | AF010578 | *Pisum sativum* | 306 | 49 |
| ORF529 | 518923 | 519516 | polyribonucleotide phophorylase | U52048 | *Spinacia oleracea* | 387 | 47 |
| ORF530 | 519577 | 520497 | polynucleotide phosphorylase | U18997 | *Escherichia coli* | 860 | 54 |
| ORF531 | 521986 | 520718 | ATP-binding protein | U01376 | *Escherichia coli* | 970 | 49 |
| ORF532 | 522131 | 521886 | cell division protein (ftsH) | U32812 | *Haemophilus influenzae* | 314 | 76 |
| ORF533 | 523495 | 522143 | putative | | | | |
| ORF534 | 524591 | 523623 | ORF327 gene product | U38804 | *Porphyra purpurea* | 148 | 44 |
| ORF535 | 524652 | 525746 | putative | | | | |
| ORF536 | 525731 | 526078 | putative | | | | |
| ORF537 | 525939 | 526400 | putative | | | | |
| ORF538 | 526301 | 526735 | putative | | | | |
| ORF539 | 528323 | 526851 | putative | | | | |
| ORF540 | 528861 | 528292 | putative | | | | |
| ORF541 | 529723 | 529142 | phenylalanyl-tRNA synthetase alpha subunit | X53057 | *Bacillus subtilis* | 476 | 52 |
| ORF542 | 530166 | 529624 | phenylalany-tRNA synthetase beta subunit | Z75208 | *Bacillus subtilis* | 164 | 40 |
| ORF543 | 530543 | 530223 | ribosomal protein L20 (AA 1-119) | X16188 | *Bacillus stearothermophilus* | 230 | 47 |

TABLE 1-continued

| ORF | begin | stop | Homology | ID | Species | Score | I % |
|---|---|---|---|---|---|---|---|
| ORF544 | 531378 | 530737 | unknown | Z85982 | *Mycobacterium tuberculosis* | 452 | 50 |
| ORF545 | 532370 | 533272 | UDP-N-acetylenolpyruvylglucosamine reductase | U86147 | *Synechococcus* PCC7942 | 488 | 43 |
| ORF546 | 533849 | 533244 | YtqB | AF008220 | *Bacillus subtilis* | 273 | 38 |
| ORF547 | 534672 | 533944 | hypothetical protein MTCY08D5.03c | Z92669 | *Mycobacterium tuberculosis* | 170 | 35 |
| ORF548 | 535915 | 534878 | ribonucleoside diphosphate reductase, beta subunit (nrdB) | AE000553 | *Helicobacter pylori* | 397 | 33 |
| ORF549 | 539153 | 535956 | ribonucleoside-diphosphate reductase 1 alpha subunit (nrdA) | AE000581 | *Helicobacter pylori* | 1447 | 51 |
| ORF550 | 539731 | 540519 | phosphatidylserine synthase (pssA) | AE000614 | *Helicobacter pylori* | 226 | 49 |
| ORF551 | 540523 | 540969 | putative | | | | |
| ORF552 | 540906 | 541805 | hypothetical 54.7 kD protein in udp 3' region precursor (o475) | AE000459 | *Escherichia coli* | 82 | 39 |
| ORF553 | 543255 | 541825 | Ydr430cp; CAI: 0.15 | U33007 | *Saccharomyces cerevisiae* | 130 | 48 |
| ORF554 | 544133 | 543222 | putative | | | | |
| ORF555 | 544565 | 544179 | hypA gene product | X86493 | *Clostridium perfringens* | 221 | 46 |
| ORF556 | 544762 | 544487 | orf1 gene product | X70951 | *Saccharomyces cerevisiae* | 153 | 38 |
| ORF557 | 546423 | 544951 | serine protease (htrA) | AE000610 | *Helicobacter pylori* | 981 | 46 |
| ORF558 | 547480 | 546584 | succinyl coenzyme A synthetase alpha subunit | U23408 | *Dictyostelium discoideum* | 869 | 63 |
| ORF559 | 546789 | 547382 | putative | | | | |
| ORF560 | 547901 | 547476 | putative succinyl-coA synthetase beta chain | AJ000975 | *Bacillus subtilis* | 388 | 55 |
| ORF561 | 548634 | 547900 | succinate--CoA ligase (ADP-forming) | X54073 | *Thermus aquaticus* flavus | 498 | 46 |
| ORF562 | 548692 | 549459 | cell division protein (ftsY) | AE000588 | *Helicobacter pylori* | 330 | 46 |
| ORF563 | 550385 | 549663 | putative | | | | |
| ORF564 | 551611 | 550421 | Tyrosine-specific transport protein (Tyrosine permease). | D90832 | *Escherichia coli* | 508 | 40 |
| ORF565 | 553041 | 551797 | tyrosine-specific transport protein (tyrP) | U32730 | *Haemophilus influenzae* | 353 | 36 |
| ORF566 | 554946 | 553096 | L-glutamine:D-fructose-6-P amidotransferase precursor | U17352 | *Thermus aquaticus* thermophilus | 1324 | 45 |
| ORF567 | 556300 | 554927 | hypothetical | U32824 | *Haemophilus influenzae* | 1009 | 51 |
| ORF568 | 556524 | 556904 | putative | | | | |
| ORF569 | 558126 | 557314 | putative | | | | |
| ORF570 | 557810 | 558235 | putative | | | | |
| ORF571 | 559215 | 558310 | putative | | | | |
| ORF572 | 561349 | 559196 | POMP91A | U65942 | *Chlamydia psittaci* | 245 | 39 |
| ORF573 | 562931 | 561150 | putative 98 kDa outer membrane protein | U72499 | *Chlamydia psittaci* | 130 | 38 |
| ORF574 | 564083 | 563121 | putative PlsX protein | Y13937 | *Bacillus subtilis* | 519 | 45 |
| ORF575 | 563593 | 563943 | putative | | | | |
| ORF576 | 565379 | 566953 | ORF__f495; orfF of ECMRED, uses 2nd start | U18997 | *Escherichia coli* | 874 | 39 |
| ORF577 | 567079 | 567966 | glycerol-3-phosphate acyltransferase | M80571 | *Cucumis sativus* | 594 | 45 |
| ORF578 | 568021 | 570399 | insulin-degrading enzyme | M58465 | *Drosophila melanogaster* | 334 | 42 |
| ORF579 | 571269 | 572021 | putative | | | | |
| ORF580 | 572519 | 572755 | putative | | | | |
| ORF581 | 573519 | 572731 | unknown | Z94752 | *Mycobacterium tuberculosis* | 203 | 35 |
| ORF582 | 572879 | 573427 | putative | | | | |
| ORF583 | 574160 | 573660 | putative heat shock protein ORF; putative | M62820 | *Chlamydia trachomatis* | 315 | 83 |
| ORF584 | 574426 | 574184 | ribosomal protein S18 homolog; putative | M62820 | *Chlamydia trachomatis* | 384 | 99 |
| ORF585 | 574781 | 574446 | ribosomal protein S6 (rps6) | AE000630 | *Helicobacter pylori* | 176 | 39 |
| ORF586 | 575243 | 574923 | peptidyl-tRNA hydrolase | U31570 | *Chlamydia trachomatis* | 358 | 78 |
| ORF587 | 575458 | 575057 | peptidyl-tRNA hydrolase | U31570 | *Chlamydia trachomatis* | 393 | 81 |
| ORF588 | 575849 | 575469 | partial ctc gene product (AA 1-186) | X16518 | *Bacillus subtilis* | 94 | 37 |
| ORF589 | 576545 | 578023 | glycogen (starch) synthase | D90899 | *Synechocysits* sp. | 695 | 48 |
| ORF590 | 578673 | 578017 | phosphatidylglycerophosphate synthase | U87792 | *Bacillus subtilis* | 243 | 48 |
| ORF591 | 579012 | 582104 | glycyl-tRNA synthetase | U20547 | *Chlamydia trachomatis* | 5054 | 99 |
| ORF592 | 582697 | 582206 | putative | | | | |
| ORF593 | 583122 | 582811 | putative | | | | |

TABLE 1-continued

| ORF | begin | stop | Homology | ID | Species | Score | I % |
|---|---|---|---|---|---|---|---|
| ORF594 | 583514 | 583182 | putative | | | | |
| ORF595 | 583869 | 583438 | putative | | | | |
| ORF596 | 584435 | 583827 | dnaG | AB001896 | *Staphylococcus aureus* | 298 | 41 |
| ORF597 | 584967 | 584299 | DNA primase | U13165 | *Listeria monocytogenes* | 339 | 41 |
| ORF598 | 585297 | 585016 | putative | | | | |
| ORF599 | 585240 | 586610 | DNA mismatch repair protein | D90909 | *Synechocystis* sp. | 673 | 42 |
| ORF600 | 586484 | 587758 | DNA mismatch repair protein | U71154 | *Aquifex pyrophilus* | 845 | 50 |
| ORF601 | 587786 | 589408 | excinuclease ABC subunit C (uvrC) | U32691 | *Haemophilus influenzae* | 719 | 46 |
| ORF602 | 589198 | 589578 | exinuclease ABC subunit C | U29587 | *Rhodobacter sphaeroides* | 156 | 42 |
| ORP603 | 590061 | 589630 | putative | | | | |
| ORF604 | 590739 | 591272 | putative | | | | |
| ORF605 | 592406 | 592765 | homologous to *E. coli* rnpA | X62539 | *Bacillus subtilis* | 117 | 34 |
| ORF606 | 593145 | 592849 | putative | | | | |
| ORF607 | 593900 | 593121 | putative | | | | |
| ORF608 | 594138 | 595637 | cys-tRNA synthetase (cysS) | U32693 | *Haemophilus influenzae* | 991 | 49 |
| ORF609 | 596122 | 595640 | lysyl-tRNA synthetase | D90906 | *Synechocystis* sp. | 375 | 53 |
| ORF610 | 596864 | 596154 | lysine--tRNA ligase | X70708 | *Thermus aquaticus thermophilus* | 571 | 52 |
| ORF611 | 597731 | 597282 | putative | | | | |
| ORP612 | 598524 | 600809 | putative PriA protein | Y13937 | *Bacillus subtilis* | 1097 | 38 |
| ORF613 | 601876 | 600734 | L-alanine - pimelyl CoA ligase | U51868 | *Bacillus subtilis* | 242 | 42 |
| ORF614 | 603523 | 601910 | 2-acylglycerophosphoethanolamine acyltransferase/acyl carrier protein synthetase | L14681 | *Escherichia coli* | 388 | 42 |
| ORF615 | 603794 | 603531 | putative | | | | |
| ORF616 | 604413 | 603757 | putative | | | | |
| ORF617 | 604549 | 605610 | 3'(2'),5-diphosphonucleoside 3'(2') phosphohydrolase | U33283 | *Oryza sativa* | 254 | 45 |
| ORF618 | 606619 | 605582 | leucine dehydrogenase | X79068 | *Thermoactinomyces* intermedius | 638 | 49 |
| ORF619 | 606843 | 607493 | inorganic pyrophosphatase | X57545 | *Arabidopsis thaliana* | 291 | 37 |
| ORF620 | 609068 | 608031 | beta-ketoacyl-ACP synthase | L13242 | *Ricinus communis* | 1069 | 57 |
| ORF621 | 609652 | 609296 | HI0034 homolog | U82598 | *Escherichia coli* | 196 | 36 |
| ORF622 | 611860 | 610109 | putative | | | | |
| ORF623 | 611812 | 612927 | conserved hypothetical protein | AE000579 | *Helicobacter pylori* | 780 | 41 |
| ORF624 | 613597 | 612938 | trna delta(2)-isopentenylpyrophosphate transferase | Z98209 | *Mycobacterium tuberculosis* | 244 | 37 |
| ORF625 | 613952 | 613692 | delta2-isopentenylpyrophosphate tRNA transferase | Z11831 | *Escherichia coli* | 134 | 54 |
| ORF626 | 614315 | 615244 | putative | | | | |
| ORF627 | 615396 | 615683 | unknown | Z74024 | *Mycobacterium tuberculosis* | 93 | 47 |
| ORF628 | 617711 | 615864 | D-alanine:D-alanine ligase | U39788 | *Enterococcus hirae* | 555 | 38 |
| ORF629 | 618313 | 617510 | UDP-N-acetylmuramate-alanine ligase (murC) | U32794 | *Haemophilus influenzae* | 448 | 47 |
| ORF630 | 619338 | 618361 | transferase, peptidoglycan synthesis (murG) | U32793 | *Haemophilus influenzae* | 380 | 39 |
| ORF631 | 620416 | 619247 | spoVE gene product (AA 1-366) | X51419 | *Bacillus subtilis* | 538 | 37 |
| ORF632 | 619863 | 620261 | putative | | | | |
| ORF633 | 621184 | 620420 | hypothetical protein | Y14079 | *Bacillus subtilis* | 313 | 44 |
| ORF634 | 621690 | 621154 | murD gene product (AA 1-438) | X51584 | *Escherichia coli* | 221 | 43 |
| ORF635 | 622399 | 621674 | MurD | Z95388 | *Mycobacterium tuberculosis* | 228 | 41 |
| ORF636 | 623466 | 622414 | ORF-Y (AA 1-360) | X51584 | *Escherichia coli* | 543 | 45 |
| ORF637 | 624178 | 623570 | PROBABLE UDP-N-ACETYLMURAMOYLALANYL-D-GLUTAMYL-2,6-DIAMINOLIGASE (EC 6.3.2.15). | AB001488 | *Bacillus subtilis* | 103 | 43 |
| ORF638 | 624918 | 624073 | UDP-N-acetylmuramoylalanyl-D glutamyl-2, 6-diaminopimelate--D-alanyl-D-alanine ligase | X62437 | *Synechocystis* sp. | 243 | 33 |
| ORF639 | 625346 | 626665 | chaperonin 60 | U56021 | *Thermoanaerobacter brockii* | 136 | 31 |
| ORF640 | 626514 | 626900 | putative | | | | |
| ORF641 | 626954 | 627853 | putative | | | | |
| ORF642 | 627822 | 628124 | putative | | | | |
| ORF643 | 628715 | 628146 | elongation factor P | U14003 | *Escherichia coli* | 467 | 55 |
| ORF644 | 628932 | 629801 | AMP nucleosidase (EC 3.2.2.4). | D90837 | *Escherichia coli* | 278 | 47 |

TABLE 1-continued

| ORF | begin | stop | Homology | ID | Species | Score | I % |
|---|---|---|---|---|---|---|---|
| ORF645 | 630406 | 629804 | transketolase | Z73234 | *Bacillus subtilis* | 361 | 46 |
| ORF646 | 630960 | 630298 | transketolase | Z73234 | *Bacillus subtilis* | 460 | 47 |
| ORF647 | 631799 | 630915 | transketolase 1 (TK 1) (tktA) | U32783 | *Haemophilus influenzae* | 756 | 47 |
| ORF648 | 637488 | 638084 | alanyl-tRNA synthetase | X59956 | *Rhizobium leguminosarum* | 436 | 56 |
| ORF649 | 638036 | 640207 | alanyl-tRNA synthetase | X95571 | *Thiobacillus ferrooxidans* | 1121 | 39 |
| ORF650 | 640221 | 643472 | transcription-repair coupling factor (trcF) (mfd) | U32805 | *Haemophilus influenzae* | 1426 | 46 |
| ORF651 | 640627 | 640220 | putative | | | | |
| ORF652 | 643485 | 644495 | uroporphyrinogen decarboxylase | M97208 | *Bacillus subtilis* | 416 | 40 |
| ORF653 | 644471 | 645430 | putative oxygen-independent coproporphyrinogen III oxidase | U06779 | *Salmonella typhimurium* | 638 | 43 |
| ORF654 | 645394 | 645840 | oxygen independent coprophorphyrinogen III oxidase | D90912 | *Synechocystis* sp. | 283 | 42 |
| ORF655 | 645840 | 647111 | hemY | M97208 | *Bacillus subtilis* | 133 | 38 |
| ORF656 | 649676 | 647109 | phosphoprotein | L25078 | *Chlamydia trachomatis* | 2043 | 99 |
| ORF657 | 649970 | 650344 | Hc1 | M60902 | *Chlamydia trachomatis* | 603 | 100 |
| ORF658 | 650418 | 651722 | pCTHom1 gene product | M94254 | *Chlamydia trachomatis* | 1735 | 100 |
| ORF659 | 651686 | 652171 | putative | | | | |
| ORF660 | 652516 | 652908 | phenolhydroxylase component | U32702 | *Haemophilus influenzae* | 263 | 41 |
| ORF661 | 652799 | 653593 | phenolhydroxylase component | U32702 | *Haemophilus influenzae* | 456 | 51 |
| ORF662 | 659884 | 661851 | YtpT | AF008220 | *Bacillus subtilis* | 709 | 52 |
| ORF663 | 661740 | 662282 | spoIIIEB protein | M17445 | *Bacillus subtilis* | 330 | 43 |
| ORF664 | 662286 | 663074 | yycJ | D78193 | *Bacillus subtilis* | 405 | 38 |
| ORF665 | 662951 | 663730 | C41G7.4 | Z81048 | *Caenorhabditis elegans* | 200 | 36 |
| ORF666 | 664212 | 663745 | hypothetical protein MTCY180.08 | Z97193 | *Mycobacterium tuberculosis* | 194 | 38 |
| ORF667 | 665619 | 664255 | D-alanine glycine permease (dagA) | AE000603 | *Helicobacter pylori* | 205 | 34 |
| ORF668 | 666083 | 665727 | putative | | | | |
| ORF669 | 666423 | 665782 | putative | | | | |
| ORF670 | 666831 | 668117 | putative | | | | |
| ORF671 | 668121 | 668375 | putative | | | | |
| ORF672 | 668470 | 668174 | riboflavin synthase beta chain (ribE) | U32810 | *Haemophilus influenzae* | 192 | 40 |
| ORF673 | 669533 | 668616 | GTP cyclohydrolase II/3,4-dihydroxy-2-butanone-4-phoshate synthase | AJ000053 | *Arabidopsis thaliana* | 800 | 51 |
| ORF674 | 669892 | 669485 | unnamed protein product | A38767 | *Saccharomyces cerevisiae* | 288 | 49 |
| ORF675 | 670780 | 669998 | ribG gene product | L09228 | *Bacillus subtilis* | 191 | 42 |
| ORF676 | 671241 | 670732 | riboflavin-specific deaminase | U27202 | *Actinobacillus pleuropneumoniae* | 314 | 51 |
| ORF677 | 671182 | 672447 | seryl-tRNA synthetase | X91007 | *Haloarcula marismortui* | 736 | 49 |
| ORF678 | 672692 | 673231 | putative | | | | |
| ORF679 | 673204 | 674562 | ATPase | L28104 | Transposon Tn5422 | 565 | 41 |
| ORF680 | 674612 | 675232 | unknown | Z74025 | *Mycobacterium tuberculosis* | 340 | 43 |
| ORF681 | 675327 | 676463 | rod-shape-determining protein | M22857 | *Escherichia coli* | 442 | 37 |
| ORF682 | 677027 | 676476 | biotin [acetyl-CoA carboxylase] ligase | L02354 | *Paracoccus denitrificans* | 169 | 49 |
| ORF683 | 678422 | 677700 | ORFX13 | L09228 | *Bacillus subtilis* | 426 | 43 |
| ORF684 | 678717 | 679508 | 2,3-bisphosphoglycerate | M23068 | *Homo sapiens* | 494 | 47 |
| ORF685 | 679342 | 680502 | synthesis of [Fe—S] cluster (nifS) | AE000542 | *Helicobacter pylori* | 150 | 33 |
| ORF686 | 680579 | 681280 | NifU | AF001780 | Cyanothece PCC 8801 | 101 | 31 |
| ORF687 | 681539 | 682558 | putative | | | | |
| ORF688 | 682554 | 683087 | putative | | | | |
| ORF689 | 683164 | 684465 | ORF 4 | M72718 | *Bacillus subtilis* | 708 | 36 |
| ORF690 | 684774 | 684418 | putative | | | | |
| ORF691 | 684839 | 686203 | AgX-1 antigen [human, infertile patient, testis, Peptide, 505 aa] | S73498 | *Homo sapiens* | 338 | 37 |
| ORF692 | 686197 | 687204 | L-glycerol 3-phosphate dehydrogenase | U00039 | *Escherichia coli* | 577 | 38 |
| ORF693 | 687341 | 688360 | putative | | | | |
| ORF694 | 688432 | 688193 | putative | | | | |
| ORF695 | 689616 | 688432 | putative | | | | |
| ORF696 | 689960 | 689631 | putative | | | | |
| ORF697 | 690487 | 689846 | putative | | | | |
| ORF698 | 690717 | 690463 | putative | | | | |

TABLE 1-continued

| ORF | begin | stop | Homology | ID | Species | Score | I % |
|---|---|---|---|---|---|---|---|
| ORF699 | 691871 | 690672 | putative | | | | |
| ORF700 | 693837 | 692041 | phosphoenolpyruvate carboxykinase | M59372 | *Neocallimastix frontalis* | 1818 | 59 |
| ORF701 | 694934 | 693837 | MreB protein | M96343 | *Bacillus subtilis* | 961 | 56 |
| ORF702 | 697263 | 694942 | SNP | X98455 | *Bacillus cereus* | 1073 | 50 |
| ORF703 | 698084 | 697170 | putative | | | | |
| ORF704 | 698392 | 697979 | putative | | | | |
| ORF705 | 698792 | 700117 | trigger factor (tig) | AE000591 | *Helicobacter pylori* | 84 | 34 |
| ORF706 | 700269 | 700895 | proteosome major subunit | AF013216 | Myxococcus xanthus | 615 | 59 |
| ORF707 | 700912 | 702165 | ATP-dependent protease ATPase subunit | L18867 | *Escherichia coli* | 1183 | 55 |
| ORF708 | 702183 | 703412 | poly(A) polymerase | L47709 | *Bacillus subtilis* | 362 | 38 |
| ORF709 | 703522 | 705000 | hypothetical protein | D90912 | *Synechocystis* sp. | 809 | 41 |
| ORF710 | 705011 | 705604 | putative | | | | |
| ORF711 | 706159 | 705704 | Preprotein translocase subunit | AF022186 | *Cyanidium caldarium* | 165 | 44 |
| ORF712 | 706521 | 706138 | secA | X99401 | *Bacillus firmus* | 155 | 42 |
| ORF713 | 708103 | 706496 | SecA | U66081 | *Mycobacterium smegmatis* | 1044 | 58 |
| ORF714 | 708398 | 708078 | cp-SecA; chloroplast SecA homolog | U71123 | *Zea mays* | 258 | 69 |
| ORF715 | 708610 | 708248 | SecA | U21192 | *Streptomyces lividans* | 179 | 42 |
| ORF716 | 710278 | 708872 | putative | | | | |
| ORF717 | 711164 | 710262 | phosphatidylserine decarboxylase | U72715 | *Chlamydia trachomatis* | 1548 | 99 |
| ORF718 | 711432 | 712763 | homologous to *E. coli* 50K | X62539 | *Bacillus subtilis* | 713 | 54 |
| ORF719 | 712767 | 713438 | ultraviolet N-glycosylase/AP lyase | U22181 | *Micrococcus luteus* | 273 | 45 |
| ORF720 | 714232 | 713651 | putative | | | | |
| ORF721 | 714632 | 714120 | putative | | | | |
| ORF722 | 715592 | 714834 | putative | | | | |
| ORF723 | 715854 | 715558 | putative | | | | |
| ORP724 | 716937 | 715921 | putative | | | | |
| ORF725 | 718357 | 717149 | 3-phosphoglycerate kinase | U83197 | *Chlamydia trachomatis* | 2049 | 100 |
| ORF726 | 718500 | 718862 | putative | | | | |
| ORF727 | 719797 | 718499 | phosphate permease (YBR296C) | U32834 | *Haemophilus influenzae* | 997 | 42 |
| ORF728 | 720273 | 719782 | putative | | | | |
| ORF729 | 720452 | 720144 | *H. influenzae* predicted coding region HI1603 | U32834 | *Haemophilus influenzae* | 164 | 37 |
| ORF730 | 720613 | 721575 | dciAD | X56678 | *Bacillus subtilis* | 722 | 41 |
| ORF731 | 721559 | 722356 | was dppE | U00039 | *Escherichia coli* | 477 | 44 |
| ORF732 | 723248 | 722397 | chromosome partitioning protein ParB | U87804 | *Caulobacter crescentus* | 388 | 50 |
| ORF733 | 724598 | 723378 | NifS protein. | D90811 | *Escherichia coli* | 805 | 39 |
| ORF734 | 725763 | 724576 | hypothetical protein | D64004 | *Synechocystis* sp. | 154 | 41 |
| ORF735 | 726519 | 725767 | Multidrug resistance protein 1 (P-glycoprotein 1). | D90811 | *Escherichia coli* | 607 | 54 |
| ORF736 | 726819 | 726538 | ABC transporter subunit | D64004 | *Synechocystis* sp. | 266 | 58 |
| ORF737 | 727493 | 726753 | ABC transporter subunit | D64004 | *Synechocystis* sp. | 854 | 71 |
| ORF738 | 727984 | 727469 | ABC transporter subunit | D64004 | *Synechocystis* sp. | 531 | 55 |
| ORF739 | 728778 | 728329 | putative | | | | |
| ORF740 | 729346 | 728759 | antiviral protein | L36940 | *Saccharomyces cerevisiae* | 115 | 33 |
| ORF741 | 732639 | 729442 | penicillin-binding protein 2 (pbp2) | U32688 | *Haemophilus influenzae* | 208 | 43 |
| ORF742 | 733246 | 734427 | major outer membrane protein precursor | M14738 | *Chlamydia trachomatis* | 2045 | 99 |
| ORF743 | 734814 | 735659 | ribosomal protein S2 | U60196 | *Chlamydia trachomatis* | 1269 | 76 |
| ORF744 | 735644 | 736504 | elongation factor Ts | U60196 | *Chlamydia trachomatis* | 1278 | 90 |
| ORF745 | 736520 | 737254 | UMP kinase | U60196 | *Chlamydia trachomatis* | 1153 | 94 |
| ORF746 | 737254 | 737787 | ribosome-releasing factor | U60196 | *Chlamydia trachomatis* | 760 | 92 |
| ORF747 | 737942 | 738679 | putative | | | | |
| ORF748 | 738838 | 739740 | ORF3; putative 39 kDa protein | U40604 | *Listeria monocytogenes* | 116 | 31 |
| ORF749 | 742057 | 740060 | XcpQ | X68594 | *Pseudomonas aeruginosa* | 453 | 37 |
| ORF750 | 742869 | 742045 | putative | | | | |
| ORF751 | 743378 | 742824 | putative | | | | |
| ORF752 | 744298 | 743306 | unknown | Z80233 | *Mycobacterium tuberculosis* | 137 | 40 |
| ORF753 | 744714 | 744430 | putative | M69228 | *Caulobacter crescentus* | 117 | 38 |
| ORF754 | 744985 | 744611 | putative | | | | |
| ORF755 | 745557 | 744958 | putative | | | | |
| ORF756 | 746412 | 745561 | putative | | | | |
| ORF757 | 746772 | 746416 | putative | | | | |
| ORF758 | 748269 | 746944 | PscN | AF010151 | *Pseudomonas aeruginosa* | 1220 | 55 |
| ORF759 | 748966 | 748274 | putative | | | | |
| ORF760 | 749426 | 748965 | putative | | | | |

TABLE 1-continued

| ORF | begin | stop | Homology | ID | Species | Score | I % |
|---|---|---|---|---|---|---|---|
| ORF761 | 749702 | 749433 | putative | | | | |
| ORF762 | 750029 | 749721 | putative | | | | |
| ORF763 | 752307 | 750007 | putative | | | | |
| ORF764 | 752913 | 752503 | putative | | | | |
| ORF765 | 754659 | 753616 | NAD(P)H:glutamyl-transfer RNA reductase | M57676 | *Bacillus subtilis* | 172 | 40 |
| ORF766 | 755000 | 756814 | DNA gyrase subunit B | U35453 | *Clostridium acetobutylicum* | 970 | 38 |
| ORF767 | 756796 | 758301 | gyrA | X92503 | *Mycobacterium smegmatis* | 409 | 49 |
| ORF768 | 758691 | 758446 | unknown | Z74024 | *Mycobacterium tuberculosis* | 107 | 34 |
| ORF769 | 759787 | 759338 | SfhB | U50134 | *Escherichia coli* | 241 | 48 |
| ORF770 | 760242 | 759871 | putative | | | | |
| ORF771 | 760538 | 760188 | putative | | | | |
| ORF772 | 760966 | 761772 | 3-deoxy-D-manno-octulosonate 8-phosphate synthetase | U72493 | *Chlamydia trachomatis* | 1350 | 99 |
| ORF773 | 761759 | 762142 | unknown | U72493 | *Chlamydia trachomatis* | 536 | 94 |
| ORF774 | 762267 | 762983 | ATP binding protein | U72493 | *Chlamydia trachomatis* | 1197 | 99 |
| ORF775 | 764465 | 763335 | chlanectin coding region | M17875 | *Chlamydia trachomatis* | 239 | 100 |
| ORF776 | 764857 | 764438 | putative | | | | |
| ORF777 | 766068 | 764821 | unknown function | Z32530 | *Chlamydia trachomatis* | 1803 | 99 |
| ORF778 | 766643 | 766065 | unknown function | Z32530 | *Chlamydia trachomatis* | 704 | 100 |
| ORF779 | 768091 | 766934 | RecA | U16739 | *Chlamydia trachomatis* | 1753 | 100 |
| ORF780 | 768785 | 768252 | unknown function | Z32530 | *Chlamydia trachomatis* | 904 | 99 |
| ORF781 | 770092 | 768791 | unknown function | Z32530 | *Chlamydia trachomatis* | 2249 | 100 |
| ORF782 | 770138 | 770470 | putative | | | | |
| ORF783 | 770661 | 770185 | putative | | | | |
| ORF784 | 770924 | 770634 | putative | | | | |
| ORF785 | 772010 | 771330 | putative | | | | |
| ORF786 | 772390 | 773391 | unknown | D26185 | *Bacillus subtilis* | 486 | 35 |
| ORF787 | 774221 | 773427 | ORF__f169 | U18997 | *Escherichia coli* | 263 | 51 |
| ORF788 | 776035 | 774191 | DNA topoisomerase I | L27797 | *Bacillus subtilis* | 1357 | 52 |
| ORF789 | 776663 | 777706 | putative | | | | |
| ORF790 | 777195 | 776953 | putative | | | | |
| ORF791 | 779222 | 777732 | ORF__f397 | U29581 | *Escherichia coli* | 93 | 40 |
| ORF792 | 779321 | 781552 | putative | | | | |
| ORF793 | 781297 | 782442 | putative | | | | |
| ORF794 | 782447 | 785524 | exonuclease V (AA 1-1180) | X04581 | *Escherichia coli* | 557 | 49 |
| ORF795 | 785532 | 786002 | putative | | | | |
| ORF796 | 786580 | 785546 | MreC protein | M31792 | *Escherichia coli* | 81 | 64 |
| ORF797 | 787741 | 786611 | aspartate aminotransferase precursor | M12105 | *Gallus gallus* | 700 | 42 |
| ORF798 | 787620 | 788021 | putative | | | | |
| ORF799 | 790124 | 787920 | GreA | U02878 | Rickettsia prowazekii | 84 | 33 |
| ORF800 | 790160 | 790609 | putative | | | | |
| ORF801 | 790634 | 792016 | NADH:ubiquinone oxidoreductase subunit A | Z37111 | *Vibrio alginolyticus* | 409 | 37 |
| ORF802 | 793084 | 792059 | delta__aminolevulinic acid dehydratase | L24386 | *Bradyrhizobium japonicum* | 867 | 52 |
| ORF803 | 793343 | 794056 | putative | | | | |
| ORF804 | 794046 | 794957 | putative | | | | |
| ORF805 | 795401 | 795144 | putative | | | | |
| ORF806 | 795575 | 796255 | ompR gene product | X92405 | *Neisseria meningitidis* | 103 | 32 |
| ORF807 | 796278 | 797015 | glucose-1-phosphate thymidylyltransferase | U67553 | *Methanococcus jannaschii* | 216 | 36 |
| ORF808 | 796979 | 797365 | YqiD | D84432 | *Bacillus subtilis* | 184 | 58 |
| ORF809 | 797260 | 797856 | farnesyl diphosphate synthase | D13293 | *Bacillus stearothermophilus* | 107 | 37 |
| ORF810 | 797772 | 798086 | putative | | | | |
| ORF811 | 798426 | 797935 | Orf39.9 | X61000 | *Escherichia coli* | 290 | 51 |
| ORF812 | 798925 | 798416 | This ORF is homologous to a 40.0 kd hypothetical protein in the htrB 3' region from *E. coli*, Accession Number X61000 | L22217 | Mycoplasma-like organism | 150 | 46 |
| ORF813 | 799301 | 799927 | ribosomal protein 54 (rps4) | AE000633 | *Helicobacter pylori* | 407 | 46 |
| ORF814 | 800892 | 800029 | apurinic/apyrimidinic endonuclease | U40707 | *Caenorhabditis elegans* | 397 | 35 |
| ORF815 | 801062 | 802129 | mviB homolog | U50732 | *Chlamydia trachomatis* | 1716 | 97 |
| ORF816 | 802023 | 802673 | mviB homolog | U50732 | *Chlamydia trachomatis* | 973 | 97 |
| ORF817 | 802851 | 803246 | lorf2; possible membrane-bound protein | U50732 | *Chlamydia trachomatis* | 280 | 100 |
| ORF818 | 803105 | 804220 | 76 kDa protein | L23921 | *Chlamydia pneumoniae* | 775 | 59 |
| ORF819 | 804307 | 805356 | putative | | | | |
| ORF820 | 805290 | 806282 | 76 kDa protein | L23921 | *Chlamydia pneumoniae* | 125 | 50 |
| ORF821 | 806453 | 808081 | putative | | | | |
| ORF822 | 808026 | 809009 | putative | | | | |

TABLE 1-continued

| ORF | begin | stop | Homology | ID | Species | Score | I % |
|---|---|---|---|---|---|---|---|
| ORF823 | 810461 | 809079 | putative | | | | |
| ORF824 | 811605 | 810328 | putative | | | | |
| ORF825 | 811725 | 812342 | putative | | | | |
| ORF826 | 812329 | 813522 | putative | | | | |
| ORF827 | 813455 | 813772 | putative | | | | |
| ORF828 | 813732 | 814334 | putative | | | | |
| ORF829 | 815213 | 814314 | putative | | | | |
| ORF830 | 814878 | 814396 | putative | | | | |
| ORF831 | 815733 | 815428 | 30S ribosomal protein S20 | Z67753 | *Odontella sinensis* | 150 | 38 |
| ORF832 | 816116 | 817456 | KIAA0336 | AB002334 | *Homo sapiens* | 90 | 32 |
| ORF833 | 817608 | 819320 | RNA polymerase sigma-subunit | J05546 | *Chlamydia trachomatis* | 2868 | 100 |
| ORF834 | 819324 | 819713 | putative | | | | |
| ORF835 | 819704 | 820402 | dihydropterin pyrophosphokinase/ dihydropteroate synthase | Y08611 | *Pisum sativum* | 310 | 45 |
| ORF836 | 820375 | 821061 | dihydropteroate synthase | X68068 | *Neisseria meningitidis* | 100 | 48 |
| ORF837 | 821043 | 821537 | dihydrofolate reductase | Z84379 | *Streptococcus* pneumoniae | 168 | 45 |
| ORF838 | 821646 | 822239 | *M. jannaschii* predicted coding region MJ0768 | U67522 | *Methanococcus jannaschii* | 139 | 41 |
| ORF839 | 822182 | 822931 | putative | | | | |
| ORF840 | 824355 | 823045 | nitrogen metabolism regulator | M58480 | *Thiobacillus* ferrooxidans | 133 | 58 |
| ORF841 | 825894 | 824359 | helicase | M63176 | *Staphylococcus aureus* | 893 | 50 |
| ORF842 | 826322 | 825879 | helicase | M63176 | *Staphylococcus aureus* | 282 | 47 |
| ORF843 | 826340 | 827026 | ipa-57d gene product | X73124 | *Bacillus subtilis* | 602 | 52 |
| ORF844 | 827014 | 827250 | putative | | | | |
| ORF845 | 827856 | 827230 | hypothetical | U32712 | *Haemophilus influenzae* | 302 | 45 |
| ORF846 | 828007 | 829275 | 19/20 residue stretch (32–51) identical to N-terminal putative signal sequence of unknown, partly cloned *B. subtilis* gene.; putative | L19954 | *Bacillus subtilis* | 442 | 37 |
| ORF847 | 829355 | 830953 | heat shock protein GroEL | U55047 | *Bradyrhizobium japonicum* | 418 | 36 |
| ORF848 | 831119 | 831748 | basl protein | Z34917 | *Hordeum vulgare* | 516 | 47 |
| ORF849 | 832152 | 831751 | putative | | | | |
| ORF850 | 832744 | 832214 | putative | | | | |
| ORF851 | 833446 | 832805 | putative | | | | |
| ORF852 | 833802 | 833368 | putative | | | | |
| ORF853 | 834679 | 833879 | putative | | | | |
| ORF854 | 835452 | 834661 | putative | | | | |
| ORF855 | 835778 | 835371 | putative | | | | |
| ORF856 | 836482 | 835775 | putative | | | | |
| ORF857 | 836602 | 837264 | putative | | | | |
| ORF858 | 837209 | 838699 | putative | | | | |
| ORF859 | 838760 | 839575 | putative | | | | |
| ORF860 | 839942 | 840583 | putative | | | | |
| ORF861 | 840445 | 841713 | putative | | | | |
| ORF862 | 841659 | 842459 | putative | | | | |
| ORF863 | 842523 | 843068 | putative | | | | |
| ORF864 | 843495 | 843031 | putative | | | | |
| ORF865 | 843239 | 846196 | putative | | | | |
| ORF866 | 844137 | 843802 | putative | | | | |
| ORF867 | 848043 | 846217 | putative | | | | |
| ORF868 | 850123 | 848150 | putative | | | | |
| ORF869 | 851645 | 850230 | putative | | | | |
| ORF870 | 853696 | 851669 | putative | | | | |
| ORF871 | 854836 | 853700 | putative | | | | |
| ORF872 | 855525 | 854920 | putative | | | | |
| ORF873 | 856240 | 855437 | putative | | | | |
| ORF874 | 857183 | 856233 | putative | | | | |
| ORF875 | 859439 | 857451 | putative | | | | |
| ORF876 | 859946 | 859587 | putative | | | | |
| ORF877 | 859642 | 860640 | putative | | | | |
| ORF878 | 861599 | 860724 | putative | | | | |
| ORF879 | 862053 | 861580 | putative | | | | |
| ORF880 | 863540 | 862098 | putative | | | | |
| ORF881 | 863930 | 863571 | putative | | | | |
| ORF882 | 864697 | 863996 | putative | | | | |
| ORF883 | 864923 | 866248 | DNA mismatch repair protein (mutL) | U32692 | *Haemophilus influenzae* | 506 | 47 |
| ORF884 | 866303 | 866605 | putative | | | | |
| ORF885 | 866665 | 867732 | YqhT | D84432 | *Bacillus subtilis* | 444 | 39 |
| ORF886 | 867810 | 869090 | putative | | | | |
| ORF887 | 869094 | 869357 | putative | | | | |
| ORF888 | 869270 | 871372 | fimbrial assembly protein | L13865 | *Pseudomonas aeruginosa* | 181 | 40 |

TABLE 1-continued

| ORF | begin | stop | Homology | ID | Species | Score | I % |
|---|---|---|---|---|---|---|---|
| ORF889 | 871299 | 872582 | xpsE gene product | X59079 | *Xanthomonas campestris* | 825 | 56 |
| ORF890 | 872429 | 872860 | secretion protein XcpR | Y09102 | *Acinetobacter calcoaceticus* | 213 | 48 |
| ORF891 | 872773 | 873915 | ORF_o398 | U18997 | *Escherichia coli* | 271 | 33 |
| ORF892 | 873812 | 873360 | putative | | | | |
| ORF893 | 874028 | 874438 | putative | | | | |
| ORF894 | 874778 | 875386 | putative | | | | |
| ORF895 | 875774 | 876382 | putative | | | | |
| ORF896 | 877872 | 877000 | secretion system apparatus, SsaT | X99944 | *Salmonella typhimurium* | 174 | 34 |
| ORF897 | 878172 | 877876 | yscS | L25667 | *Yersinia pseudotuberculosis* | 172 | 44 |
| ORF898 | 879098 | 878172 | pathogenicity protein | M64094 | *Xanthomonas campestris* | 464 | 46 |
| ORF899 | 878883 | 879161 | putative | | | | |
| ORF900 | 879842 | 879105 | PscL | U56077 | *Pseudomonas aeruginosa* | 141 | 34 |
| ORF901 | 880885 | 880052 | putative | | | | |
| ORF902 | 881863 | 880889 | HrcJ | U56662 | *Erwinia amylovora* | 236 | 43 |
| ORF903 | 882904 | 881948 | ORF YOR196c | Z75104 | *Saccharomyces cerevisiae* | 685 | 44 |
| ORF904 | 883794 | 882901 | dihydrolipoamide dehydrogenase | L31844 | *Clostridium magnum* | 578 | 38 |
| ORF905 | 884296 | 883661 | YqiV | D84432 | *Bacillus subtilis* | 437 | 44 |
| ORF906 | 884996 | 884508 | putative | | | | |
| ORF907 | 888777 | 885166 | helicase of the snf2/rad54 family | D90916 | *Synechocystis* sp. | 824 | 43 |
| ORF908 | 890172 | 888940 | sodium-coupled branched-chain amino acid carrier | D49784 | *Clostridium perfringens* | 230 | 35 |
| ORF909 | 891164 | 890325 | putative Fmu protein | Y13937 | *Bacillus subtilis* | 220 | 41 |
| ORF910 | 891463 | 891116 | putative | | | | |
| ORF911 | 893278 | 891968 | DD-carboxypeptidase | M85047 | *Bacillus subtilis* | 302 | 39 |
| ORF912 | 893356 | 893808 | putative | | | | |
| ORF913 | 893909 | 893643 | putative | | | | |
| ORF914 | 894276 | 893821 | hypothetical protein | D90908 | *Synechocystis* sp. | 155 | 39 |
| ORF915 | 894778 | 894248 | putative | | | | |
| ORF916 | 895892 | 895050 | putative | | | | |
| ORF917 | 895951 | 896829 | putative | | | | |
| ORF918 | 900783 | 897064 | DNA polymerase III alpha-subunit (dnaE) | AE000646 | *Helicobacter pylori* | 1974 | 43 |
| ORF919 | 902032 | 900791 | UhpC protein | M17102 | *Escherichia coli* | 1117 | 52 |
| ORF920 | 902659 | 903876 | histidine--tRNA ligase | Z17214 | *Streptococcus equisimilis* | 686 | 47 |
| ORF921 | 903731 | 903471 | putative | | | | |
| ORF922 | 903860 | 905605 | aspartyl-tRNA synthetase | D90910 | *Synechocystis* sp. | 1339 | 51 |
| ORF923 | 905725 | 906474 | mip-like protein | X66126 | *Chlamydia trachomatis* | 1196 | 98 |
| ORF924 | 906493 | 906945 | spoU | L40369 | *Chlamydia trachomatis* | 607 | 100 |
| ORF925 | 907306 | 907001 | trxA | L39892 | *Chlamydia psittaci* | 380 | 76 |
| ORF926 | 908101 | 908742 | putative | | | | |
| ORF927 | 908721 | 909194 | hypothetical protein | D90914 | *Synechocystis* sp. | 150 | 37 |
| ORF928 | 909198 | 909584 | DNA polymerase III | Z48003 | *Staphylococcus aureus* | 181 | 40 |
| ORF929 | 909583 | 909951 | putative | | | | |
| ORF930 | 910081 | 910569 | VdlD | U94318 | *Helicobacter pylori* | 197 | 43 |
| ORF931 | 910615 | 910944 | putative | | | | |
| ORF932 | 910948 | 912261 | acid-inducible gene | L13845 | *Sinorhizobium meliloti* | 145 | 50 |
| ORF933 | 912399 | 912629 | putative | | | | |
| ORF934 | 912595 | 913218 | UDP-3-O-acyl-GlcNAc deacetylase | U67855 | *Pseudomonas aeruginosa* | 309 | 39 |
| ORF935 | 913203 | 913676 | (3R)-hydroxymyristol acyl carrier protein dehydrase | D90910 | *Synechocystis* sp. | 302 | 59 |
| ORF936 | 913691 | 914485 | UDP-N-acetylglucosamine acyltransferase | L22690 | *Rickettsia rickettsii* | 503 | 38 |
| ORF937 | 914516 | 915136 | methionyl-tRNA formyl transferase | X63666 | *Escherichia coli* | 407 | 42 |
| ORF938 | 915144 | 915467 | putative | | | | |
| ORF939 | 915629 | 916633 | putative | | | | |
| ORF940 | 916051 | 916539 | putative | | | | |
| ORF941 | 916965 | 917627 | ribosomal protein L3 (rpL3) | U32761 | *Haemophilus influenzae* | 470 | 48 |
| ORF942 | 917612 | 918304 | 50S ribosomal protein L4 | AB000111 | *Synechococcus* sp. | 210 | 43 |
| ORF943 | 918323 | 918655 | ribosomal protein L23 | Z21677 | *Thermotoga maritima* | 116 | 47 |
| ORF944 | 918682 | 919533 | rpl2 | M74770 | Mycoplasma-like organism | 800 | 48 |
| ORF945 | 919542 | 919829 | *Mycoplasma pneumoniae*, ribosomal protein S19; similar to GenBank Accession Number S36895, from *M. bovis* | AE000061 | *Mycoplasma pneumoniae* | 315 | 68 |
| ORF946 | 919723 | 920157 | ribosomal protein L22 | Z21677 | *Thermotoga maritima* | 240 | 49 |
| ORF947 | 920184 | 920840 | ribosomal protein S3 (rpS3) | U32761 | *Haemophilus influenzae* | 605 | 57 |
| ORF948 | 920866 | 921294 | ribosomal protein L16 | Z21677 | *Thermotoga maritima* | 434 | 62 |

TABLE 1-continued

| ORF | begin | stop | Homology | ID | Species | Score | I % |
|---|---|---|---|---|---|---|---|
| ORF949 | 921272 | 921514 | ribosomal protein CtrL29e | M80325 | *Chlamydia trachomatis* | 343 | 99 |
| ORF950 | 921510 | 921758 | ribosomal protein S17e | M80325 | *Chlamydia trachomatis* | 419 | 100 |
| ORF951 | 921778 | 922143 | ribosomal protein CtrL14e | M80325 | *Chlamydia trachomatis* | 618 | 100 |
| ORF952 | 922159 | 922491 | ribosomal protein CtrL24e | M80325 | *Chlamydia trachomatis* | 568 | 100 |
| ORF953 | 922496 | 923035 | ribosomal protein CtrL5e | M80325 | *Chlamydia trachomatis* | 793 | 99 |
| ORF954 | 923160 | 923453 | ribosomal protein CtrS8e | M80325 | *Chlamydia trachomatis* | 487 | 98 |
| ORF955 | 923484 | 924032 | ribosomal protein L6 | M60652 | *Chlamydia trachomatis* | 927 | 100 |
| ORF956 | 924048 | 924425 | ribosomal protein CtrL18e | M80325 | *Chlamydia trachomatis* | 605 | 99 |
| ORF957 | 924443 | 924937 | ribosomal protein CtrS5e | M80325 | *Chlamydia trachomatis* | 814 | 99 |
| ORF958 | 924933 | 925364 | ribosomal protein CtrL15e | M80325 | *Chlamydia trachomatis* | 740 | 99 |
| ORF959 | 925390 | 926760 | homolog | L25077 | *Chlamydia trachomatis* | 2254 | 99 |
| ORF960 | 926819 | 927184 | ribosomal protein S13 | L33834 | *Chlamydia trachomatis* | 604 | 100 |
| ORF961 | 927209 | 927604 | ribosomal protein S11 | L33834 | *Chlamydia trachomatis* | 646 | 98 |
| ORF962 | 927577 | 928155 | RNA polymerase alpha-subunit | L33834 | *Chlamydia trachomatis* | 847 | 97 |
| ORF963 | 928100 | 928759 | RNA polymerase alpha-subunit | L33834 | *Chlamydia trachomatis* | 1040 | 98 |
| ORF964 | 929222 | 930244 | glyceraldehyde-3-phosphate dehydrogenase | U83198 | *Chlamydia trachomatis* | 1735 | 99 |
| ORF965 | 930222 | 930656 | putative | | | | |
| ORF966 | 930608 | 931078 | putative | | | | |
| ORF967 | 931367 | 931666 | putative | | | | |
| ORF968 | 931549 | 931959 | putative | | | | |
| ORF969 | 932070 | 932579 | crossover junction endodeoxyribonuclease (ruvC) | U32717 | *Haemophilus influenzae* | 250 | 41 |
| ORF970 | 932602 | 933201 | Holliday junction DNA helicase (ruvA) | U32716 | *Haemophilus influenzae* | 258 | 38 |
| ORF971 | 933319 | 933621 | nucleoside diphosphate kinase (ndk) | AE000540 | *Helicobacter pylori* | 264 | 60 |
| ORF972 | 933522 | 933785 | nucleoside 5'-diphosphate phosphotransferase (EC 2.7.4.6) | J05207 | *Myxococcus xanthus* | 186 | 64 |
| ORF973 | 934546 | 933848 | hypothetical protein (GB:U14003_297) | U39706 | *Mycoplasma genitalium* | 156 | 36 |
| ORF974 | 936377 | 934539 | homologous to *E. coli* gidA | X62540 | *Pseudomonas putida* | 1562 | 51 |
| ORF975 | 938081 | 936666 | replicative DNA helicase | D26185 | *Bacillus subtilis* | 848 | 41 |
| ORF976 | 938538 | 939098 | phosphatidylglycerophosphate synthase (pgsA) | AE000610 | *Helicobacter pylori* | 120 | 33 |
| ORF977 | 939329 | 940933 | adenine nucleotide translocase | Z49227 | *Arabidopsis thaliana* | 668 | 40 |
| ORF978 | 941031 | 942068 | putative protease | AF008220 | *Bacillus subtilis* | 265 | 36 |
| ORF979 | 942082 | 944685 | DNA polymerase | D12982 | *Bacillus caldotenax* | 1334 | 42 |
| ORF980 | 944634 | 945287 | T05G5.5 | Z27079 | *Caenorhabditis elegans* | 198 | 32 |
| ORF981 | 945287 | 946294 | 'The first ATG in the open reading frame was chosen as the initiation codon.' | L27278 | *Pseudomonas fluorescens* | 882 | 68 |
| ORF982 | 946293 | 946676 | 'The first GTG in the open reading frame was chosen as the initiation codon.' | L27276 | *Deinococcus radiodurans* | 417 | 65 |
| ORF983 | 947105 | 948454 | ADPglucose pyrophosphorylase | M31616 | *Oryza sativa* | 755 | 44 |
| ORF984 | 948522 | 949277 | putative | | | | |
| ORF985 | 949277 | 949594 | YlbH protein | Z98682 | *Bacillus subtilis* | 223 | 41 |
| ORF986 | 949849 | 950676 | putative | | | | |
| ORF987 | 950680 | 951330 | ferrochelatase | M59288 | *Mus musculus* | 260 | 42 |
| ORF988 | 951281 | 951643 | ferrochelatase | D26106 | *Cucumis sativus* | 178 | 47 |
| ORF989 | 951788 | 952798 | putative | | | | |
| ORF990 | 953581 | 954264 | putative | | | | |
| ORF991 | 954426 | 955157 | putative | | | | |
| ORF992 | 955754 | 957940 | orf4 gene product | X93084 | *Methanosarcina barkeri* | 130 | 41 |
| ORF993 | 957837 | 959312 | OppB gene product | X56347 | *Bacillus subtilis* | 327 | 38 |
| ORF994 | 959299 | 961050 | dipeptide ABC transporter, permease protein (dppC) | AE000548 | *Helicobacter pylori* | 263 | 39 |
| ORF995 | 961562 | 961053 | methylated DNA protein cysteine methyltransferase | U67593 | *Methanococcus jannaschii* | 109 | 39 |
| ORF996 | 962575 | 961487 | putative | | | | |
| ORF997 | 961979 | 961584 | putative | | | | |
| ORF998 | 964914 | 962545 | phenylalanyl-tRNA synthetase beta subunit | Z75208 | *Bacillus subtilis* | 775 | 37 |
| ORF999 | 964941 | 965708 | putative | | | | |
| ORF1000 | 967023 | 966193 | unknown | Z48008 | *Saccharomyces cerevisiae* | 492 | 44 |
| ORF1001 | 967444 | 968061 | putative | | | | |
| ORF1002 | 968903 | 968064 | putative | | | | |
| ORF1003 | 970685 | 969528 | transcriptional activator of pilA | Z12154 | *Pseudomonas aeruginosa* | 849 | 45 |
| ORF1004 | 971806 | 971024 | sensor protein | L39904 | *Myxococcus xanthus* | 147 | 30 |
| ORF1005 | 973053 | 972388 | putative | | | | |
| ORF1006 | 974546 | 973746 | unknown | D64126 | *Bacillus subtilis* | 500 | 50 |
| ORF1007 | 975223 | 974558 | unknown | D26185 | *Bacillus subtilis* | 141 | 44 |

TABLE 1-continued

| ORF | begin | stop | Homology | ID | Species | Score | I % |
|---|---|---|---|---|---|---|---|
| ORF1008 | 976193 | 975207 | hypothetical protein in htrA dapD intergenic region | AE000126 | *Escherichia coli* | 142 | 42 |
| ORF1009 | 976520 | 976254 | unknown | Z49939 | *Saccharomyces cerevisiae* | 183 | 39 |
| ORF1010 | 976588 | 976899 | putative | | | | |
| ORF1011 | 976886 | 977635 | peptide release factor 2 | X99401 | *Bacillus firmus* | 534 | 44 |
| ORF1012 | 977661 | 977933 | release factor 2 | AF013188 | *Bacillus subtilis* | 187 | 52 |
| ORF1013 | 977918 | 978433 | putative | | | | |
| ORF1014 | 978619 | 978984 | spore coat protein CotRC | D50551 | *Bacillus subtilis* | 355 | 52 |
| ORF1015 | 978933 | 979331 | hypothetical | U32717 | *Haemophilus influenzae* | 199 | 40 |
| ORF1016 | 981197 | 979389 | putative | | | | |
| ORF1017 | 979711 | 980112 | putative | | | | |
| ORF1018 | 982116 | 981148 | putative | | | | |
| ORF1019 | 982321 | 983598 | UDP-N-acetylglucosamine enolpyruvyl transferase (murZ) | U32788 | *Haemophilus influenzae* | 593 | 38 |
| ORF1020 | 984488 | 983862 | arginyl-tRNA-synthetase | D64006 *Synechocystis* sp. | 347 | 44 | |
| ORF1021 | 985381 | 984371 | arginyl-tRNA-synthetase | D64006 | *Synechocystis* sp. | 782 | 58 |
| ORF1022 | 986103 | 985399 | hypothetical protein | D90915 | *Synechocystis* sp. | 224 | 35 |
| ORF1023 | 986693 | 986046 | No definition line found | U00021 | *Mycobacterium leprae* | 286 | 50 |
| ORF1024 | 987607 | 986693 | o298; This 298 aa ORF is 33 pct identical (24 gaps) to 248 residues of an approx. 256 aa protein CDSA_ECOLI SW: P06466 | AE000238 | *Escherichia coli* | 132 | 46 |
| ORF1025 | 988119 | 987616 | conserved hypothetical protein | AE000627 | *Helicobacter pylori* | 343 | 49 |
| ORF1026 | 988253 | 987936 | hypothetical protein (HI0920) | U67577 | *Methanococcus jannaschii* | 110 | 38 |
| ORF1027 | 988831 | 989163 | putative | | | | |
| ORF1028 | 989693 | 993442 | protein-export membrane protein SecD | D64000 | *Synechocystis* sp. | 447 | 38 |
| ORF1029 | 993408 | 993785 | protein-export membrane protein | U83136 | *Rhodobacter sphaeroides* | 240 | 43 |
| ORF1030 | 993835 | 993416 | putative | | | | |
| ORF1031 | 993882 | 994262 | putative | | | | |
| ORF1032 | 994226 | 995656 | RecJ recombination protein | U41759 | *Chlamydia psittaci* | 880 | 66 |
| ORF1033 | 996036 | 996611 | unknown | U41759 | *Chlamydia psittaci* | 533 | 75 |
| ORF1034 | 996885 | 998267 | glutamyl-tRNA synthetase homolog | U41759 | *Chlamydia psittaci* | 2018 | 83 |
| ORF1035 | 998962 | 999225 | 9-kDa cysteine-rich outer membrane protein | M35148 | *Chlamydia trachomatis* | 504 | 100 |
| ORF1036 | 999375 | 1001033 | outer membrane protein 2 | M23001 | *Chlamydia trachomatis* | 2857 | 100 |
| ORF1037 | 1001211 | 1001516 | 15-kDa serine-rich outer membrane protein | M35148 | *Chlamydia trachomatis* | 276 | 94 |
| ORF1038 | 1001392 | 1001664 | 15-kDa serine-rich outer membrane protein | M35148 | *Chlamydia trachomatis* | 438 | 97 |
| ORF1039 | 1003721 | 1001823 | ORF of prc gene (alt.) | D00674 | *Escherichia coli* | 486 | 42 |
| ORF1040 | 1004459 | 1004845 | StrA | M86701 | *Haemophilus influenzae* | 454 | 70 |
| ORF1041 | 1004990 | 1005382 | ribosomal protein S7 | Z11567 | *Chlamydia trachomatis* | 662 | 99 |
| ORF1042 | 1005391 | 1007496 | translation elongation factor EF-G (fusA) | AE000625 | *Helicobacter pylori* | 2147 | 62 |
| ORF1043 | 1007486 | 1007821 | ribosomal protein 510 | Z21676 | *Spirulina platensis* | 350 | 68 |
| ORF1044 | 1007802 | 1008698 | NADPH-sulfite reducatase flavoprotein component | M23008 | *Escherichia coli* | 113 | 48 |
| ORF1045 | 1009426 | 1009121 | unknown | Z92774 | *Mycobacterium tuberculosis* | 102 | 42 |
| ORF1046 | 1010534 | 1012054 | serine hydroxymethyltransferase | Z38002 | *Bacillus subtilis* | 1021 | 55 |
| ORF1047 | 1012397 | 1011942 | putative | | | | |
| ORF1048 | 1012042 | 1012635 | ATP-dependent Clp protease proteolytic subunit | D90915 | *Synechocystis* sp. | 365 | 44 |
| ORF1049 | 1012593 | 1012862 | putative | | | | |
| ORF1050 | 1012811 | 1013440 | diaminopimelate epimerase (dapF) | U32759 | *Haemophilus influenzae* | 108 | 40 |
| ORF1051 | 1013456 | 1014055 | putative | | | | |
| ORF1052 | 1013977 | 1014489 | putative | | | | |
| ORF1053 | 1015224 | 1014529 | hypothetical 28.1 kD protein in udp-rfaH intergenic region | AE000459 | *Escherichia coli* | 263 | 38 |
| ORF1054 | 1016002 | 1015145 | putative | | | | |
| ORF1055 | 1017120 | 1015939 | conserved hypothetical protein | AE000579 | *Helicobacter pylori* | 428 | 42 |
| ORF1056 | 1017766 | 1017245 | putative | | | | |
| ORF1057 | 1018911 | 1017916 | putative | | | | |
| ORF1058 | 1019191 | 1018580 | putative | | | | |

TABLE 1-continued

| ORF | begin | stop | Homology | ID | Species | Score | I % |
|---|---|---|---|---|---|---|---|
| ORF1059 | 1020199 | 1019831 | hemolysin | AE000647 | *Helicobacter pylori* | 164 | 33 |
| ORF1060 | 1021007 | 1020114 | unknown | Z95208 | *Mycobacterium tuberculosis* | 201 | 36 |
| ORF1061 | 1021569 | 1021075 | putative | | | | |
| ORF1062 | 1022411 | 1022097 | putative | | | | |
| ORF1063 | 1023344 | 1023667 | 50S ribosomal subunit protein L21 | U18997 | *Escherichia coli* | 218 | 43 |
| ORF1064 | 1023701 | 1023949 | 50S ribosomal protein L27 | U38804 | *Porphyra purpurea* | 251 | 64 |
| ORF1065 | 1023976 | 1024776 | ORF__f390 | U18997 | *Escherichia coli* | 603 | 51 |
| ORF1066 | 1024704 | 1025045 | GTP-binding protein (obg) | U32769 | *Haemophilus influenzae* | 161 | 37 |
| ORF1067 | 1025881 | 1024967 | hypothetical protein | D90903 | *Synechocystis* sp. | 439 | 35 |
| ORF1068 | 1026546 | 1025839 | YcdI | AB000617 | *Bacillus subtilis* | 312 | 40 |
| ORF1069 | 1027379 | 1026546 | adhesion protein | D90903 | *Synechocystis* sp. | 354 | 35 |
| ORF1070 | 1030604 | 1027929 | putative 98 kDa outer membrane protein | U72499 | *Chlamydia psittaci* | 95 | 49 |
| ORF1071 | 1033252 | 1030508 | putative 98 kDa outer membrane protein | U72499 | *Chlamydia psittaci* | 75 | 36 |
| ORF1072 | 1031733 | 1032086 | putative | | | | |
| ORF1073 | 1037037 | 1033456 | putative 98 kDa outer membrane protein | U72499 | *Chlamydia psittaci* | 160 | 46 |
| ORF1074 | 1035674 | 1035910 | putative | | | | |
| ORF1075 | 1036175 | 1036507 | putative | | | | |
| ORF1076 | 68(com) | 1036967 | putative | | | | |
| ORF1077 | 16591 | 16989 | GutQ/KpsF Family Sugar-P Isomerase | AE001313 | *Chlamydia trachomatis* | 658 | 97 |
| ORF1078 | 31779 | 31408 | putative | | | | |
| ORF1079 | 56502 | 56834 | hypothetical protein | AE001309 | *Chlamydia trachomatis* | 284 | 95 |
| ORF1080 | 56686 | 56913 | hypothetical protein | AE001309 | *Chlamydia trachomatis* | 303 | 94 |
| ORF1081 | 64748 | 65074 | hypothetical protein (possible 357R?) | AE001309 | *Chlamydia trachomatis* | 501 | 100 |
| ORF1082 | 73482 | 73195 | Predicted OMP [leader (19) peptide] | AE001308 | *Chlamydia trachomatis* | 476 | 100 |
| ORF1083 | 78482 | 78736 | putative | | | | |
| ORF1084 | 79803 | 79411 | hypothetical protein | AE001307 | *Chlamydia trachomatis* | 583 | 98 |
| ORF1085 | 82333 | 81959 | Lon ATP-dependent protease | AE001307 | *Chlamydia trachomatis* | 607 | 99 |
| ORF1086 | 87313 | 86999 | hypothetical protein | AE001307 | *Chlamydia trachomatis* | 534 | 100 |
| ORF1087 | 109929 | 109456 | hypothetical protein | AE001305 | *Chlamydia trachomatis* | 529 | 98 |
| ORF1088 | 111599 | 111351 | putative | | | | |
| ORF1089 | 112069 | 111734 | putative | | | | |
| ORF1090 | 112666 | 112911 | hypothetical protein | AE001305 | *Chlamydia trachomatis* | 395 | 94 |
| ORF1091 | 114017 | 113715 | putative | | | | |
| ORF1092 | 120757 | 120464 | putative | | | | |
| ORF1093 | 125133 | 125522 | predied ferredoxin | AE001303 | *Chlamydia trachomatis* | 631 | 97 |
| ORF1094 | 131888 | 131604 | putative | | | | |
| ORF1095 | 144164 | 144427 | putative | | | | |
| ORF1096 | 150698 | 150369 | putative | | | | |
| ORF1097 | 164385 | 163948 | NADH (Ubiquinone) Dehydrogenase | AE001300 | *Chlamydia trachomatis* | 755 | 100 |
| ORF1098 | 165690 | 166115 | hypothetical protein | AE001300 | *Chlamydia trachomatis* | 724 | 99 |
| ORF1099 | 168742 | 168425 | hypothetical protein | AE001300 | *Chlamydia trachomatis* | 356 | 96 |
| ORF1100 | 170509 | 170793 | hypothetical protein | AE001300 | *Chlamydia trachomatis* | 489 | 100 |
| ORF1101 | 177145 | 177474 | AcCoA Carboxylase/Transferase Alpha | AE001299 | *Chlamydia trachomatis* | 518 | 99 |
| ORF1102 | 188295 | 188023 | hypothetical protein | AE001298 | *Chlamydia trachomatis* | 451 | 100 |
| ORF1103 | 188791 | 188330 | hypothetical protein | AE001298 | *Chlamydia trachomatis* | 733 | 97 |
| ORF1104 | 190629 | 190336 | putative | | | | |
| ORF1105 | 197313 | 197083 | putative | | | | |
| ORF1106 | 210914 | 211384 | putative | | | | |
| ORF1107 | 235160 | 234852 | Glutamate Aminomutase | AE001295 | *Chlamydia trachomatis* | 507 | 97 |
| ORF1108 | 237227 | 236913 | putative | | | | |
| ORF1109 | 249733 | 249446 | Oligopeptide Permease | AE001293 | *Chlamydia trachomatis* | 512 | 100 |
| ORF1110 | 253493 | 253158 | hypothetical protein | AE001293 | *Chlamydia trachomatis* | 318 | 63 |
| ORF1111 | 253701 | 254789 | hypothetical protein | AE001293 | *Chlamydia trachomatis* | 1860 | 99 |
| ORF1112 | 271633 | 271932 | hypothetical protein | AE001291 | *Chlamydia trachomatis* | 512 | 100 |
| ORF1113 | 275666 | 276070 | Disulfide bond Oxidoreductase | AE001291 | *Chlamydia trachamatis* | 700 | 99 |
| ORF1114 | 277931 | 278218 | putative | | | | |
| ORF1115 | 282741 | 282481 | hypothetical protein | AE001290 | *Chlamydia trachomatis* | 422 | 99 |
| ORF1116 | 293178 | 293489 | Phospholipase D Endonuclease Superfamily | AE001289 | *Chlamydia trachomatis* | 433 | 95 |
| ORF1117 | 303155 | 303469 | putative | | | | |
| ORF1118 | 309297 | 308965 | hypothetical protein | AE001287 | *Chlamydia trachomatis* | 422 | 95 |
| ORF1119 | 312219 | 312536 | putative | | | | |
| ORF1120 | 312853 | 312602 | hypothetical protein | AE001287 | *Chlamydia trachomatis* | 338 | 99 |
| ORF1121 | 313167 | 312772 | hypothetical protein | AE001287 | *Chlamydia trachomatis* | 616 | 98 |
| ORF1122 | 320224 | 320598 | hypothetical protein | AE001286 | *Chlamydia trachomatis* | 628 | 98 |

TABLE 1-continued

| ORF | begin | stop | Homology | ID | Species | Score | I % |
|---|---|---|---|---|---|---|---|
| ORF1123 | 340249 | 340503 | Oligopeptidase | AE001285 | *Chlamydia trachomatis* | 444 | 100 |
| ORF1124 | 352839 | 353324 | hypothetical protein | AE001284 | *Chlamydia trachomatis* | 751 | 98 |
| ORF1125 | 373475 | 373699 | Phopholipase D Superfamily [leader (33) peptide] | AE001282 | *Chlamydia trachomatis* | 378 | 100 |
| ORF1126 | 377316 | 377756 | hypothetical protein | AE001282 | *Chlamydia trachomatis* | 764 | 99 |
| ORF1127 | 379268 | 379657 | hypothetical protein | AE001282 | *Chlamydia trachomatis* | 535 | 100 |
| ORF1128 | 395098 | 394823 | putative | | | | |
| ORF1129 | 401594 | 401142 | Flagellar Secretion Protein | AE001280 | *Chlamydia trachomatis* | 698 | 100 |
| ORF1130 | 410045 | 410539 | hypothetical protein | AE001279 | *Chlamydia trachomatis* | 767 | 100 |
| ORF1131 | 411425 | 411658 | Coproporphyrinogen III Oxidase | AE001279 | *Chlamydia trachomatis* | 399 | 99 |
| ORF1132 | 414937 | 414416 | putative | | | | |
| ORF1133 | 422889 | 423212 | Glycogen Hydrolase (debranching) | AE001278 | *Chlamydia trachomatis* | 206 | 100 |
| ORF1134 | 427842 | 428183 | hypothetical protein | AE001278 | *Chlamydia trachomatis* | 610 | 100 |
| ORF1135 | 428732 | 429451 | hypothetical protein | AE001278 | *Chlamydia trachomatis* | 1010 | 98 |
| ORF1136 | 442557 | 442799 | hypothetical protein | AE001277 | *Chlamydia trachomatis* | 649 | 94 |
| ORF1137 | 443628 | 444041 | L31 Ribosomal Protein | AE001277 | *Chlamydia trachomatis* | 538 | 96 |
| ORF1138 | 443678 | 443166 | putative | | | | |
| ORF1139 | 445901 | 446155 | putative | | | | |
| ORF1140 | 467981 | 468262 | putative | | | | |
| ORF1141 | 471869 | 472108 | Putative Outer Membrane Protein I | AE001361 | *Chlamydia trachomatis* | 370 | 100 |
| ORF1142 | 488032 | 488337 | Membrane Thiol Protease | AE001360 | *Chlamydia trachomatis* | 483 | 96 |
| ORF1143 | 497179 | 497694 | Low Calcium Response Protein H | AE001359 | *Chlamydia trachomatis* | 864 | 95 |
| ORF1144 | 500474 | 500202 | putative | | | | |
| ORF1145 | 508968 | 509561 | ABC transporter permease | AE001358 | *Chlamydia trachomatis* | 964 | 100 |
| ORF1146 | 510845 | 511264 | hypothetical protein | AE001358 | *Chlamydia trachomatis* | 360 | 89 |
| ORF1147 | 526525 | 526848 | hypothetical protein | AE001356 | *Chlamydia trachomatis* | 242 | 81 |
| ORF1148 | 531318 | 531863 | hypothetical protein | AE001356 | *Chlamydia trachoinatis* | 127 | 100 |
| ORF1149 | 556826 | 557224 | hypothetical protein | AE001354 | *Chlamydia trachomatis* | 683 | 99 |
| ORF1150 | 564971 | 564537 | hypothetical protein | AE001353 | *Chlamydia trachomatis* | 534 | 100 |
| ORF1151 | 566963 | 567232 | Glycerol-3-P Acyltransferase | AE001353 | *Chlamydia trachomatis* | 220 | 53 |
| ORF1152 | 570351 | 570890 | Insulinase family/Protease III | AE001353 | *Chlamydia trachomatis* | 925 | 100 |
| ORF1153 | 571072 | 571332 | hypothetical protein | AE001353 | *Chlamydia trachomatis* | 441 | 99 |
| ORF1154 | 576025 | 575801 | General Stress Protein | AE001352 | *Chlamydia trachomatis* | 273 | 97 |
| ORP1155 | 590363 | 590650 | hypothetical protein | AE001351 | *Chlamydia trachomatis* | 442 | 100 |
| ORF1156 | 597868 | 598593 | hypothetical protein | AE001350 | *Chlamydia trachomatis* | 1176 | 98 |
| ORF1157 | 606889 | 606626 | putative | | | | |
| ORF1158 | 608031 | 607786 | hydrolase/phosphatase homolog | AE001349 | *Chlamydia trachomatis* | 434 | 99 |
| ORF1159 | 610110 | 610391 | putative | | | | |
| ORF1160 | 632703 | 633353 | putative | | | | |
| ORF1161 | 637213 | 637482 | putative | | | | |
| ORF1162 | 650517 | 649924 | putative | | | | |
| ORF1163 | 652317 | 652562 | Phenolhydrolase/NADH ubiquinone oxidoreductase | AE001345 | *Chlamydia trachomatis* | 324 | 99 |
| ORF1164 | 654753 | 655325 | putative | | | | |
| ORF1165 | 661118 | 660810 | putative | | | | |
| ORF1166 | 677596 | 677057 | hypothetical protein | AE001343 | *Chlamydia trachomatis* | 864 | 98 |
| ORF1167 | 679528 | 679253 | putative | | | | |
| ORF1168 | 732536 | 732210 | putative | | | | |
| ORF1169 | 742069 | 742383 | putative | | | | |
| ORF1170 | 759318 | 758782 | (Pseudouridine Synthase) | AE001336 | *Chlamydia trachomatis* | 909 | 98 |
| ORF1171 | 760282 | 760521 | putative | | | | |
| ORP1172 | 771313 | 770894 | hypothetical protein | AE001335 | *Chlamydia trachomatis* | 661 | 96 |
| ORF1173 | 772115 | 772408 | hypothetical protein | AE001335 | *Chlamydia trachomatis* | 520 | 99 |
| ORF1174 | 788137 | 788457 | putative | | | | |
| ORF1175 | 816302 | 815967 | putative | | | | |
| ORF1176 | 846606 | 846914 | putative | | | | |
| ORF1177 | 867803 | 868054 | putative | | | | |
| ORF1178 | 875386 | 875658 | hypothetical protein | AE001327 | *Chlamydia trachomatis* | 268 | 86 |
| ORF1179 | 876445 | 876915 | hypothetical protein | AE001327 | *Chlamydia trachomatis* | 747 | 99 |
| ORF1180 | 884548 | 884312 | putative | | | | |
| ORF1181 | 891859 | 891467 | hypothetical protein | AE001326 | *Chlamydia trachomatis* | 551 | 95 |
| ORF1182 | 900770 | 900417 | putative | | | | |
| ORF1183 | 902553 | 902269 | putative | | | | |
| ORF1184 | 908046 | 907783 | putative | | | | |
| ORF1185 | 912313 | 912567 | Myristoyl GlcNac Deacetylase | AE001324 | *Chlamydia trachomatis* | 195 | 97 |
| ORF1186 | 935451 | 935741 | putative | | | | |
| ORF1187 | 946961 | 946692 | hypothetical protein | AE001322 | *Chlamydia trachomatis* | 410 | 99 |
| ORF1188 | 953193 | 952783 | hypothetical protein | AE001322 | *Chlamydia trachomatis* | 593 | 100 |
| ORF1189 | 966199 | 965873 | hypothetical protein | AE001321 | *Chlamydia trachomatis* | 542 | 98 |
| ORF1190 | 969298 | 968765 | putative | | | | |
| ORF1191 | 971009 | 970731 | 2-Component Sensor | AE001320 | *Chlamydia trachomatis* | 467 | 97 |

TABLE 1-continued

| ORF | begin | stop | Homology | ID | Species | Score | I % |
|---|---|---|---|---|---|---|---|
| ORF1192 | 972162 | 972404 | putative | | | | |
| ORF1193 | 973119 | 973508 | Phosphoglycolate Phosphatase | AE001320 | *Chlamydia trachomatis* | 647 | 98 |
| ORF1194 | 998649 | 998404 | putative | | | | |
| ORF1195 | 1004280 | 1003882 | hypothetical protein | AE001317 | *Chlamydia trachomatis* | 571 | 99 |
| ORF1196 | 1010200 | 1009532 | hypothetical protein | AE001317 | *Chlamydia trachomatis* | 1132 | 99 |
| ORF1197 | 1029174 | 1029482 | putative | | | | |

TABLE 2

| SEQ ID NO | begin | stop | preferred start |
|---|---|---|---|
| 2 | 501 | 208 | 501 |
| 3 | 3276 | 505 | 3153 |
| 4 | 5068 | 3242 | 5062 |
| 5 | 6400 | 5126 | 6400 |
| 6 | 7977 | 6619 | 7977 |
| 7 | 8582 | 8082 | 8582 |
| 8 | 8995 | 8591 | 8995 |
| 9 | 9440 | 8979 | 9440 |
| 10 | 9828 | 10430 | 9828 |
| 11 | 10367 | 11254 | 10430 |
| 12 | 11245 | 11916 | 11245 |
| 13 | 12068 | 13324 | 12068 |
| 14 | 13532 | 14413 | 13538 |
| 15 | 14807 | 15019 | 14807 |
| 16 | 14932 | 15969 | 14977 |
| 17 | 15995 | 16501 | 16004 |
| 18 | 16467 | 16138 | 16377 |
| 19 | 18190 | 17417 | 18178 |
| 20 | 20521 | 18437 | 20518 |
| 21 | 22202 | 20814 | 22166 |
| 22 | 22602 | 22153 | 22509 |
| 23 | 22804 | 22478 | 22795 |
| 24 | 23183 | 22824 | 23180 |
| 25 | 23394 | 23110 | 23394 |
| 26 | 24569 | 23394 | 24569 |
| 27 | 26383 | 24641 | 26383 |
| 28 | 26640 | 27710 | 26640 |
| 29 | 28780 | 27725 | 28729 |
| 30 | 29957 | 28740 | 29957 |
| 31 | 30721 | 30032 | 30628 |
| 32 | 31281 | 30520 | 31254 |
| 33 | 31436 | 31780 | 31436 |
| 34 | 33356 | 31800 | 33344 |
| 35 | 33901 | 33314 | 33874 |
| 36 | 34116 | 35027 | 34116 |
| 37 | 34988 | 35359 | 35027 |
| 38 | 35167 | 35919 | 35377 |
| 39 | 35923 | 36996 | 36031 |
| 40 | 37810 | 37013 | 37765 |
| 41 | 38207 | 39085 | 38252 |
| 42 | 39151 | 39927 | 39157 |
| 43 | 39923 | 40756 | 39959 |
| 44 | 40760 | 42007 | 40772 |
| 45 | 42175 | 43116 | 42229 |
| 46 | 42999 | 43802 | 43128 |
| 47 | 44211 | 45227 | 44217 |
| 48 | 46072 | 45275 | 46066 |
| 49 | 46340 | 45975 | 46331 |
| 50 | 46895 | 46506 | 46865 |
| 51 | 47955 | 46882 | 47955 |
| 52 | 48585 | 48178 | 48558 |
| 53 | 50072 | 48630 | 50012 |
| 54 | 50710 | 50099 | 50692 |
| 55 | 52439 | 50925 | 52430 |
| 56 | 53484 | 52348 | 53478 |
| 57 | 54536 | 53466 | 54536 |
| 58 | 55086 | 54595 | 55104 |
| 59 | 56350 | 55031 | 56350 |
| 60 | 55659 | 56084 | 55722 |
| 61 | 56847 | 58235 | 56931 |
| 62 | 58423 | 59181 | 58423 |
| 63 | 59185 | 60195 | 59194 |

TABLE 2-continued

| SEQ ID NO | begin | stop | preferred start |
|---|---|---|---|
| 64 | 60188 | 61483 | 60191 |
| 65 | 61496 | 62353 | 61496 |
| 66 | 62500 | 63141 | 62518 |
| 67 | 63396 | 63983 | 63396 |
| 68 | 64628 | 64071 | 64580 |
| 69 | 64285 | 64656 | 64285 |
| 70 | 64944 | 64609 | 64938 |
| 71 | 65347 | 67269 | 65347 |
| 72 | 67656 | 68873 | 67815 |
| 73 | 68877 | 69233 | 68892 |
| 74 | 69212 | 69721 | 69323 |
| 75 | 69958 | 70455 | 69970 |
| 76 | 70701 | 71006 | 70725 |
| 77 | 73191 | 71086 | 73185 |
| 78 | 74900 | 73497 | 74891 |
| 79 | 75463 | 74876 | 75463 |
| 80 | 77124 | 75502 | 77124 |
| 81 | 77000 | 77299 | 77012 |
| 82 | 78095 | 77145 | 78095 |
| 83 | 79065 | 78154 | 79065 |
| 84 | 81971 | 79878 | 81965 |
| 85 | 82639 | 83271 | 82642 |
| 86 | 83792 | 84850 | 83921 |
| 87 | 84876 | 86921 | 84888 |
| 88 | 88650 | 87313 | 88383 |
| 89 | 87440 | 87805 | 87458 |
| 90 | 88400 | 88747 | 88409 |
| 91 | 88717 | 89265 | 88729 |
| 92 | 89355 | 89732 | 89355 |
| 93 | 89735 | 91447 | 89735 |
| 94 | 91749 | 91435 | 91749 |
| 95 | 92392 | 91745 | 92323 |
| 96 | 93138 | 92344 | 92874 |
| 97 | 94134 | 93361 | 93945 |
| 98 | 94637 | 94071 | 94577 |
| 99 | 98299 | 94628 | 98113 |
| 100 | 98715 | 98113 | 98715 |
| 101 | 100228 | 98741 | 100195 |
| 102 | 101347 | 100337 | 101323 |
| 103 | 102210 | 101323 | 102210 |
| 104 | 102485 | 102210 | 102479 |
| 105 | 104315 | 102726 | 104315 |
| 106 | 105075 | 104254 | 105075 |
| 107 | 105259 | 105894 | 105271 |
| 108 | 107429 | 108460 | 107486 |
| 109 | 108665 | 108955 | 108683 |
| 110 | 109459 | 109013 | 109456 |
| 111 | 110366 | 109704 | 110363 |
| 112 | 111330 | 112520 | 111330 |
| 113 | 112915 | 113463 | 112918 |
| 114 | 113566 | 113994 | 113566 |
| 115 | 114020 | 114604 | 114020 |
| 116 | 114720 | 115253 | 114807 |
| 117 | 115362 | 115676 | 115380 |
| 118 | 116022 | 119795 | 116040 |
| 119 | 119823 | 124010 | 119823 |
| 120 | 124065 | 124988 | 124065 |
| 121 | 124873 | 125106 | 124873 |
| 122 | 126261 | 125536 | 126243 |
| 123 | 126328 | 126930 | 126331 |
| 124 | 127138 | 127785 | 127147 |
| 125 | 127924 | 129714 | 127942 |

TABLE 2-continued

| SEQ ID NO | begin | stop | preferred start |
|---|---|---|---|
| 126 | 129720 | 131033 | 129720 |
| 127 | 131018 | 131629 | 131021 |
| 128 | 131834 | 133156 | 131852 |
| 129 | 133075 | 133584 | 133096 |
| 130 | 133625 | 133999 | 133628 |
| 131 | 133861 | 134508 | 133948 |
| 132 | 134638 | 137454 | 134638 |
| 133 | 137442 | 140276 | 137472 |
| 134 | 140733 | 140335 | 140727 |
| 135 | 141799 | 141077 | 141799 |
| 136 | 143240 | 141780 | 143240 |
| 137 | 143829 | 143128 | 143820 |
| 138 | 143923 | 144393 | 143923 |
| 139 | 144548 | 146326 | 144548 |
| 140 | 146413 | 147078 | 146425 |
| 141 | 147140 | 148075 | 147152 |
| 142 | 148115 | 148549 | 148115 |
| 143 | 148524 | 149027 | 148524 |
| 144 | 149000 | 149305 | 149033 |
| 145 | 149187 | 149708 | 149187 |
| 146 | 149712 | 150911 | 149769 |
| 147 | 152044 | 151004 | 151966 |
| 148 | 152664 | 151999 | 152592 |
| 149 | 152900 | 153352 | 152924 |
| 150 | 153389 | 153997 | 153425 |
| 151 | 155276 | 153984 | 155228 |
| 152 | 156544 | 155231 | 156544 |
| 153 | 156806 | 157525 | 156809 |
| 154 | 157489 | 158955 | 157534 |
| 155 | 159104 | 159961 | 159104 |
| 156 | 159916 | 161220 | 159916 |
| 157 | 161183 | 161593 | 161228 |
| 158 | 162354 | 161623 | 162354 |
| 159 | 163013 | 162363 | 163013 |
| 160 | 163941 | 162994 | 163941 |
| 161 | 165505 | 164474 | 165505 |
| 162 | 166686 | 166093 | 166686 |
| 163 | 168171 | 166729 | 168171 |
| 164 | 169249 | 168848 | 169189 |
| 165 | 169586 | 170431 | 169607 |
| 166 | 170780 | 171334 | 170783 |
| 167 | 171333 | 172376 | 171390 |
| 168 | 172309 | 172722 | 172309 |
| 169 | 173048 | 174496 | 173048 |
| 170 | 174399 | 174968 | 174399 |
| 171 | 175267 | 175710 | 175267 |
| 172 | 175714 | 177009 | 175735 |
| 173 | 177423 | 178115 | 177468 |
| 174 | 178084 | 180021 | 178084 |
| 175 | 180704 | 180048 | 180635 |
| 176 | 181398 | 180631 | 181398 |
| 177 | 182594 | 181398 | 182594 |
| 178 | 182895 | 183656 | 182895 |
| 179 | 183665 | 184786 | 183665 |
| 180 | 186007 | 184796 | 186007 |
| 181 | 186848 | 186000 | 186791 |
| 182 | 187270 | 186749 | 187240 |
| 183 | 187426 | 187809 | 187429 |
| 184 | 189481 | 188798 | 189442 |
| 185 | 189693 | 190352 | 189693 |
| 186 | 190235 | 190510 | 190280 |
| 187 | 190785 | 191786 | 190824 |
| 188 | 191790 | 192464 | 191811 |
| 189 | 192392 | 193183 | 192500 |
| 190 | 193254 | 194630 | 193263 |
| 191 | 195046 | 194690 | 195037 |
| 192 | 195184 | 197031 | 195193 |
| 193 | 197018 | 197635 | 197024 |
| 194 | 197762 | 198208 | 197669 |
| 195 | 198963 | 197668 | 198954 |
| 196 | 199957 | 198962 | 199945 |
| 197 | 200327 | 199941 | 200306 |
| 198 | 200685 | 200266 | 200598 |
| 199 | 200962 | 200585 | 200962 |
| 200 | 201169 | 202377 | 201184 |
| 201 | 203441 | 202380 | 203441 |
| 202 | 203998 | 203471 | 203989 |

TABLE 2-continued

| SEQ ID NO | begin | stop | preferred start |
|---|---|---|---|
| 203 | 206449 | 204059 | 206434 |
| 204 | 207425 | 206811 | 207410 |
| 205 | 207506 | 208528 | 207506 |
| 206 | 208545 | 209471 | 208545 |
| 207 | 209471 | 210214 | 209471 |
| 208 | 210586 | 210816 | 210586 |
| 209 | 211332 | 210883 | 211293 |
| 210 | 212978 | 211374 | 212972 |
| 211 | 214134 | 212875 | 214134 |
| 212 | 214710 | 214168 | 214701 |
| 213 | 215143 | 214754 | 215128 |
| 214 | 216705 | 215236 | 216705 |
| 215 | 217917 | 216892 | 217911 |
| 216 | 217088 | 217441 | 217202 |
| 217 | 218364 | 218702 | 218364 |
| 218 | 218695 | 219009 | 218785 |
| 219 | 219179 | 219748 | 219260 |
| 220 | 219891 | 220430 | 219912 |
| 221 | 220499 | 221074 | 220505 |
| 222 | 221137 | 221541 | 221176 |
| 223 | 221601 | 222092 | 221616 |
| 224 | 222472 | 223290 | 222487 |
| 225 | 223423 | 223818 | 223423 |
| 226 | 224278 | 225171 | 224278 |
| 227 | 225749 | 225174 | 225749 |
| 228 | 225334 | 225549 | 225328 |
| 229 | 226654 | 225749 | 226654 |
| 230 | 227299 | 226769 | 227170 |
| 231 | 227646 | 227161 | 227646 |
| 232 | 228457 | 227750 | 228439 |
| 233 | 230001 | 228607 | 229854 |
| 234 | 231074 | 230151 | 231062 |
| 235 | 231348 | 233006 | 231366 |
| 236 | 233059 | 233829 | 233059 |
| 237 | 233801 | 234265 | 233801 |
| 238 | 234282 | 234854 | 234288 |
| 239 | 236300 | 235227 | 236300 |
| 240 | 236314 | 238209 | 236314 |
| 241 | 238164 | 238769 | 238185 |
| 242 | 238769 | 240061 | 238769 |
| 243 | 242022 | 240313 | 242022 |
| 244 | 242846 | 241941 | 242846 |
| 245 | 244480 | 242798 | 244456 |
| 246 | 245897 | 244479 | 245891 |
| 247 | 246877 | 245924 | 246829 |
| 248 | 247731 | 246985 | 247725 |
| 249 | 248585 | 247743 | 248573 |
| 250 | 249420 | 248569 | 249411 |
| 251 | 250383 | 249766 | 250383 |
| 252 | 251186 | 250545 | 251174 |
| 253 | 252111 | 251095 | 252099 |
| 254 | 253088 | 252066 | 253088 |
| 255 | 255153 | 256718 | 255153 |
| 256 | 256762 | 257844 | 256774 |
| 257 | 257911 | 258690 | 257962 |
| 258 | 258780 | 259187 | 258840 |
| 259 | 259193 | 261604 | 259193 |
| 260 | 261622 | 264129 | 261622 |
| 261 | 264125 | 264742 | 264134 |
| 262 | 264741 | 265628 | 264759 |
| 263 | 266416 | 265631 | 266416 |
| 264 | 266938 | 266426 | 267946 |
| 265 | 267961 | 266942 | 267946 |
| 266 | 268320 | 268066 | 268299 |
| 267 | 268510 | 268205 | 268510 |
| 268 | 270116 | 268500 | 270116 |
| 269 | 270892 | 270095 | 270856 |
| 270 | 271191 | 271613 | 271224 |
| 271 | 272219 | 272932 | 272243 |
| 272 | 272884 | 273588 | 273079 |
| 273 | 274816 | 273596 | 274807 |
| 274 | 274821 | 275666 | 274953 |
| 275 | 277689 | 276103 | 277689 |
| 276 | 278268 | 278816 | 278298 |
| 277 | 279771 | 279013 | 279870 |
| 278 | 280777 | 279767 | 280762 |
| 279 | 281603 | 281295 | 281576 |

TABLE 2-continued

| SEQ ID NO | begin | stop | preferred start |
|---|---|---|---|
| 280 | 282104 | 281787 | 282086 |
| 281 | 284335 | 282794 | 284320 |
| 282 | 284460 | 284795 | 284550 |
| 283 | 284817 | 285674 | 284844 |
| 284 | 285637 | 286137 | 285670 |
| 285 | 286357 | 286677 | 286399 |
| 286 | 286681 | 287898 | 286852 |
| 287 | 288127 | 289227 | 288358 |
| 288 | 289744 | 290679 | 289744 |
| 289 | 290828 | 291535 | 291206 |
| 290 | 291514 | 292230 | 291514 |
| 291 | 292326 | 293048 | 292350 |
| 292 | 293330 | 294853 | 293525 |
| 293 | 295684 | 295010 | 295684 |
| 294 | 296336 | 295692 | 296294 |
| 295 | 297238 | 296243 | 297199 |
| 296 | 297791 | 298735 | 297791 |
| 297 | 298905 | 300458 | 298920 |
| 298 | 302152 | 300527 | 302131 |
| 299 | 304917 | 302071 | 304872 |
| 300 | 306157 | 304973 | 306142 |
| 301 | 306494 | 306111 | 306461 |
| 302 | 306963 | 306436 | 306963 |
| 303 | 308773 | 306977 | 308758 |
| 304 | 309881 | 309276 | 309869 |
| 305 | 310720 | 309872 | 310711 |
| 306 | 311570 | 310716 | 311570 |
| 307 | 312451 | 311972 | 312439 |
| 308 | 313435 | 314364 | 313462 |
| 309 | 314340 | 314738 | 314409 |
| 310 | 315526 | 314741 | 315445 |
| 311 | 316507 | 315665 | 316507 |
| 312 | 317284 | 316529 | 317284 |
| 313 | 317592 | 317338 | 317592 |
| 314 | 318470 | 317499 | 318416 |
| 315 | 317599 | 317874 | 317599 |
| 316 | 318947 | 318477 | 318887 |
| 317 | 319342 | 320142 | 319342 |
| 318 | 320544 | 321497 | 320682 |
| 319 | 321485 | 321937 | 321497 |
| 320 | 321901 | 322362 | 321943 |
| 321 | 322301 | 323140 | 322325 |
| 322 | 323144 | 324913 | 323177 |
| 323 | 325621 | 324977 | 325621 |
| 324 | 326268 | 325621 | 326262 |
| 325 | 326469 | 327203 | 326469 |
| 326 | 327281 | 328150 | 327302 |
| 327 | 328605 | 328204 | 328602 |
| 328 | 329066 | 328734 | 329066 |
| 329 | 329663 | 329292 | 329648 |
| 330 | 330666 | 329608 | 330663 |
| 331 | 331161 | 330670 | 331161 |
| 332 | 331731 | 331177 | 331731 |
| 333 | 332404 | 331721 | 332404 |
| 334 | 332779 | 333021 | 332779 |
| 335 | 333005 | 333589 | 333149 |
| 336 | 334357 | 333806 | 334321 |
| 337 | 334089 | 334361 | 334089 |
| 338 | 335142 | 334729 | 335124 |
| 339 | 335195 | 335602 | 335234 |
| 340 | 335673 | 335194 | 335673 |
| 341 | 336334 | 335903 | 336229 |
| 342 | 337378 | 336338 | 337378 |
| 343 | 339947 | 337347 | 339947 |
| 344 | 340507 | 341847 | 340576 |
| 345 | 341783 | 342022 | 341786 |
| 346 | 342249 | 342470 | 342249 |
| 347 | 342597 | 343370 | 342597 |
| 348 | 343361 | 344032 | 343379 |
| 349 | 343956 | 344225 | 343962 |
| 350 | 344357 | 345142 | 344357 |
| 351 | 345934 | 345161 | 345934 |
| 352 | 347102 | 346080 | 347102 |
| 353 | 347113 | 347940 | 347119 |
| 354 | 350164 | 348146 | 350113 |
| 355 | 350423 | 351283 | 350426 |
| 356 | 352207 | 351314 | 352207 |

TABLE 2-continued

| SEQ ID NO | begin | stop | preferred start |
|---|---|---|---|
| 357 | 352727 | 352245 | 352703 |
| 358 | 353709 | 353305 | 353709 |
| 359 | 354218 | 353670 | 354215 |
| 360 | 354721 | 354140 | 354721 |
| 361 | 354966 | 356672 | 354966 |
| 362 | 356700 | 357377 | 356700 |
| 363 | 357326 | 358093 | 357500 |
| 364 | 358035 | 360743 | 358035 |
| 365 | 360753 | 361121 | 360753 |
| 366 | 361162 | 361884 | 361162 |
| 367 | 361826 | 362746 | 361826 |
| 368 | 363859 | 362816 | 363859 |
| 369 | 364116 | 365195 | 364116 |
| 370 | 365198 | 365587 | 365198 |
| 371 | 365479 | 367320 | 365614 |
| 372 | 367341 | 368603 | 367341 |
| 373 | 368644 | 369081 | 368644 |
| 374 | 369088 | 370251 | 369088 |
| 375 | 370769 | 371086 | 370769 |
| 376 | 371203 | 372816 | 371209 |
| 377 | 373119 | 373529 | 373152 |
| 378 | 373614 | 374204 | 373776 |
| 379 | 374736 | 374224 | 374703 |
| 380 | 376391 | 374703 | 376382 |
| 381 | 377062 | 376748 | 377038 |
| 382 | 377853 | 378737 | 377871 |
| 383 | 378626 | 379048 | 378710 |
| 384 | 379017 | 379403 | 379038 |
| 385 | 380009 | 379641 | 379967 |
| 386 | 380187 | 381470 | 380187 |
| 387 | 381473 | 382567 | 381473 |
| 388 | 382704 | 383702 | 382728 |
| 389 | 383945 | 383655 | 383921 |
| 390 | 385217 | 383949 | 385211 |
| 391 | 385507 | 385178 | 385507 |
| 392 | 386845 | 385706 | 386842 |
| 393 | 386127 | 386627 | 386232 |
| 394 | 387372 | 386872 | 387351 |
| 395 | 387823 | 387338 | 387823 |
| 396 | 388250 | 387816 | 388106 |
| 397 | 389169 | 388237 | 389169 |
| 398 | 389955 | 389173 | 390087 |
| 399 | 390988 | 389945 | 390922 |
| 400 | 391514 | 391810 | 391514 |
| 401 | 392410 | 393996 | 392413 |
| 402 | 394170 | 395354 | 394185 |
| 403 | 395309 | 395992 | 395354 |
| 404 | 396538 | 396059 | 396529 |
| 405 | 397507 | 396542 | 397498 |
| 406 | 398753 | 397401 | 398747 |
| 407 | 399688 | 398909 | 399667 |
| 408 | 400167 | 399778 | 400167 |
| 409 | 401224 | 400034 | 401209 |
| 410 | 401776 | 402021 | 401776 |
| 411 | 402126 | 403220 | 402132 |
| 412 | 403348 | 405180 | 403354 |
| 413 | 403788 | 403276 | 403785 |
| 414 | 405165 | 405920 | 405165 |
| 415 | 407049 | 405955 | 407049 |
| 416 | 409773 | 407056 | 409764 |
| 417 | 410532 | 411416 | 410532 |
| 418 | 411707 | 413410 | 411722 |
| 419 | 413433 | 412606 | 413334 |
| 420 | 413404 | 413952 | 413449 |
| 421 | 413841 | 415112 | 413991 |
| 422 | 414379 | 413978 | 414220 |
| 423 | 416664 | 415177 | 416646 |
| 424 | 417456 | 416740 | 417456 |
| 425 | 418053 | 417721 | 418044 |
| 426 | 418603 | 418031 | 418582 |
| 427 | 419531 | 418647 | 419531 |
| 428 | 420190 | 419672 | 420190 |
| 429 | 421171 | 420245 | 421171 |
| 430 | 421988 | 421518 | 421988 |
| 431 | 422486 | 423043 | 422492 |
| 432 | 423226 | 425079 | 423295 |
| 433 | 426054 | 425146 | 426021 |

TABLE 2-continued

| SEQ ID NO | begin | stop | preferred start |
|---|---|---|---|
| 434 | 426985 | 426245 | 426967 |
| 435 | 427248 | 427817 | 427248 |
| 436 | 429560 | 429886 | 429623 |
| 437 | 430360 | 429857 | 430360 |
| 438 | 430637 | 430323 | 430628 |
| 439 | 430933 | 431787 | 430966 |
| 440 | 431658 | 431987 | 431688 |
| 441 | 432232 | 434475 | 432238 |
| 442 | 436308 | 434620 | 436269 |
| 443 | 436574 | 436272 | 436571 |
| 444 | 437685 | 436567 | 437595 |
| 445 | 438262 | 437894 | 438256 |
| 446 | 439127 | 438285 | 439031 |
| 447 | 439339 | 438986 | 439339 |
| 448 | 439705 | 439358 | 439705 |
| 449 | 441042 | 439699 | 441042 |
| 450 | 441911 | 441042 | 441911 |
| 451 | 442593 | 441898 | 442584 |
| 452 | 444505 | 446388 | 444505 |
| 453 | 448068 | 446452 | 448029 |
| 454 | 449575 | 447932 | 449575 |
| 455 | 450546 | 451076 | 450576 |
| 456 | 451623 | 451144 | 451401 |
| 457 | 452593 | 451517 | 452575 |
| 458 | 453195 | 452632 | 453174 |
| 459 | 453567 | 454868 | 453567 |
| 460 | 455430 | 454972 | 455403 |
| 461 | 456047 | 455367 | 456047 |
| 462 | 457384 | 456047 | 457384 |
| 463 | 457659 | 458450 | 457659 |
| 464 | 458508 | 459632 | 458511 |
| 465 | 459839 | 461203 | 459839 |
| 466 | 461624 | 461196 | 461624 |
| 467 | 461887 | 462621 | 462151 |
| 468 | 463758 | 462895 | 463749 |
| 469 | 464048 | 464629 | 464063 |
| 470 | 464721 | 465848 | 464760 |
| 471 | 467420 | 466113 | 467414 |
| 472 | 468891 | 467419 | 468891 |
| 473 | 469280 | 468906 | 469226 |
| 474 | 469349 | 469675 | 469406 |
| 475 | 471226 | 469826 | 471160 |
| 476 | 471624 | 471106 | 471609 |
| 477 | 471954 | 473267 | 471954 |
| 478 | 473252 | 473695 | 473252 |
| 479 | 473982 | 474527 | 474051 |
| 480 | 475198 | 474602 | 475195 |
| 481 | 476527 | 475613 | 476509 |
| 482 | 478640 | 476517 | 478640 |
| 483 | 479084 | 478665 | 479078 |
| 484 | 479723 | 479088 | 479720 |
| 485 | 480012 | 479668 | 479898 |
| 486 | 481466 | 479895 | 481412 |
| 487 | 481732 | 481496 | 481732 |
| 488 | 481864 | 483429 | 481870 |
| 489 | 483402 | 484964 | 483402 |
| 490 | 484898 | 487864 | 484970 |
| 491 | 485725 | 485222 | 485593 |
| 492 | 488204 | 489247 | 488321 |
| 493 | 488571 | 488233 | 488562 |
| 494 | 489440 | 490456 | 489473 |
| 495 | 492765 | 490507 | 492690 |
| 496 | 492357 | 492893 | 492654 |
| 497 | 493744 | 492737 | 493723 |
| 498 | 493875 | 494675 | 493875 |
| 499 | 494573 | 494869 | 494609 |
| 500 | 494835 | 495365 | 494955 |
| 501 | 495174 | 494872 | 495174 |
| 502 | 495687 | 496634 | 495732 |
| 503 | 496295 | 497176 | 496523 |
| 504 | 497703 | 498515 | 498222 |
| 505 | 498280 | 499239 | 498301 |
| 506 | 499215 | 500732 | 499254 |
| 507 | 501710 | 500790 | 501710 |
| 508 | 502863 | 501808 | 502830 |
| 509 | 503675 | 502692 | 503645 |
| 510 | 505002 | 503722 | 505002 |

TABLE 2-continued

| SEQ ID NO | begin | stop | preferred start |
|---|---|---|---|
| 511 | 505739 | 506986 | 505739 |
| 512 | 506999 | 507439 | 507011 |
| 513 | 508404 | 507649 | 508302 |
| 514 | 508291 | 508590 | 508297 |
| 515 | 508915 | 508478 | 508915 |
| 516 | 509600 | 510691 | 509600 |
| 517 | 511039 | 511527 | 511147 |
| 518 | 511547 | 512185 | 511547 |
| 519 | 512382 | 513092 | 512385 |
| 520 | 514287 | 513055 | 514269 |
| 521 | 514789 | 515244 | 514792 |
| 522 | 514994 | 515269 | 515027 |
| 523 | 515553 | 515804 | 515553 |
| 524 | 515808 | 516422 | 515820 |
| 525 | 516476 | 517171 | 516605 |
| 526 | 517927 | 517400 | 517927 |
| 527 | 518096 | 518380 | 518114 |
| 528 | 518403 | 518822 | 518412 |
| 529 | 518923 | 519516 | 518923 |
| 530 | 519577 | 520497 | 519730 |
| 531 | 521986 | 520718 | 521971 |
| 532 | 522131 | 521886 | 522125 |
| 533 | 523495 | 522143 | 523483 |
| 534 | 524591 | 523623 | 524510 |
| 535 | 524652 | 525746 | 524685 |
| 536 | 525731 | 526078 | 525752 |
| 537 | 525939 | 526400 | 525999 |
| 538 | 526301 | 526735 | 526361 |
| 539 | 528323 | 526851 | 528284 |
| 540 | 528861 | 528292 | 528828 |
| 541 | 529723 | 529142 | 529645 |
| 542 | 530166 | 529624 | 530166 |
| 543 | 530543 | 530223 | 530543 |
| 544 | 531378 | 530737 | 531363 |
| 545 | 532370 | 533272 | 532370 |
| 546 | 533849 | 533244 | 533849 |
| 547 | 534672 | 533944 | 534615 |
| 548 | 535915 | 534878 | 535915 |
| 549 | 539153 | 535956 | 539114 |
| 550 | 539731 | 540519 | 539731 |
| 551 | 540523 | 540969 | 540526 |
| 552 | 540906 | 541805 | 541002 |
| 553 | 543255 | 541825 | 543222 |
| 554 | 544133 | 543222 | 544115 |
| 555 | 544565 | 544179 | 544532 |
| 556 | 544762 | 544487 | 544747 |
| 557 | 546423 | 544951 | 546423 |
| 558 | 547480 | 546584 | 547378 |
| 559 | 546789 | 547382 | 546900 |
| 560 | 547901 | 547476 | 547826 |
| 561 | 548634 | 547900 | 548634 |
| 562 | 548692 | 549459 | 548704 |
| 563 | 550385 | 549663 | 550376 |
| 564 | 551611 | 550421 | 551611 |
| 565 | 553041 | 551797 | 553041 |
| 566 | 554946 | 553096 | 554946 |
| 567 | 556300 | 554927 | 556300 |
| 568 | 556524 | 556904 | 556524 |
| 569 | 558126 | 557314 | 558105 |
| 570 | 557810 | 558235 | 557810 |
| 571 | 559215 | 558310 | 559215 |
| 572 | 561349 | 559196 | 561349 |
| 573 | 562931 | 561150 | 562898 |
| 574 | 564083 | 563121 | 564083 |
| 575 | 563593 | 563943 | 563644 |
| 576 | 565379 | 566953 | 565379 |
| 577 | 567079 | 567966 | 567274 |
| 578 | 568021 | 570399 | 568021 |
| 579 | 571269 | 572021 | 571284 |
| 580 | 572519 | 572755 | 572519 |
| 581 | 573519 | 572731 | 573393 |
| 582 | 572879 | 573427 | 573077 |
| 583 | 574160 | 573660 | 574160 |
| 584 | 574426 | 574184 | 574426 |
| 585 | 574781 | 574446 | 574781 |
| 586 | 575243 | 574923 | 575156 |
| 587 | 575458 | 575057 | 575458 |

TABLE 2-continued

| SEQ ID NO | begin | stop | preferred start |
|---|---|---|---|
| 588 | 575849 | 575469 | 575735 |
| 589 | 576545 | 578023 | 576545 |
| 590 | 578673 | 578017 | 578673 |
| 591 | 579012 | 582104 | 579012 |
| 592 | 582697 | 582206 | 582682 |
| 593 | 583122 | 582811 | 583095 |
| 594 | 583514 | 583182 | 583484 |
| 595 | 583869 | 583438 | 583803 |
| 596 | 584435 | 583827 | 584399 |
| 597 | 584967 | 584299 | 584967 |
| 598 | 585297 | 585016 | 585285 |
| 599 | 585240 | 586610 | 585300 |
| 600 | 586484 | 587758 | 586505 |
| 601 | 587786 | 589408 | 587786 |
| 602 | 589198 | 589578 | 589258 |
| 603 | 590061 | 589630 | 589971 |
| 604 | 590739 | 591272 | 590775 |
| 605 | 592406 | 592765 | 592406 |
| 606 | 593145 | 592849 | 593127 |
| 607 | 593900 | 593121 | 593894 |
| 608 | 594138 | 595637 | 594138 |
| 609 | 596122 | 595640 | 596053 |
| 610 | 596864 | 596154 | 596828 |
| 611 | 597731 | 597282 | 597689 |
| 612 | 598524 | 600809 | 598551 |
| 613 | 601876 | 600734 | 601864 |
| 614 | 603523 | 601910 | 603520 |
| 615 | 603794 | 603531 | 603794 |
| 616 | 604413 | 603757 | 604398 |
| 617 | 604549 | 605610 | 604549 |
| 618 | 606619 | 605582 | 606619 |
| 619 | 606843 | 607493 | 606867 |
| 620 | 609068 | 608031 | 608972 |
| 621 | 609652 | 609296 | 609652 |
| 622 | 611860 | 610109 | 611830 |
| 623 | 611812 | 612927 | 611815 |
| 624 | 613597 | 612938 | 613444 |
| 625 | 613952 | 613692 | 613952 |
| 626 | 614315 | 615244 | 614441 |
| 627 | 615396 | 615683 | 615396 |
| 628 | 617711 | 615864 | 617624 |
| 629 | 618313 | 617510 | 618361 |
| 630 | 619338 | 618361 | 619338 |
| 631 | 620416 | 619247 | 620401 |
| 632 | 619863 | 620261 | 619929 |
| 633 | 621184 | 620420 | 621154 |
| 634 | 621690 | 621154 | 621678 |
| 635 | 622399 | 621674 | 622399 |
| 636 | 623466 | 622414 | 623421 |
| 637 | 624178 | 623570 | 624106 |
| 638 | 624918 | 624073 | 624918 |
| 639 | 625346 | 626665 | 625367 |
| 640 | 626514 | 626900 | 626652 |
| 641 | 626954 | 627853 | 626984 |
| 642 | 627822 | 628124 | 627873 |
| 643 | 628715 | 628146 | 628715 |
| 644 | 628932 | 629801 | 628935 |
| 645 | 630406 | 629804 | 630298 |
| 646 | 630960 | 630298 | 630915 |
| 647 | 631799 | 630915 | 631799 |
| 648 | 637488 | 638084 | 637488 |
| 649 | 638036 | 640207 | 638111 |
| 650 | 640221 | 643472 | 640236 |
| 651 | 640627 | 640220 | 640627 |
| 652 | 643485 | 644495 | 643488 |
| 653 | 644471 | 645430 | 644471 |
| 654 | 645394 | 645840 | 645538 |
| 655 | 645840 | 647111 | 645840 |
| 656 | 649676 | 647109 | 649616 |
| 657 | 649970 | 650344 | 649970 |
| 658 | 650418 | 651722 | 650433 |
| 659 | 651686 | 652171 | 651770 |
| 660 | 652516 | 652908 | 652516 |
| 661 | 652799 | 653593 | 652892 |
| 662 | 659884 | 661851 | 660136 |
| 663 | 661740 | 662282 | 661851 |
| 664 | 662286 | 663074 | 662289 |

TABLE 2-continued

| SEQ ID NO | begin | stop | preferred start |
|---|---|---|---|
| 665 | 662951 | 663730 | 663074 |
| 666 | 664212 | 663745 | 664194 |
| 667 | 665619 | 664255 | 665619 |
| 668 | 666083 | 665727 | 666056 |
| 669 | 666423 | 665782 | 666390 |
| 670 | 666831 | 668117 | 667047 |
| 671 | 668121 | 668375 | 668139 |
| 672 | 668470 | 668174 | 668404 |
| 673 | 669533 | 668616 | 669485 |
| 674 | 669892 | 669485 | 669892 |
| 675 | 670780 | 669998 | 670765 |
| 676 | 671241 | 670732 | 671196 |
| 677 | 671182 | 672447 | 671260 |
| 678 | 672692 | 673231 | 672698 |
| 679 | 673204 | 674562 | 673204 |
| 680 | 674612 | 675232 | 674612 |
| 681 | 675327 | 676463 | 675327 |
| 682 | 677027 | 676476 | 677027 |
| 683 | 678422 | 677700 | 678422 |
| 684 | 678717 | 679508 | 678708 |
| 685 | 679342 | 680502 | 679342 |
| 686 | 680579 | 681280 | 680654 |
| 687 | 681539 | 682558 | 681557 |
| 688 | 682554 | 683087 | 682578 |
| 689 | 683164 | 684465 | 683164 |
| 690 | 684774 | 684418 | 684639 |
| 691 | 684839 | 686203 | 684839 |
| 692 | 686197 | 687204 | 686203 |
| 693 | 687341 | 688360 | 687341 |
| 694 | 688432 | 688193 | 688426 |
| 695 | 689616 | 688432 | 689601 |
| 696 | 689960 | 689631 | 689939 |
| 697 | 690487 | 689846 | 690445 |
| 698 | 690717 | 690463 | 690717 |
| 699 | 691871 | 690672 | 691856 |
| 700 | 693837 | 692041 | 693837 |
| 701 | 694934 | 693837 | 694934 |
| 702 | 697263 | 694942 | 697230 |
| 703 | 698084 | 697170 | 697958 |
| 704 | 698392 | 697979 | 698380 |
| 705 | 698792 | 700117 | 698792 |
| 706 | 700269 | 700895 | 700269 |
| 707 | 700912 | 702165 | 700990 |
| 708 | 702183 | 703412 | 702183 |
| 709 | 703522 | 705000 | 703531 |
| 710 | 705011 | 705604 | 705062 |
| 711 | 706159 | 705704 | 706093 |
| 712 | 706521 | 706138 | 706488 |
| 713 | 708103 | 706496 | 707932 |
| 714 | 708398 | 708078 | 708392 |
| 715 | 708610 | 708248 | 708610 |
| 716 | 710278 | 708872 | 710203 |
| 717 | 711164 | 710262 | 711164 |
| 718 | 711432 | 712763 | 711432 |
| 719 | 712767 | 713438 | 712773 |
| 720 | 714232 | 713651 | 714217 |
| 721 | 714632 | 714120 | 714617 |
| 722 | 715592 | 714834 | 715739 |
| 723 | 715854 | 715558 | 715854 |
| 724 | 716937 | 715921 | 716886 |
| 725 | 718357 | 717149 | 718357 |
| 726 | 718500 | 718862 | 718590 |
| 727 | 719797 | 718499 | 719776 |
| 728 | 720273 | 719782 | 720147 |
| 729 | 720452 | 720144 | 720452 |
| 730 | 720613 | 721575 | 720613 |
| 731 | 721559 | 722356 | 721571 |
| 732 | 723248 | 722397 | 723239 |
| 733 | 724598 | 723378 | 724580 |
| 734 | 725763 | 724576 | 725760 |
| 735 | 726519 | 725767 | 726519 |
| 736 | 726819 | 726538 | 726801 |
| 737 | 727493 | 726753 | 727466 |
| 738 | 727984 | 727469 | 727984 |
| 739 | 728778 | 728329 | 728718 |
| 740 | 729346 | 728759 | 729334 |
| 741 | 732639 | 729442 | 732639 |

TABLE 2-continued

| SEQ ID NO | begin | stop | preferred start |
|---|---|---|---|
| 742 | 733246 | 734427 | 733246 |
| 743 | 734814 | 735659 | 734814 |
| 744 | 735644 | 736504 | 735644 |
| 745 | 736520 | 737254 | 736520 |
| 746 | 737254 | 737787 | 737254 |
| 747 | 737942 | 738679 | 738122 |
| 748 | 738838 | 739740 | 738862 |
| 749 | 742057 | 740060 | 741982 |
| 750 | 742869 | 742045 | 742824 |
| 751 | 743378 | 742824 | 743348 |
| 752 | 744298 | 743306 | 744292 |
| 753 | 744714 | 744430 | 744660 |
| 754 | 744985 | 744611 | 744931 |
| 755 | 745557 | 744958 | 745548 |
| 756 | 746412 | 745561 | 746409 |
| 757 | 746772 | 746416 | 746697 |
| 758 | 748269 | 746944 | 748269 |
| 759 | 748966 | 748274 | 748954 |
| 760 | 749426 | 748965 | 749411 |
| 761 | 749702 | 749433 | 749681 |
| 762 | 750029 | 749721 | 750020 |
| 763 | 752307 | 750007 | 752307 |
| 764 | 752913 | 752503 | 752901 |
| 765 | 754659 | 753616 | 754659 |
| 766 | 755000 | 756814 | 755000 |
| 767 | 756796 | 758301 | 756832 |
| 768 | 758691 | 758446 | 758688 |
| 769 | 759787 | 759338 | 759787 |
| 770 | 760242 | 759871 | 760188 |
| 771 | 760538 | 760188 | 760529 |
| 772 | 760966 | 761772 | 760966 |
| 773 | 761759 | 762142 | 761759 |
| 774 | 762267 | 762983 | 762267 |
| 775 | 764465 | 763335 | 764312 |
| 776 | 764857 | 764438 | 764821 |
| 777 | 766068 | 764821 | 765972 |
| 778 | 766643 | 766065 | 766643 |
| 779 | 768091 | 766934 | 768091 |
| 780 | 768785 | 768252 | 768785 |
| 781 | 770092 | 768791 | 770062 |
| 782 | 770138 | 770470 | 770150 |
| 783 | 770661 | 770185 | 770631 |
| 784 | 770924 | 770634 | 770894 |
| 785 | 772010 | 771330 | 772010 |
| 786 | 772390 | 773391 | 772390 |
| 787 | 774221 | 773427 | 774215 |
| 788 | 776035 | 774191 | 776035 |
| 789 | 776663 | 777706 | 776894 |
| 790 | 777195 | 776953 | 777177 |
| 791 | 779222 | 777732 | 779180 |
| 792 | 779321 | 781552 | 779360 |
| 793 | 781297 | 782442 | 781351 |
| 794 | 782447 | 785524 | 782447 |
| 795 | 785532 | 786002 | 785697 |
| 796 | 786580 | 785546 | 786580 |
| 797 | 787741 | 786611 | 787729 |
| 798 | 787620 | 788021 | 787782 |
| 799 | 790124 | 787920 | 790064 |
| 800 | 790160 | 790609 | 790178 |
| 801 | 790634 | 792016 | 790634 |
| 802 | 793084 | 792059 | 793084 |
| 803 | 793343 | 794056 | 793370 |
| 804 | 794046 | 794957 | 794079 |
| 805 | 795401 | 795144 | 795395 |
| 806 | 795575 | 796255 | 795575 |
| 807 | 796278 | 797015 | 796311 |
| 808 | 796979 | 797365 | 796979 |
| 809 | 797260 | 797856 | 797395 |
| 810 | 797772 | 798086 | 797805 |
| 811 | 798426 | 797935 | 798393 |
| 812 | 798925 | 798416 | 798916 |
| 813 | 799301 | 799927 | 799301 |
| 814 | 800892 | 800029 | 800892 |
| 815 | 801062 | 802129 | 801062 |
| 816 | 802023 | 802673 | 802041 |
| 817 | 802851 | 803246 | 802920 |
| 818 | 803105 | 804220 | 803111 |
| 819 | 804307 | 805356 | 804331 |
| 820 | 805290 | 806282 | 805356 |
| 821 | 806453 | 808081 | 806498 |
| 822 | 808026 | 809009 | 808098 |
| 823 | 810461 | 809079 | 810437 |
| 824 | 811605 | 810328 | 811590 |
| 825 | 811725 | 812342 | 811824 |
| 826 | 812329 | 813522 | 812398 |
| 827 | 813455 | 813772 | 813455 |
| 828 | 813732 | 814334 | 813780 |
| 829 | 815213 | 814314 | 815207 |
| 830 | 814878 | 814396 | 814975 |
| 831 | 815733 | 815428 | 815733 |
| 832 | 816116 | 817456 | 816170 |
| 833 | 817608 | 819320 | 817608 |
| 834 | 819324 | 819713 | 819342 |
| 835 | 819704 | 820402 | 819713 |
| 836 | 820375 | 821061 | 820453 |
| 837 | 821043 | 821537 | 821043 |
| 838 | 821646 | 822239 | 821667 |
| 839 | 822182 | 822931 | 822221 |
| 840 | 824355 | 823045 | 824352 |
| 841 | 825894 | 824359 | 825891 |
| 842 | 826322 | 825879 | 826322 |
| 843 | 826340 | 827026 | 826340 |
| 844 | 827014 | 827250 | 827014 |
| 845 | 827856 | 827230 | 827856 |
| 846 | 828007 | 829275 | 828025 |
| 847 | 829355 | 830953 | 829358 |
| 848 | 831119 | 831748 | 831140 |
| 849 | 832152 | 831751 | 832140 |
| 850 | 832744 | 832214 | 832666 |
| 851 | 833446 | 832805 | 833446 |
| 852 | 833802 | 833368 | 833742 |
| 853 | 834679 | 833879 | 834661 |
| 854 | 835452 | 834661 | 835365 |
| 855 | 835778 | 835371 | 835775 |
| 856 | 836482 | 835775 | 836470 |
| 857 | 836602 | 837264 | 836617 |
| 858 | 837209 | 838699 | 837209 |
| 859 | 838760 | 839575 | 838760 |
| 860 | 839942 | 840583 | 839951 |
| 861 | 840445 | 841713 | 840451 |
| 862 | 841659 | 842459 | 841686 |
| 863 | 842523 | 843068 | 842541 |
| 864 | 843495 | 843031 | 843447 |
| 865 | 843239 | 846196 | 843335 |
| 866 | 844137 | 843802 | 844077 |
| 867 | 848043 | 846217 | 848022 |
| 868 | 850123 | 848150 | 850099 |
| 869 | 851645 | 850230 | 851504 |
| 870 | 853696 | 851669 | 853672 |
| 871 | 854836 | 853700 | 854809 |
| 872 | 855525 | 854920 | 855468 |
| 873 | 856240 | 855437 | 856240 |
| 874 | 857183 | 856233 | 857006 |
| 875 | 859439 | 857451 | 859430 |
| 876 | 859946 | 859587 | 859916 |
| 877 | 859642 | 860640 | 859660 |
| 878 | 861599 | 860724 | 861599 |
| 879 | 862053 | 861580 | 862038 |
| 880 | 863540 | 862098 | 863531 |
| 881 | 863930 | 863571 | 863927 |
| 882 | 864697 | 863996 | 864688 |
| 883 | 864923 | 866248 | 864923 |
| 884 | 866303 | 866605 | 866336 |
| 885 | 866665 | 867732 | 866665 |
| 886 | 867810 | 869090 | 867864 |
| 887 | 869094 | 869357 | 869094 |
| 888 | 869270 | 871372 | 869336 |
| 889 | 871299 | 872582 | 871359 |
| 890 | 872429 | 872860 | 872555 |
| 891 | 872773 | 873915 | 872773 |
| 892 | 873812 | 873360 | 873668 |
| 893 | 874028 | 874438 | 874067 |
| 894 | 874778 | 875386 | 874796 |
| 895 | 875774 | 876382 | 875843 |

TABLE 2-continued

| SEQ ID NO | begin | stop | preferred start |
|---|---|---|---|
| 896 | 877872 | 877000 | 877866 |
| 897 | 878172 | 877876 | 878157 |
| 898 | 879098 | 878172 | 879098 |
| 899 | 878883 | 879161 | 878886 |
| 900 | 879842 | 879105 | 879809 |
| 901 | 880885 | 880052 | 880885 |
| 902 | 881863 | 880889 | 881863 |
| 903 | 882904 | 881948 | 882901 |
| 904 | 883794 | 882901 | 883761 |
| 905 | 884296 | 883661 | 884296 |
| 906 | 884996 | 884508 | 884984 |
| 907 | 888777 | 885166 | 888771 |
| 908 | 890172 | 888940 | 890172 |
| 909 | 891164 | 890325 | 891146 |
| 910 | 891463 | 891116 | 891427 |
| 911 | 893278 | 891968 | 893278 |
| 912 | 893356 | 893808 | 893386 |
| 913 | 893909 | 893643 | 893894 |
| 914 | 894276 | 893821 | 894276 |
| 915 | 894778 | 894248 | 894760 |
| 916 | 895892 | 895050 | 895874 |
| 917 | 895951 | 896829 | 895963 |
| 918 | 900783 | 897064 | 900774 |
| 919 | 902032 | 900791 | 902158 |
| 920 | 902659 | 903876 | 902659 |
| 921 | 903731 | 903471 | 903731 |
| 922 | 903860 | 905605 | 903860 |
| 923 | 905725 | 906474 | 905725 |
| 924 | 906493 | 906945 | 906493 |
| 925 | 907306 | 907001 | 907306 |
| 926 | 908101 | 908742 | 908131 |
| 927 | 908721 | 909194 | 908724 |
| 928 | 909198 | 909584 | 909201 |
| 929 | 909583 | 909951 | 909670 |
| 930 | 910081 | 910569 | 910090 |
| 931 | 910615 | 910944 | 910636 |
| 932 | 910948 | 912261 | 910951 |
| 933 | 912399 | 912629 | 912399 |
| 934 | 912595 | 913218 | 912595 |
| 935 | 913203 | 913676 | 913218 |
| 936 | 913691 | 914485 | 913691 |
| 937 | 914516 | 915136 | 914522 |
| 938 | 915144 | 915467 | 915162 |
| 939 | 915629 | 916633 | 915629 |
| 940 | 916051 | 916539 | 916159 |
| 941 | 916965 | 917627 | 916965 |
| 942 | 917612 | 918304 | 917612 |
| 943 | 918323 | 918655 | 918323 |
| 944 | 918682 | 919533 | 918682 |
| 945 | 919542 | 919829 | 919542 |
| 946 | 919723 | 920157 | 919723 |
| 947 | 920184 | 920840 | 920184 |
| 948 | 920866 | 921294 | 920866 |
| 949 | 921272 | 921514 | 921272 |
| 950 | 921510 | 921758 | 921510 |
| 951 | 921778 | 922143 | 921778 |
| 952 | 922159 | 922491 | 922159 |
| 953 | 922496 | 923035 | 922496 |
| 954 | 923160 | 923453 | 923160 |
| 955 | 923484 | 924032 | 923484 |
| 956 | 924048 | 924425 | 924057 |
| 957 | 924443 | 924937 | 924443 |
| 958 | 924933 | 925364 | 924933 |
| 959 | 925390 | 926760 | 925390 |
| 960 | 926819 | 927184 | 926819 |
| 961 | 927209 | 927604 | 927209 |
| 962 | 927577 | 928155 | 927577 |
| 963 | 928100 | 928759 | 928127 |
| 964 | 929222 | 930244 | 929243 |
| 965 | 930222 | 930656 | 930258 |
| 966 | 930608 | 931078 | 930665 |
| 967 | 931367 | 931666 | 931406 |
| 968 | 931549 | 931959 | 931558 |
| 969 | 932070 | 932579 | 932070 |
| 970 | 932602 | 933201 | 932602 |
| 971 | 933319 | 933621 | 933319 |
| 972 | 933522 | 933785 | 933522 |

TABLE 2-continued

| SEQ ID NO | begin | stop | preferred start |
|---|---|---|---|
| 973 | 934546 | 933848 | 934546 |
| 974 | 936377 | 934539 | 936377 |
| 975 | 938081 | 936666 | 938081 |
| 976 | 938538 | 939098 | 938595 |
| 977 | 939329 | 940933 | 939506 |
| 978 | 941031 | 942068 | 941076 |
| 979 | 942082 | 944685 | 942082 |
| 980 | 944634 | 945287 | 944673 |
| 981 | 945287 | 946294 | 945287 |
| 982 | 946293 | 946676 | 946368 |
| 983 | 947105 | 948454 | 947132 |
| 984 | 948522 | 949277 | 948546 |
| 985 | 949277 | 949594 | 949277 |
| 986 | 949849 | 950676 | 949888 |
| 987 | 950680 | 951330 | 950701 |
| 988 | 951281 | 951643 | 951290 |
| 989 | 951788 | 952798 | 951803 |
| 990 | 953581 | 954264 | 953602 |
| 991 | 954426 | 955157 | 954429 |
| 992 | 955754 | 957940 | 955766 |
| 993 | 957837 | 959312 | 957867 |
| 994 | 959299 | 961050 | 959317 |
| 995 | 961562 | 961053 | 961562 |
| 996 | 962575 | 961487 | 962545 |
| 997 | 961979 | 961584 | 961979 |
| 998 | 964914 | 962545 | 964914 |
| 999 | 964941 | 965708 | 964956 |
| 1000 | 967023 | 966193 | 966984 |
| 1001 | 967444 | 968061 | 967459 |
| 1002 | 968903 | 968064 | 968792 |
| 1003 | 970685 | 969528 | 970685 |
| 1004 | 971806 | 971024 | 971785 |
| 1005 | 973053 | 972388 | 973026 |
| 1006 | 974546 | 973746 | 974546 |
| 1007 | 975223 | 974558 | 975214 |
| 1008 | 976193 | 975207 | 976193 |
| 1009 | 976520 | 976254 | 976511 |
| 1010 | 976588 | 976899 | 976588 |
| 1011 | 976886 | 977635 | 976934 |
| 1012 | 977661 | 977933 | 977682 |
| 1013 | 977918 | 978433 | 977933 |
| 1014 | 978619 | 978984 | 978619 |
| 1015 | 978933 | 979331 | 978987 |
| 1016 | 981197 | 979389 | 981197 |
| 1017 | 979711 | 980112 | 979753 |
| 1018 | 982116 | 981148 | 982107 |
| 1019 | 982321 | 983598 | 982321 |
| 1020 | 984488 | 983862 | 984296 |
| 1021 | 985381 | 984371 | 985381 |
| 1022 | 986103 | 985399 | 986046 |
| 1023 | 986693 | 986046 | 986693 |
| 1024 | 987607 | 986693 | 987607 |
| 1025 | 988119 | 987616 | 987942 |
| 1026 | 988253 | 987936 | 988247 |
| 1027 | 988831 | 989163 | 988834 |
| 1028 | 989693 | 993442 | 989693 |
| 1029 | 993408 | 993785 | 993408 |
| 1030 | 993835 | 993416 | 993754 |
| 1031 | 993882 | 994262 | 993906 |
| 1032 | 994226 | 995656 | 994259 |
| 1033 | 996036 | 996611 | 996036 |
| 1034 | 996885 | 998267 | 996885 |
| 1035 | 998962 | 999225 | 998962 |
| 1036 | 999375 | 1001033 | 999393 |
| 1037 | 1001211 | 1001516 | 1001214 |
| 1038 | 1001392 | 1001664 | 1001443 |
| 1039 | 1003721 | 1001823 | 1003721 |
| 1040 | 1004459 | 1004845 | 1004459 |
| 1041 | 1004990 | 1005382 | 1004990 |
| 1042 | 1005391 | 1007496 | 1005391 |
| 1043 | 1007486 | 1007821 | 1007453 |
| 1044 | 1007802 | 1008698 | 1007841 |
| 1045 | 1009426 | 1009121 | 1009426 |
| 1046 | 1010534 | 1012054 | 1010534 |
| 1047 | 1012397 | 1011942 | 1012241 |
| 1048 | 1012042 | 1012635 | 1012057 |
| 1049 | 1012593 | 1012862 | 1012593 |

TABLE 2-continued

| SEQ ID NO | begin | stop | preferred start |
|---|---|---|---|
| 1050 | 1012811 | 1013440 | 1012829 |
| 1051 | 1013456 | 1014055 | 1013468 |
| 1052 | 1013977 | 1014489 | 1013977 |
| 1053 | 1015224 | 1014529 | 1015206 |
| 1054 | 1016002 | 1015145 | 1015963 |
| 1055 | 1017120 | 1015939 | 1017120 |
| 1056 | 1017766 | 1017245 | 1017658 |
| 1057 | 1018911 | 1017916 | 1018893 |
| 1058 | 1019191 | 1018580 | 1019110 |
| 1059 | 1020199 | 1019831 | 1020196 |
| 1060 | 1021007 | 1020114 | 1020992 |
| 1061 | 1021569 | 1021075 | 1021557 |
| 1062 | 1022411 | 1022097 | 1022402 |
| 1063 | 1023344 | 1023667 | 1023344 |
| 1064 | 1023701 | 1023949 | 1023701 |
| 1065 | 1023976 | 1024776 | 1023976 |
| 1066 | 1024704 | 1025045 | 1024704 |
| 1067 | 1025881 | 1024967 | 1025845 |
| 1068 | 1026546 | 1025839 | 1026546 |
| 1069 | 1027379 | 1026546 | 1027373 |
| 1070 | 1030604 | 1027929 | 1030328 |
| 1071 | 1033252 | 1030508 | 1033249 |
| 1072 | 1031733 | 1032086 | 1031823 |
| 1073 | 1037037 | 1033456 | 1037016 |
| 1074 | 1035674 | 1035910 | 1035674 |
| 1075 | 1036175 | 1036507 | 1036268 |
| 1076 | 68(comp) | 1036967 | 38 |
| 1077 | 16591 | 16989 | 16597 |
| 1078 | 31779 | 31408 | 31764 |
| 1079 | 56502 | 56834 | 56520 |
| 1080 | 56686 | 56913 | 56686 |
| 1081 | 64748 | 65074 | 64790 |
| 1082 | 73482 | 73195 | 73482 |
| 1083 | 78482 | 78736 | 78506 |
| 1084 | 79803 | 79411 | 79773 |
| 1085 | 82333 | 81959 | 82333 |
| 1086 | 87313 | 86999 | 87523 |
| 1087 | 109929 | 109456 | 109716 |
| 1088 | 111599 | 111351 | 111599 |
| 1089 | 112069 | 111734 | 111988 |
| 1090 | 112666 | 112911 | 112666 |
| 1091 | 114017 | 113715 | 113978 |
| 1092 | 120757 | 120464 | 120757 |
| 1093 | 125133 | 125522 | 125133 |
| 1094 | 131888 | 131604 | 131837 |
| 1095 | 144164 | 144427 | 144191 |
| 1096 | 150698 | 150369 | 150635 |
| 1097 | 164385 | 163948 | 164385 |
| 1098 | 165690 | 166115 | 165408 |
| 1099 | 168742 | 168425 | 168742 |
| 1100 | 170509 | 170793 | 170509 |
| 1101 | 177145 | 177474 | 177145 |
| 1102 | 188295 | 188023 | 188295 |
| 1103 | 188791 | 188330 | 188791 |
| 1104 | 190629 | 190336 | 190626 |
| 1105 | 197313 | 197083 | 197307 |
| 1106 | 210914 | 211384 | 210956 |
| 1107 | 235160 | 234852 | 235160 |
| 1108 | 237227 | 236913 | 237188 |
| 1109 | 249733 | 249446 | 249904 |
| 1110 | 253493 | 253158 | 253493 |
| 1111 | 253701 | 254789 | 253701 |
| 1112 | 271633 | 271932 | 271633 |
| 1113 | 275666 | 276070 | 275666 |
| 1114 | 277931 | 278218 | 277976 |
| 1115 | 282741 | 282481 | 282738 |
| 1116 | 293178 | 293489 | 293181 |
| 1117 | 303155 | 303469 | 303185 |
| 1118 | 309297 | 308965 | 309297 |
| 1119 | 312219 | 312536 | 312246 |
| 1120 | 312853 | 312602 | 312844 |
| 1121 | 313167 | 312772 | 313167 |
| 1122 | 320224 | 320598 | 320224 |
| 1123 | 340249 | 340503 | 340249 |
| 1124 | 352839 | 353324 | 352839 |
| 1125 | 373475 | 373699 | 373475 |
| 1126 | 377316 | 377756 | 377316 |

TABLE 2-continued

| SEQ ID NO | begin | stop | preferred start |
|---|---|---|---|
| 1127 | 379268 | 379657 | 379268 |
| 1128 | 395098 | 394823 | 395077 |
| 1129 | 401594 | 401142 | 401594 |
| 1130 | 410045 | 410539 | 410045 |
| 1131 | 411425 | 411658 | 411425 |
| 1132 | 414937 | 414416 | 414937 |
| 1133 | 422889 | 423212 | 422964 |
| 1134 | 427842 | 428183 | 427842 |
| 1135 | 428732 | 429451 | 428732 |
| 1136 | 442557 | 442799 | 442524 |
| 1137 | 443628 | 444041 | 443628 |
| 1138 | 443678 | 443166 | 443678 |
| 1139 | 445901 | 446155 | 445901 |
| 1140 | 467981 | 468262 | 468023 |
| 1141 | 471869 | 472108 | 471869 |
| 1142 | 488032 | 488337 | 488044 |
| 1143 | 497179 | 497694 | 497101 |
| 1144 | 500474 | 500202 | 500471 |
| 1145 | 508968 | 509561 | 508968 |
| 1146 | 510845 | 511264 | 510845 |
| 1147 | 526525 | 526848 | 526525 |
| 1148 | 531318 | 531863 | 531444 |
| 1149 | 556826 | 557224 | 556826 |
| 1150 | 564971 | 564537 | 564971 |
| 1151 | 566963 | 567232 | 566963 |
| 1152 | 570351 | 570890 | 570351 |
| 1153 | 571072 | 571332 | 571072 |
| 1154 | 576025 | 575801 | 576025 |
| 1155 | 590363 | 590650 | 590363 |
| 1156 | 597868 | 598593 | 597868 |
| 1157 | 606889 | 606626 | 606889 |
| 1158 | 608031 | 607786 | 608031 |
| 1159 | 610110 | 610391 | 610143 |
| 1160 | 632703 | 633353 | 632703 |
| 1161 | 637213 | 637482 | 637255 |
| 1162 | 650517 | 649924 | 650517 |
| 1163 | 652317 | 652562 | 652317 |
| 1164 | 654753 | 655325 | 654753 |
| 1165 | 661118 | 660810 | 661118 |
| 1166 | 677596 | 677057 | 677578 |
| 1167 | 679528 | 679253 | 679477 |
| 1168 | 732536 | 732210 | 732536 |
| 1169 | 742069 | 742383 | 742069 |
| 1170 | 759318 | 758782 | 759318 |
| 1171 | 760282 | 760521 | 760282 |
| 1172 | 771313 | 770894 | 771391 |
| 1173 | 772115 | 772408 | 772115 |
| 1174 | 788137 | 788457 | 788137 |
| 1175 | 816302 | 815967 | 816302 |
| 1176 | 846606 | 846914 | 846612 |
| 1177 | 867803 | 868054 | 867806 |
| 1178 | 875386 | 875658 | 875395 |
| 1179 | 876445 | 876915 | 876445 |
| 1180 | 884548 | 884312 | 884548 |
| 1181 | 891859 | 891467 | 891859 |
| 1182 | 900770 | 900417 | 900728 |
| 1183 | 902553 | 902269 | 902529 |
| 1184 | 908046 | 907783 | 908007 |
| 1185 | 912313 | 912567 | 912313 |
| 1186 | 935451 | 935741 | 935451 |
| 1187 | 946961 | 946692 | 946940 |
| 1188 | 953193 | 952783 | 953145 |
| 1189 | 966199 | 965873 | 966184 |
| 1190 | 969298 | 968765 | 969298 |
| 1191 | 971009 | 970731 | 971009 |
| 1192 | 972162 | 972404 | 972165 |
| 1193 | 973119 | 973508 | 973119 |
| 1194 | 998649 | 998404 | 998625 |
| 1195 | 1004280 | 1003882 | 1004280 |
| 1196 | 1010200 | 1009532 | 1010200 |
| 1197 | 1029174 | 1029482 | 1029180 |

TABLE 4

| ORF-Gen-set | ORFoligosFd | ORFoligosFp | ORFoligosBd | ORFoligosBp |
|---|---|---|---|---|
| 2 | 1199 | 1198 | 3591 | 3590 |
| 3 | 1201 | 1200 | 3593 | 3592 |
| 4 | 1203 | 1202 | 3595 | 3594 |
| 5 | 1205 | 1204 | 3597 | 3596 |
| 6 | 1207 | 1206 | 3599 | 3598 |
| 7 | 1209 | 1208 | 3601 | 3600 |
| 8 | 1211 | 1210 | 3603 | 3602 |
| 9 | 1213 | 1212 | 3605 | 3604 |
| 10 | 1215 | 1214 | 3607 | 3606 |
| 11 | 1217 | 1216 | 3609 | 3608 |
| 12 | 1219 | 1218 | 3611 | 3610 |
| 13 | 1221 | 1220 | 3613 | 3612 |
| 14 | 1223 | 1222 | 3615 | 3614 |
| 15 | 1225 | 1224 | 3617 | 3616 |
| 16 | 1227 | 1226 | 3619 | 3618 |
| 17 | 1229 | 1228 | 3621 | 3620 |
| 18 | 1231 | 1230 | 3623 | 3622 |
| 19 | 1233 | 1232 | 3625 | 3624 |
| 20 | 1235 | 1234 | 3627 | 3626 |
| 21 | 1237 | 1236 | 3629 | 3628 |
| 22 | 1239 | 1238 | 3631 | 3630 |
| 23 | 1241 | 1240 | 3633 | 3632 |
| 24 | 1243 | 1242 | 3635 | 3634 |
| 25 | 1245 | 1244 | 3637 | 3636 |
| 26 | 1247 | 1246 | 3639 | 3638 |
| 27 | 1249 | 1248 | 3641 | 3640 |
| 28 | 1251 | 1250 | 3643 | 3642 |
| 29 | 1253 | 1252 | 3645 | 3644 |
| 30 | 1255 | 1254 | 3647 | 3646 |
| 31 | 1257 | 1256 | 3649 | 3648 |
| 32 | 1259 | 1258 | 3651 | 3650 |
| 33 | 1261 | 1260 | 3653 | 3652 |
| 34 | 1263 | 1262 | 3655 | 3654 |
| 35 | 1265 | 1264 | 3657 | 3656 |
| 36 | 1267 | 1266 | 3659 | 3658 |
| 37 | 1269 | 1268 | 3661 | 3660 |
| 38 | 1271 | 1270 | 3663 | 3662 |
| 39 | 1273 | 1272 | 3665 | 3664 |
| 40 | 1275 | 1274 | 3667 | 3666 |
| 41 | 1277 | 1276 | 3669 | 3668 |
| 42 | 1279 | 1278 | 3671 | 3670 |
| 43 | 1281 | 1280 | 3673 | 3672 |
| 44 | 1283 | 1282 | 3675 | 3674 |
| 45 | 1285 | 1284 | 3677 | 3676 |
| 46 | 1287 | 1286 | 3679 | 3678 |
| 47 | 1289 | 1288 | 3681 | 3680 |
| 48 | 1291 | 1290 | 3683 | 3682 |
| 49 | 1293 | 1292 | 3685 | 3684 |
| 50 | 1295 | 1294 | 3687 | 3686 |
| 51 | 1297 | 1296 | 3689 | 3688 |
| 52 | 1299 | 1298 | 3691 | 3690 |
| 53 | 1301 | 1300 | 3693 | 3692 |
| 54 | 1303 | 1302 | 3695 | 3694 |
| 55 | 1305 | 1304 | 3697 | 3696 |
| 56 | 1307 | 1306 | 3699 | 3698 |
| 57 | 1309 | 1308 | 3701 | 3700 |
| 58 | 1311 | 1310 | 3703 | 3702 |
| 59 | 1313 | 1312 | 3705 | 3704 |
| 60 | 1315 | 1314 | 3707 | 3706 |
| 61 | 1317 | 1316 | 3709 | 3708 |
| 62 | 1319 | 1318 | 3711 | 3710 |
| 63 | 1321 | 1320 | 3713 | 3712 |
| 64 | 1323 | 1322 | 3715 | 3714 |
| 65 | 1325 | 1324 | 3717 | 3716 |
| 66 | 1327 | 1326 | 3719 | 3718 |
| 67 | 1329 | 1328 | 3721 | 3720 |
| 68 | 1331 | 1330 | 3723 | 3722 |
| 69 | 1333 | 1332 | 3725 | 3724 |
| 70 | 1335 | 1334 | 3727 | 3726 |
| 71 | 1337 | 1336 | 3729 | 3728 |
| 72 | 1339 | 1338 | 3731 | 3730 |
| 73 | 1341 | 1340 | 3733 | 3732 |
| 74 | 1343 | 1342 | 3735 | 3734 |
| 75 | 1345 | 1344 | 3737 | 3736 |
| 76 | 1347 | 1346 | 3739 | 3738 |

TABLE 4-continued

| ORF-Gen-set | ORFoligosFd | ORFoligosFp | ORFoligosBd | ORFoligosBp |
|---|---|---|---|---|
| 77 | 1349 | 1348 | 3741 | 3740 |
| 78 | 1351 | 1350 | 3743 | 3742 |
| 79 | 1353 | 1352 | 3745 | 3744 |
| 80 | 1355 | 1354 | 3747 | 3746 |
| 81 | 1357 | 1356 | 3749 | 3748 |
| 82 | 1359 | 1358 | 3751 | 3750 |
| 83 | 1361 | 1360 | 3753 | 3752 |
| 84 | 1363 | 1362 | 3755 | 3754 |
| 85 | 1365 | 1364 | 3757 | 3756 |
| 86 | 1367 | 1366 | 3759 | 3758 |
| 87 | 1369 | 1368 | 3761 | 3760 |
| 88 | 1371 | 1370 | 3763 | 3762 |
| 89 | 1373 | 1372 | 3765 | 3764 |
| 90 | 1375 | 1374 | 3767 | 3766 |
| 91 | 1377 | 1376 | 3769 | 3768 |
| 92 | 1379 | 1378 | 3771 | 3770 |
| 93 | 1381 | 1380 | 3773 | 3772 |
| 94 | 1383 | 1382 | 3775 | 3774 |
| 95 | 1385 | 1384 | 3777 | 3776 |
| 96 | 1387 | 1386 | 3779 | 3778 |
| 97 | 1389 | 1388 | 3781 | 3780 |
| 98 | 1391 | 1390 | 3783 | 3782 |
| 99 | 1393 | 1392 | 3785 | 3784 |
| 100 | 1395 | 1394 | 3787 | 3786 |
| 101 | 1397 | 1396 | 3789 | 3788 |
| 102 | 1399 | 1398 | 3791 | 3790 |
| 103 | 1401 | 1400 | 3793 | 3792 |
| 104 | 1403 | 1402 | 3795 | 3794 |
| 105 | 1405 | 1404 | 3797 | 3796 |
| 106 | 1407 | 1406 | 3799 | 3798 |
| 107 | 1409 | 1408 | 3801 | 3800 |
| 108 | 1411 | 1410 | 3803 | 3802 |
| 109 | 1413 | 1412 | 3805 | 3804 |
| 110 | 1415 | 1414 | 3807 | 3806 |
| 111 | 1417 | 1416 | 3809 | 3808 |
| 112 | 1419 | 1418 | 3811 | 3810 |
| 113 | 1421 | 1420 | 3813 | 3812 |
| 114 | 1423 | 1422 | 3815 | 3814 |
| 115 | 1425 | 1424 | 3817 | 3816 |
| 116 | 1427 | 1426 | 3819 | 3818 |
| 117 | 1429 | 1428 | 3821 | 3820 |
| 118 | 1431 | 1430 | 3823 | 3822 |
| 119 | 1433 | 1432 | 3825 | 3824 |
| 120 | 1435 | 1434 | 3827 | 3826 |
| 121 | 1437 | 1436 | 3829 | 3828 |
| 122 | 1439 | 1438 | 3831 | 3830 |
| 123 | 1441 | 1440 | 3833 | 3832 |
| 124 | 1443 | 1442 | 3835 | 3834 |
| 125 | 1445 | 1444 | 3837 | 3836 |
| 126 | 1447 | 1446 | 3839 | 3838 |
| 127 | 1449 | 1448 | 3841 | 3840 |
| 128 | 1451 | 1450 | 3843 | 3842 |
| 129 | 1453 | 1452 | 3845 | 3844 |
| 130 | 1455 | 1454 | 3847 | 3846 |
| 131 | 1457 | 1456 | 3849 | 3848 |
| 132 | 1459 | 1458 | 3851 | 3850 |
| 133 | 1461 | 1460 | 3853 | 3852 |
| 134 | 1463 | 1462 | 3855 | 3854 |
| 135 | 1465 | 1464 | 3857 | 3856 |
| 136 | 1467 | 1466 | 3859 | 3858 |
| 137 | 1469 | 1468 | 3861 | 3860 |
| 138 | 1471 | 1470 | 3863 | 3862 |
| 139 | 1473 | 1472 | 3865 | 3864 |
| 140 | 1475 | 1474 | 3867 | 3866 |
| 141 | 1477 | 1476 | 3869 | 3868 |
| 142 | 1479 | 1478 | 3871 | 3870 |
| 143 | 1481 | 1480 | 3873 | 3872 |
| 144 | 1483 | 1482 | 3875 | 3874 |
| 145 | 1485 | 1484 | 3877 | 3876 |
| 146 | 1487 | 1486 | 3879 | 3878 |
| 147 | 1489 | 1488 | 3881 | 3880 |
| 148 | 1491 | 1490 | 3883 | 3882 |
| 149 | 1493 | 1492 | 3885 | 3884 |
| 150 | 1495 | 1494 | 3887 | 3886 |
| 151 | 1497 | 1496 | 3889 | 3888 |

TABLE 4-continued

| ORF-Gen-set | ORFoligosFd | ORFoligosFp | ORFoligosBd | ORFoligosBp |
|---|---|---|---|---|
| 152 | 1499 | 1498 | 3891 | 3890 |
| 153 | 1501 | 1500 | 3893 | 3892 |
| 154 | 1503 | 1502 | 3895 | 3894 |
| 155 | 1505 | 1504 | 3897 | 3896 |
| 156 | 1507 | 1506 | 3899 | 3898 |
| 157 | 1509 | 1508 | 3901 | 3900 |
| 158 | 1511 | 1510 | 3903 | 3902 |
| 159 | 1513 | 1512 | 3905 | 3904 |
| 160 | 1515 | 1514 | 3907 | 3906 |
| 161 | 1517 | 1516 | 3909 | 3908 |
| 162 | 1519 | 1518 | 3911 | 3910 |
| 163 | 1521 | 1520 | 3913 | 3912 |
| 164 | 1523 | 1522 | 3915 | 3914 |
| 165 | 1525 | 1524 | 3917 | 3916 |
| 166 | 1527 | 1526 | 3919 | 3918 |
| 167 | 1529 | 1528 | 3921 | 3920 |
| 168 | 1531 | 1530 | 3923 | 3922 |
| 169 | 1533 | 1532 | 3925 | 3924 |
| 170 | 1535 | 1534 | 3927 | 3926 |
| 171 | 1537 | 1536 | 3929 | 3928 |
| 172 | 1539 | 1538 | 3931 | 3930 |
| 173 | 1541 | 1540 | 3933 | 3932 |
| 174 | 1543 | 1542 | 3935 | 3934 |
| 175 | 1545 | 1544 | 3937 | 3936 |
| 176 | 1547 | 1546 | 3939 | 3938 |
| 177 | 1549 | 1548 | 3941 | 3940 |
| 178 | 1551 | 1550 | 3943 | 3942 |
| 179 | 1553 | 1552 | 3945 | 3944 |
| 180 | 1555 | 1554 | 3947 | 3946 |
| 181 | 1557 | 1556 | 3949 | 3948 |
| 182 | 1559 | 1558 | 3951 | 3950 |
| 183 | 1561 | 1560 | 3953 | 3952 |
| 184 | 1563 | 1562 | 3955 | 3954 |
| 185 | 1565 | 1564 | 3957 | 3956 |
| 186 | 1567 | 1566 | 3959 | 3958 |
| 187 | 1569 | 1568 | 3961 | 3960 |
| 188 | 1571 | 1570 | 3963 | 3962 |
| 189 | 1573 | 1572 | 3965 | 3964 |
| 190 | 1575 | 1574 | 3967 | 3966 |
| 191 | 1577 | 1576 | 3969 | 3968 |
| 192 | 1579 | 1578 | 3971 | 3970 |
| 193 | 1581 | 1580 | 3973 | 3972 |
| 194 | 1583 | 1582 | 3975 | 3974 |
| 195 | 1585 | 1584 | 3977 | 3976 |
| 196 | 1587 | 1586 | 3979 | 3978 |
| 197 | 1589 | 1588 | 3981 | 3980 |
| 198 | 1591 | 1590 | 3983 | 3982 |
| 199 | 1593 | 1592 | 3985 | 3984 |
| 200 | 1595 | 1594 | 3987 | 3986 |
| 201 | 1597 | 1596 | 3989 | 3988 |
| 202 | 1599 | 1598 | 3991 | 3990 |
| 203 | 1601 | 1600 | 3993 | 3992 |
| 204 | 1603 | 1602 | 3995 | 3994 |
| 205 | 1605 | 1604 | 3997 | 3996 |
| 206 | 1607 | 1606 | 3999 | 3998 |
| 207 | 1609 | 1608 | 4001 | 4000 |
| 208 | 1611 | 1610 | 4003 | 4002 |
| 209 | 1613 | 1612 | 4005 | 4004 |
| 210 | 1615 | 1614 | 4007 | 4006 |
| 211 | 1617 | 1616 | 4009 | 4008 |
| 212 | 1619 | 1618 | 4011 | 4010 |
| 213 | 1621 | 1620 | 4013 | 4012 |
| 214 | 1623 | 1622 | 4015 | 4014 |
| 215 | 1625 | 1624 | 4017 | 4016 |
| 216 | 1627 | 1626 | 4019 | 4018 |
| 217 | 1629 | 1628 | 4021 | 4020 |
| 218 | 1631 | 1630 | 4023 | 4022 |
| 219 | 1633 | 1632 | 4025 | 4024 |
| 220 | 1635 | 1634 | 4027 | 4026 |
| 221 | 1637 | 1636 | 4029 | 4028 |
| 222 | 1639 | 1638 | 4031 | 4030 |
| 223 | 1641 | 1640 | 4033 | 4032 |
| 224 | 1643 | 1642 | 4035 | 4034 |
| 225 | 1645 | 1644 | 4037 | 4036 |
| 226 | 1647 | 1646 | 4039 | 4038 |

TABLE 4-continued

| ORF-Gen-set | ORFoligosFd | ORFoligosFp | ORFoligosBd | ORFoligosBp |
|---|---|---|---|---|
| 227 | 1649 | 1648 | 4041 | 4040 |
| 228 | 1651 | 1650 | 4043 | 4042 |
| 229 | 1653 | 1652 | 4045 | 4044 |
| 230 | 1655 | 1654 | 4047 | 4046 |
| 231 | 1657 | 1656 | 4049 | 4048 |
| 232 | 1659 | 1658 | 4051 | 4050 |
| 233 | 1661 | 1660 | 4053 | 4052 |
| 234 | 1663 | 1662 | 4055 | 4054 |
| 235 | 1665 | 1664 | 4057 | 4056 |
| 236 | 1667 | 1666 | 4059 | 4058 |
| 237 | 1669 | 1668 | 4061 | 4060 |
| 238 | 1671 | 1670 | 4063 | 4062 |
| 239 | 1673 | 1672 | 4065 | 4064 |
| 240 | 1675 | 1674 | 4067 | 4066 |
| 241 | 1677 | 1676 | 4069 | 4068 |
| 242 | 1679 | 1678 | 4071 | 4070 |
| 243 | 1681 | 1680 | 4073 | 4072 |
| 244 | 1683 | 1682 | 4075 | 4074 |
| 245 | 1685 | 1684 | 4077 | 4076 |
| 246 | 1687 | 1686 | 4079 | 4078 |
| 247 | 1689 | 1688 | 4081 | 4080 |
| 248 | 1691 | 1690 | 4083 | 4082 |
| 249 | 1693 | 1692 | 4085 | 4084 |
| 250 | 1695 | 1694 | 4087 | 4086 |
| 251 | 1697 | 1696 | 4089 | 4088 |
| 252 | 1699 | 1698 | 4091 | 4090 |
| 253 | 1701 | 1700 | 4093 | 4092 |
| 254 | 1703 | 1702 | 4095 | 4094 |
| 255 | 1705 | 1704 | 4097 | 4096 |
| 256 | 1707 | 1706 | 4099 | 4098 |
| 257 | 1709 | 1708 | 4101 | 4100 |
| 258 | 1711 | 1710 | 4103 | 4102 |
| 259 | 1713 | 1712 | 4105 | 4104 |
| 260 | 1715 | 1714 | 4107 | 4106 |
| 261 | 1717 | 1716 | 4109 | 4108 |
| 262 | 1719 | 1718 | 4111 | 4110 |
| 263 | 1721 | 1720 | 4113 | 4112 |
| 264 | 1723 | 1722 | 4115 | 4114 |
| 265 | 1725 | 1724 | 4117 | 4116 |
| 266 | 1727 | 1726 | 4119 | 4118 |
| 267 | 1729 | 1728 | 4121 | 4120 |
| 268 | 1731 | 1730 | 4123 | 4122 |
| 269 | 1733 | 1732 | 4125 | 4124 |
| 270 | 1735 | 1734 | 4127 | 4126 |
| 271 | 1737 | 1736 | 4129 | 4128 |
| 272 | 1739 | 1738 | 4131 | 4130 |
| 273 | 1741 | 1740 | 4133 | 4132 |
| 274 | 1743 | 1742 | 4135 | 4134 |
| 275 | 1745 | 1744 | 4137 | 4136 |
| 276 | 1747 | 1746 | 4139 | 4138 |
| 277 | 1749 | 1748 | 4141 | 4140 |
| 278 | 1751 | 1750 | 4143 | 4142 |
| 279 | 1753 | 1752 | 4145 | 4144 |
| 280 | 1755 | 1754 | 4147 | 4146 |
| 281 | 1757 | 1756 | 4149 | 4148 |
| 282 | 1759 | 1758 | 4151 | 4150 |
| 283 | 1761 | 1760 | 4153 | 4152 |
| 284 | 1763 | 1762 | 4155 | 4154 |
| 285 | 1765 | 1764 | 4157 | 4156 |
| 286 | 1767 | 1766 | 4159 | 4158 |
| 287 | 1769 | 1768 | 4161 | 4160 |
| 288 | 1771 | 1770 | 4163 | 4162 |
| 289 | 1773 | 1772 | 4165 | 4164 |
| 290 | 1775 | 1774 | 4167 | 4166 |
| 291 | 1777 | 1776 | 4169 | 4168 |
| 292 | 1779 | 1778 | 4171 | 4170 |
| 293 | 1781 | 1780 | 4173 | 4172 |
| 294 | 1783 | 1782 | 4175 | 4174 |
| 295 | 1785 | 1784 | 4177 | 4176 |
| 296 | 1787 | 1786 | 4179 | 4178 |
| 297 | 1789 | 1788 | 4181 | 4180 |
| 298 | 1791 | 1790 | 4183 | 4182 |
| 299 | 1793 | 1792 | 4185 | 4184 |
| 300 | 1795 | 1794 | 4187 | 4186 |
| 301 | 1797 | 1796 | 4189 | 4188 |

TABLE 4-continued

| ORF-Gen-set | ORFoligosFd | ORFoligosFp | ORFoligosBd | ORFoligosBp |
|---|---|---|---|---|
| 302 | 1799 | 1798 | 4191 | 4190 |
| 303 | 1801 | 1800 | 4193 | 4192 |
| 304 | 1803 | 1802 | 4195 | 4194 |
| 305 | 1805 | 1804 | 4197 | 4196 |
| 306 | 1807 | 1806 | 4199 | 4198 |
| 307 | 1809 | 1808 | 4201 | 4200 |
| 308 | 1811 | 1810 | 4203 | 4202 |
| 309 | 1813 | 1812 | 4205 | 4204 |
| 310 | 1815 | 1814 | 4207 | 4206 |
| 311 | 1817 | 1816 | 4209 | 4208 |
| 312 | 1819 | 1818 | 4211 | 4210 |
| 313 | 1821 | 1820 | 4213 | 4212 |
| 314 | 1823 | 1822 | 4215 | 4214 |
| 315 | 1825 | 1824 | 4217 | 4216 |
| 316 | 1827 | 1826 | 4219 | 4218 |
| 317 | 1829 | 1828 | 4221 | 4220 |
| 318 | 1831 | 1830 | 4223 | 4222 |
| 319 | 1833 | 1832 | 4225 | 4224 |
| 320 | 1835 | 1834 | 4227 | 4226 |
| 321 | 1837 | 1836 | 4229 | 4228 |
| 322 | 1839 | 1838 | 4231 | 4230 |
| 323 | 1841 | 1840 | 4233 | 4232 |
| 324 | 1843 | 1842 | 4235 | 4234 |
| 325 | 1845 | 1844 | 4237 | 4236 |
| 326 | 1847 | 1846 | 4239 | 4238 |
| 327 | 1849 | 1848 | 4241 | 4240 |
| 328 | 1851 | 1850 | 4243 | 4242 |
| 329 | 1853 | 1852 | 4245 | 4244 |
| 330 | 1855 | 1854 | 4247 | 4246 |
| 331 | 1857 | 1856 | 4249 | 4248 |
| 332 | 1859 | 1858 | 4251 | 4250 |
| 333 | 1861 | 1860 | 4253 | 4252 |
| 334 | 1863 | 1862 | 4255 | 4254 |
| 335 | 1865 | 1864 | 4257 | 4256 |
| 336 | 1867 | 1866 | 4259 | 4258 |
| 337 | 1869 | 1868 | 4261 | 4260 |
| 338 | 1871 | 1870 | 4263 | 4262 |
| 339 | 1873 | 1872 | 4265 | 4264 |
| 340 | 1875 | 1874 | 4267 | 4266 |
| 341 | 1877 | 1876 | 4269 | 4268 |
| 342 | 1879 | 1878 | 4271 | 4270 |
| 343 | 1881 | 1880 | 4273 | 4272 |
| 344 | 1883 | 1882 | 4275 | 4274 |
| 345 | 1885 | 1884 | 4277 | 4276 |
| 346 | 1887 | 1886 | 4279 | 4278 |
| 347 | 1889 | 1888 | 4281 | 4280 |
| 348 | 1891 | 1890 | 4283 | 4282 |
| 349 | 1893 | 1892 | 4285 | 4284 |
| 350 | 1895 | 1894 | 4287 | 4286 |
| 351 | 1897 | 1896 | 4289 | 4288 |
| 352 | 1899 | 1898 | 4291 | 4290 |
| 353 | 1901 | 1900 | 4293 | 4292 |
| 354 | 1903 | 1902 | 4295 | 4294 |
| 355 | 1905 | 1904 | 4297 | 4296 |
| 356 | 1907 | 1906 | 4299 | 4298 |
| 357 | 1909 | 1908 | 4301 | 4300 |
| 358 | 1911 | 1910 | 4303 | 4302 |
| 359 | 1913 | 1912 | 4305 | 4304 |
| 360 | 1915 | 1914 | 4307 | 4306 |
| 361 | 1917 | 1916 | 4309 | 4308 |
| 362 | 1919 | 1918 | 4311 | 4310 |
| 363 | 1921 | 1920 | 4313 | 4312 |
| 364 | 1923 | 1922 | 4315 | 4314 |
| 365 | 1925 | 1924 | 4317 | 4316 |
| 366 | 1927 | 1926 | 4319 | 4318 |
| 367 | 1929 | 1928 | 4321 | 4320 |
| 368 | 1931 | 1930 | 4323 | 4322 |
| 369 | 1933 | 1932 | 4325 | 4324 |
| 370 | 1935 | 1934 | 4327 | 4326 |
| 371 | 1937 | 1936 | 4329 | 4328 |
| 372 | 1939 | 1938 | 4331 | 4330 |
| 373 | 1941 | 1940 | 4333 | 4332 |
| 374 | 1943 | 1942 | 4335 | 4334 |
| 375 | 1945 | 1944 | 4337 | 4336 |
| 376 | 1947 | 1946 | 4339 | 4338 |
| 377 | 1949 | 1948 | 4341 | 4340 |
| 378 | 1951 | 1950 | 4343 | 4342 |
| 379 | 1953 | 1952 | 4345 | 4344 |
| 380 | 1955 | 1954 | 4347 | 4346 |
| 381 | 1957 | 1956 | 4349 | 4348 |
| 382 | 1959 | 1958 | 4351 | 4350 |
| 383 | 1961 | 1960 | 4353 | 4352 |
| 384 | 1963 | 1962 | 4355 | 4354 |
| 385 | 1965 | 1964 | 4357 | 4356 |
| 386 | 1967 | 1966 | 4359 | 4358 |
| 387 | 1969 | 1968 | 4361 | 4360 |
| 388 | 1971 | 1970 | 4363 | 4362 |
| 389 | 1973 | 1972 | 4365 | 4364 |
| 390 | 1975 | 1974 | 4367 | 4366 |
| 391 | 1977 | 1976 | 4369 | 4368 |
| 392 | 1979 | 1978 | 4371 | 4370 |
| 393 | 1981 | 1980 | 4373 | 4372 |
| 394 | 1983 | 1982 | 4375 | 4374 |
| 395 | 1985 | 1984 | 4377 | 4376 |
| 396 | 1987 | 1986 | 4379 | 4378 |
| 397 | 1989 | 1988 | 4381 | 4380 |
| 398 | 1991 | 1990 | 4383 | 4382 |
| 399 | 1993 | 1992 | 4385 | 4384 |
| 400 | 1995 | 1994 | 4387 | 4386 |
| 401 | 1997 | 1996 | 4389 | 4388 |
| 402 | 1999 | 1998 | 4391 | 4390 |
| 403 | 2001 | 2000 | 4393 | 4392 |
| 404 | 2003 | 2002 | 4395 | 4394 |
| 405 | 2005 | 2004 | 4397 | 4396 |
| 406 | 2007 | 2006 | 4399 | 4398 |
| 407 | 2009 | 2008 | 4401 | 4400 |
| 408 | 2011 | 2010 | 4403 | 4402 |
| 409 | 2013 | 2012 | 4405 | 4404 |
| 410 | 2015 | 2014 | 4407 | 4406 |
| 411 | 2017 | 2016 | 4409 | 4408 |
| 412 | 2019 | 2018 | 4411 | 4410 |
| 413 | 2021 | 2020 | 4413 | 4412 |
| 414 | 2023 | 2022 | 4415 | 4414 |
| 415 | 2025 | 2024 | 4417 | 4416 |
| 416 | 2027 | 2026 | 4419 | 4418 |
| 417 | 2029 | 2028 | 4421 | 4420 |
| 418 | 2031 | 2030 | 4423 | 4422 |
| 419 | 2033 | 2032 | 4425 | 4424 |
| 420 | 2035 | 2034 | 4427 | 4426 |
| 421 | 2037 | 2036 | 4429 | 4428 |
| 422 | 2039 | 2038 | 4431 | 4430 |
| 423 | 2041 | 2040 | 4433 | 4432 |
| 424 | 2043 | 2042 | 4435 | 4434 |
| 425 | 2045 | 2044 | 4437 | 4436 |
| 426 | 2047 | 2046 | 4439 | 4438 |
| 427 | 2049 | 2048 | 4441 | 4440 |
| 428 | 2051 | 2050 | 4443 | 4442 |
| 429 | 2053 | 2052 | 4445 | 4444 |
| 430 | 2055 | 2054 | 4447 | 4446 |
| 431 | 2057 | 2056 | 4449 | 4448 |
| 432 | 2059 | 2058 | 4451 | 4450 |
| 433 | 2061 | 2060 | 4453 | 4452 |
| 434 | 2063 | 2062 | 4455 | 4454 |
| 435 | 2065 | 2064 | 4457 | 4456 |
| 436 | 2067 | 2066 | 4459 | 4458 |
| 437 | 2069 | 2068 | 4461 | 4460 |
| 438 | 2071 | 2070 | 4463 | 4462 |
| 439 | 2073 | 2072 | 4465 | 4464 |
| 440 | 2075 | 2074 | 4467 | 4466 |
| 441 | 2077 | 2076 | 4469 | 4468 |
| 442 | 2079 | 2078 | 4471 | 4470 |
| 443 | 2081 | 2080 | 4473 | 4472 |
| 444 | 2083 | 2082 | 4475 | 4474 |
| 445 | 2085 | 2084 | 4477 | 4476 |
| 446 | 2087 | 2086 | 4479 | 4478 |
| 447 | 2089 | 2088 | 4481 | 4480 |
| 448 | 2091 | 2090 | 4483 | 4482 |
| 449 | 2093 | 2092 | 4485 | 4484 |
| 450 | 2095 | 2094 | 4487 | 4486 |
| 451 | 2097 | 2096 | 4489 | 4488 |

TABLE 4-continued

| ORF-Gen-set | ORFoligosFd | ORFoligosFp | ORFoligosBd | ORFoligosBp |
|---|---|---|---|---|
| 452 | 2099 | 2098 | 4491 | 4490 |
| 453 | 2101 | 2100 | 4493 | 4492 |
| 454 | 2103 | 2102 | 4495 | 4494 |
| 455 | 2105 | 2104 | 4497 | 4496 |
| 456 | 2107 | 2106 | 4499 | 4498 |
| 457 | 2109 | 2108 | 4501 | 4500 |
| 458 | 2111 | 2110 | 4503 | 4502 |
| 459 | 2113 | 2112 | 4505 | 4504 |
| 460 | 2115 | 2114 | 4507 | 4506 |
| 461 | 2117 | 2116 | 4509 | 4508 |
| 462 | 2119 | 2118 | 4511 | 4510 |
| 463 | 2121 | 2120 | 4513 | 4512 |
| 464 | 2123 | 2122 | 4515 | 4514 |
| 465 | 2125 | 2124 | 4517 | 4516 |
| 466 | 2127 | 2126 | 4519 | 4518 |
| 467 | 2129 | 2128 | 4521 | 4520 |
| 468 | 2131 | 2130 | 4523 | 4522 |
| 469 | 2133 | 2132 | 4525 | 4524 |
| 470 | 2135 | 2134 | 4527 | 4526 |
| 471 | 2137 | 2136 | 4529 | 4528 |
| 472 | 2139 | 2138 | 4531 | 4530 |
| 473 | 2141 | 2140 | 4533 | 4532 |
| 474 | 2143 | 2142 | 4535 | 4534 |
| 475 | 2145 | 2144 | 4537 | 4536 |
| 476 | 2147 | 2146 | 4539 | 4538 |
| 477 | 2149 | 2148 | 4541 | 4540 |
| 478 | 2151 | 2150 | 4543 | 4542 |
| 479 | 2153 | 2152 | 4545 | 4544 |
| 480 | 2155 | 2154 | 4547 | 4546 |
| 481 | 2157 | 2156 | 4549 | 4548 |
| 482 | 2159 | 2158 | 4551 | 4550 |
| 483 | 2161 | 2160 | 4553 | 4552 |
| 484 | 2163 | 2162 | 4555 | 4554 |
| 485 | 2165 | 2164 | 4557 | 4556 |
| 486 | 2167 | 2166 | 4559 | 4558 |
| 487 | 2169 | 2168 | 4561 | 4560 |
| 488 | 2171 | 2170 | 4563 | 4562 |
| 489 | 2173 | 2172 | 4565 | 4564 |
| 490 | 2175 | 2174 | 4567 | 4566 |
| 491 | 2177 | 2176 | 4569 | 4568 |
| 492 | 2179 | 2178 | 4571 | 4570 |
| 493 | 2181 | 2180 | 4573 | 4572 |
| 494 | 2183 | 2182 | 4575 | 4574 |
| 495 | 2185 | 2184 | 4577 | 4576 |
| 496 | 2187 | 2186 | 4579 | 4578 |
| 497 | 2189 | 2188 | 4581 | 4580 |
| 498 | 2191 | 2190 | 4583 | 4582 |
| 499 | 2193 | 2192 | 4585 | 4584 |
| 500 | 2195 | 2194 | 4587 | 4586 |
| 501 | 2197 | 2196 | 4589 | 4588 |
| 502 | 2199 | 2198 | 4591 | 4590 |
| 503 | 2201 | 2200 | 4593 | 4592 |
| 504 | 2203 | 2202 | 4595 | 4594 |
| 505 | 2205 | 2204 | 4597 | 4596 |
| 506 | 2207 | 2206 | 4599 | 4598 |
| 507 | 2209 | 2208 | 4601 | 4600 |
| 508 | 2211 | 2210 | 4603 | 4602 |
| 509 | 2213 | 2212 | 4605 | 4604 |
| 510 | 2215 | 2214 | 4607 | 4606 |
| 511 | 2217 | 2216 | 4609 | 4608 |
| 512 | 2219 | 2218 | 4611 | 4610 |
| 513 | 2221 | 2220 | 4613 | 4612 |
| 514 | 2223 | 2222 | 4615 | 4614 |
| 515 | 2225 | 2224 | 4617 | 4616 |
| 516 | 2227 | 2226 | 4619 | 4618 |
| 517 | 2229 | 2228 | 4621 | 4620 |
| 518 | 2231 | 2230 | 4623 | 4622 |
| 519 | 2233 | 2232 | 4625 | 4624 |
| 520 | 2235 | 2234 | 4627 | 4626 |
| 521 | 2237 | 2236 | 4629 | 4628 |
| 522 | 2239 | 2238 | 4631 | 4630 |
| 523 | 2241 | 2240 | 4633 | 4632 |
| 524 | 2243 | 2242 | 4635 | 4634 |
| 525 | 2245 | 2244 | 4637 | 4636 |
| 526 | 2247 | 2246 | 4639 | 4638 |

TABLE 4-continued

| ORF-Gen-set | ORFoligosFd | ORFoligosFp | ORFoligosBd | ORFoligosBp |
|---|---|---|---|---|
| 527 | 2249 | 2248 | 4641 | 4640 |
| 528 | 2251 | 2250 | 4643 | 4642 |
| 529 | 2253 | 2252 | 4645 | 4644 |
| 530 | 2255 | 2254 | 4647 | 4646 |
| 531 | 2257 | 2256 | 4649 | 4648 |
| 532 | 2259 | 2258 | 4651 | 4650 |
| 533 | 2261 | 2260 | 4653 | 4652 |
| 534 | 2263 | 2262 | 4655 | 4654 |
| 535 | 2265 | 2264 | 4657 | 4656 |
| 536 | 2267 | 2266 | 4659 | 4658 |
| 537 | 2269 | 2268 | 4661 | 4660 |
| 538 | 2271 | 2270 | 4663 | 4662 |
| 539 | 2273 | 2272 | 4665 | 4664 |
| 540 | 2275 | 2274 | 4667 | 4666 |
| 541 | 2277 | 2276 | 4669 | 4668 |
| 542 | 2279 | 2278 | 4671 | 4670 |
| 543 | 2281 | 2280 | 4673 | 4672 |
| 544 | 2283 | 2282 | 4675 | 4674 |
| 545 | 2285 | 2284 | 4677 | 4676 |
| 546 | 2287 | 2286 | 4679 | 4678 |
| 547 | 2289 | 2288 | 4681 | 4680 |
| 548 | 2291 | 2290 | 4683 | 4682 |
| 549 | 2293 | 2292 | 4685 | 4684 |
| 550 | 2295 | 2294 | 4687 | 4686 |
| 551 | 2297 | 2296 | 4689 | 4688 |
| 552 | 2299 | 2298 | 4691 | 4690 |
| 553 | 2301 | 2300 | 4693 | 4692 |
| 554 | 2303 | 2302 | 4695 | 4694 |
| 555 | 2305 | 2304 | 4697 | 4696 |
| 556 | 2307 | 2306 | 4699 | 4698 |
| 557 | 2309 | 2308 | 4701 | 4700 |
| 558 | 2311 | 2310 | 4703 | 4702 |
| 559 | 2313 | 2312 | 4705 | 4704 |
| 560 | 2315 | 2314 | 4707 | 4706 |
| 561 | 2317 | 2316 | 4709 | 4708 |
| 562 | 2319 | 2318 | 4711 | 4710 |
| 563 | 2321 | 2320 | 4713 | 4712 |
| 564 | 2323 | 2322 | 4715 | 4714 |
| 565 | 2325 | 2324 | 4717 | 4716 |
| 566 | 2327 | 2326 | 4719 | 4718 |
| 567 | 2329 | 2328 | 4721 | 4720 |
| 568 | 2331 | 2330 | 4723 | 4722 |
| 569 | 2333 | 2332 | 4725 | 4724 |
| 570 | 2335 | 2334 | 4727 | 4726 |
| 571 | 2337 | 2336 | 4729 | 4728 |
| 572 | 2339 | 2338 | 4731 | 4730 |
| 573 | 2341 | 2340 | 4733 | 4732 |
| 574 | 2343 | 2342 | 4735 | 4734 |
| 575 | 2345 | 2344 | 4737 | 4736 |
| 576 | 2347 | 2346 | 4739 | 4738 |
| 577 | 2349 | 2348 | 4741 | 4740 |
| 578 | 2351 | 2350 | 4743 | 4742 |
| 579 | 2353 | 2352 | 4745 | 4744 |
| 580 | 2355 | 2354 | 4747 | 4746 |
| 581 | 2357 | 2356 | 4749 | 4748 |
| 582 | 2359 | 2358 | 4751 | 4750 |
| 583 | 2361 | 2360 | 4753 | 4752 |
| 584 | 2363 | 2362 | 4755 | 4754 |
| 585 | 2365 | 2364 | 4757 | 4756 |
| 586 | 2367 | 2366 | 4759 | 4758 |
| 587 | 2369 | 2368 | 4761 | 4760 |
| 588 | 2371 | 2370 | 4763 | 4762 |
| 589 | 2373 | 2372 | 4765 | 4764 |
| 590 | 2375 | 2374 | 4767 | 4766 |
| 591 | 2377 | 2376 | 4769 | 4768 |
| 592 | 2379 | 2378 | 4771 | 4770 |
| 593 | 2381 | 2380 | 4773 | 4772 |
| 594 | 2383 | 2382 | 4775 | 4774 |
| 595 | 2385 | 2384 | 4777 | 4776 |
| 596 | 2387 | 2386 | 4779 | 4778 |
| 597 | 2389 | 2388 | 4781 | 4780 |
| 598 | 2391 | 2390 | 4783 | 4782 |
| 599 | 2393 | 2392 | 4785 | 4784 |
| 600 | 2395 | 2394 | 4787 | 4786 |
| 601 | 2397 | 2396 | 4789 | 4788 |

TABLE 4-continued

| ORF-Gen-set | ORFoligosFd | ORFoligosFp | ORFoligosBd | ORFoligosBp |
|---|---|---|---|---|
| 602 | 2399 | 2398 | 4791 | 4790 |
| 603 | 2401 | 2400 | 4793 | 4792 |
| 604 | 2403 | 2402 | 4795 | 4794 |
| 605 | 2405 | 2404 | 4797 | 4796 |
| 606 | 2407 | 2406 | 4799 | 4798 |
| 607 | 2409 | 2408 | 4801 | 4800 |
| 608 | 2411 | 2410 | 4803 | 4802 |
| 609 | 2413 | 2412 | 4805 | 4804 |
| 610 | 2415 | 2414 | 4807 | 4806 |
| 611 | 2417 | 2416 | 4809 | 4808 |
| 612 | 2419 | 2418 | 4811 | 4810 |
| 613 | 2421 | 2420 | 4813 | 4812 |
| 614 | 2423 | 2422 | 4815 | 4814 |
| 615 | 2425 | 2424 | 4817 | 4816 |
| 616 | 2427 | 2426 | 4819 | 4818 |
| 617 | 2429 | 2428 | 4821 | 4820 |
| 618 | 2431 | 2430 | 4823 | 4822 |
| 619 | 2433 | 2432 | 4825 | 4824 |
| 620 | 2435 | 2434 | 4827 | 4826 |
| 621 | 2437 | 2436 | 4829 | 4828 |
| 622 | 2439 | 2438 | 4831 | 4830 |
| 623 | 2441 | 2440 | 4833 | 4832 |
| 624 | 2443 | 2442 | 4835 | 4834 |
| 625 | 2445 | 2444 | 4837 | 4836 |
| 626 | 2447 | 2446 | 4839 | 4838 |
| 627 | 2449 | 2448 | 4841 | 4840 |
| 628 | 2451 | 2450 | 4843 | 4842 |
| 629 | 2453 | 2452 | 4845 | 4844 |
| 630 | 2455 | 2454 | 4847 | 4846 |
| 631 | 2457 | 2456 | 4849 | 4848 |
| 632 | 2459 | 2458 | 4851 | 4850 |
| 633 | 2461 | 2460 | 4853 | 4852 |
| 634 | 2463 | 2462 | 4855 | 4854 |
| 635 | 2465 | 2464 | 4857 | 4856 |
| 636 | 2467 | 2466 | 4859 | 4858 |
| 637 | 2469 | 2468 | 4861 | 4860 |
| 638 | 2471 | 2470 | 4863 | 4862 |
| 639 | 2473 | 2472 | 4865 | 4864 |
| 640 | 2475 | 2474 | 4867 | 4866 |
| 641 | 2477 | 2476 | 4869 | 4868 |
| 642 | 2479 | 2478 | 4871 | 4870 |
| 643 | 2481 | 2480 | 4873 | 4872 |
| 644 | 2483 | 2482 | 4875 | 4874 |
| 645 | 2485 | 2484 | 4877 | 4876 |
| 646 | 2487 | 2486 | 4879 | 4878 |
| 647 | 2489 | 2488 | 4881 | 4880 |
| 648 | 2491 | 2490 | 4883 | 4882 |
| 649 | 2493 | 2492 | 4885 | 4884 |
| 650 | 2495 | 2494 | 4887 | 4886 |
| 651 | 2497 | 2496 | 4889 | 4888 |
| 652 | 2499 | 2498 | 4891 | 4890 |
| 653 | 2501 | 2500 | 4893 | 4892 |
| 654 | 2503 | 2502 | 4895 | 4894 |
| 655 | 2505 | 2504 | 4897 | 4896 |
| 656 | 2507 | 2506 | 4899 | 4898 |
| 657 | 2509 | 2508 | 4901 | 4900 |
| 658 | 2511 | 2510 | 4903 | 4902 |
| 659 | 2513 | 2512 | 4905 | 4904 |
| 660 | 2515 | 2514 | 4907 | 4906 |
| 661 | 2517 | 2516 | 4909 | 4908 |
| 662 | 2519 | 2518 | 4911 | 4910 |
| 663 | 2521 | 2520 | 4913 | 4912 |
| 664 | 2523 | 2522 | 4915 | 4914 |
| 665 | 2525 | 2524 | 4917 | 4916 |
| 666 | 2527 | 2526 | 4919 | 4918 |
| 667 | 2529 | 2528 | 4921 | 4920 |
| 668 | 2531 | 2530 | 4923 | 4922 |
| 669 | 2533 | 2532 | 4925 | 4924 |
| 670 | 2535 | 2534 | 4927 | 4926 |
| 671 | 2537 | 2536 | 4929 | 4928 |
| 672 | 2539 | 2538 | 4931 | 4930 |
| 673 | 2541 | 2540 | 4933 | 4932 |
| 674 | 2543 | 2542 | 4935 | 4934 |
| 675 | 2545 | 2544 | 4937 | 4936 |
| 676 | 2547 | 2546 | 4939 | 4938 |

TABLE 4-continued

| ORF-Gen-set | ORFoligosFd | ORFoligosFp | ORFoligosBd | ORFoligosBp |
|---|---|---|---|---|
| 677 | 2549 | 2548 | 4941 | 4940 |
| 678 | 2551 | 2550 | 4943 | 4942 |
| 679 | 2553 | 2552 | 4945 | 4944 |
| 680 | 2555 | 2554 | 4947 | 4946 |
| 681 | 2557 | 2556 | 4949 | 4948 |
| 682 | 2559 | 2558 | 4951 | 4950 |
| 683 | 2561 | 2560 | 4953 | 4952 |
| 684 | 2563 | 2562 | 4955 | 4954 |
| 685 | 2565 | 2564 | 4957 | 4956 |
| 686 | 2567 | 2566 | 4959 | 4958 |
| 687 | 2569 | 2568 | 4961 | 4960 |
| 688 | 2571 | 2570 | 4963 | 4962 |
| 689 | 2573 | 2572 | 4965 | 4964 |
| 690 | 2575 | 2574 | 4967 | 4966 |
| 691 | 2577 | 2576 | 4969 | 4968 |
| 692 | 2579 | 2578 | 4971 | 4970 |
| 693 | 2581 | 2580 | 4973 | 4972 |
| 694 | 2583 | 2582 | 4975 | 4974 |
| 695 | 2585 | 2584 | 4977 | 4976 |
| 696 | 2587 | 2586 | 4979 | 4978 |
| 697 | 2589 | 2588 | 4981 | 4980 |
| 698 | 2591 | 2590 | 4983 | 4982 |
| 699 | 2593 | 2592 | 4985 | 4984 |
| 700 | 2595 | 2594 | 4987 | 4986 |
| 701 | 2597 | 2596 | 4989 | 4988 |
| 702 | 2599 | 2598 | 4991 | 4990 |
| 703 | 2601 | 2600 | 4993 | 4992 |
| 704 | 2603 | 2602 | 4995 | 4994 |
| 705 | 2605 | 2604 | 4997 | 4996 |
| 706 | 2607 | 2606 | 4999 | 4998 |
| 707 | 2609 | 2608 | 5001 | 5000 |
| 708 | 2611 | 2610 | 5003 | 5002 |
| 709 | 2613 | 2612 | 5005 | 5004 |
| 710 | 2615 | 2614 | 5007 | 5006 |
| 711 | 2617 | 2616 | 5009 | 5008 |
| 712 | 2619 | 2618 | 5011 | 5010 |
| 713 | 2621 | 2620 | 5013 | 5012 |
| 714 | 2623 | 2622 | 5015 | 5014 |
| 715 | 2625 | 2624 | 5017 | 5016 |
| 716 | 2627 | 2626 | 5019 | 5018 |
| 717 | 2629 | 2628 | 5021 | 5020 |
| 718 | 2631 | 2630 | 5023 | 5022 |
| 719 | 2633 | 2632 | 5025 | 5024 |
| 720 | 2635 | 2634 | 5027 | 5026 |
| 721 | 2637 | 2636 | 5029 | 5028 |
| 722 | 2639 | 2638 | 5031 | 5030 |
| 723 | 2641 | 2640 | 5033 | 5032 |
| 724 | 2643 | 2642 | 5035 | 5034 |
| 725 | 2645 | 2644 | 5037 | 5036 |
| 726 | 2647 | 2646 | 5039 | 5038 |
| 727 | 2649 | 2648 | 5041 | 5040 |
| 728 | 2651 | 2650 | 5043 | 5042 |
| 729 | 2653 | 2652 | 5045 | 5044 |
| 730 | 2655 | 2654 | 5047 | 5046 |
| 731 | 2657 | 2656 | 5049 | 5048 |
| 732 | 2659 | 2658 | 5051 | 5050 |
| 733 | 2661 | 2660 | 5053 | 5052 |
| 734 | 2663 | 2662 | 5055 | 5054 |
| 735 | 2665 | 2664 | 5057 | 5056 |
| 736 | 2667 | 2666 | 5059 | 5058 |
| 737 | 2669 | 2668 | 5061 | 5060 |
| 738 | 2671 | 2670 | 5063 | 5062 |
| 739 | 2673 | 2672 | 5065 | 5064 |
| 740 | 2675 | 2674 | 5067 | 5066 |
| 741 | 2677 | 2676 | 5069 | 5068 |
| 742 | 2679 | 2678 | 5071 | 5070 |
| 743 | 2681 | 2680 | 5073 | 5072 |
| 744 | 2683 | 2682 | 5075 | 5074 |
| 745 | 2685 | 2684 | 5077 | 5076 |
| 746 | 2687 | 2686 | 5079 | 5078 |
| 747 | 2689 | 2688 | 5081 | 5080 |
| 748 | 2691 | 2690 | 5083 | 5082 |
| 749 | 2693 | 2692 | 5085 | 5084 |
| 750 | 2695 | 2694 | 5087 | 5086 |
| 751 | 2697 | 2696 | 5089 | 5088 |

TABLE 4-continued

| ORF-Gen-set | ORFoligosFd | ORFoligosFp | ORFoligosBd | ORFoligosBp |
|---|---|---|---|---|
| 752 | 2699 | 2698 | 5091 | 5090 |
| 753 | 2701 | 2700 | 5093 | 5092 |
| 754 | 2703 | 2702 | 5095 | 5094 |
| 755 | 2705 | 2704 | 5097 | 5096 |
| 756 | 2707 | 2706 | 5099 | 5098 |
| 757 | 2709 | 2708 | 5101 | 5100 |
| 758 | 2711 | 2710 | 5103 | 5102 |
| 759 | 2713 | 2712 | 5105 | 5104 |
| 760 | 2715 | 2714 | 5107 | 5106 |
| 761 | 2717 | 2716 | 5109 | 5108 |
| 762 | 2719 | 2718 | 5111 | 5110 |
| 763 | 2721 | 2720 | 5113 | 5112 |
| 764 | 2723 | 2722 | 5115 | 5114 |
| 765 | 2725 | 2724 | 5117 | 5116 |
| 766 | 2727 | 2726 | 5119 | 5118 |
| 767 | 2729 | 2728 | 5121 | 5120 |
| 768 | 2731 | 2730 | 5123 | 5122 |
| 769 | 2733 | 2732 | 5125 | 5124 |
| 770 | 2735 | 2734 | 5127 | 5126 |
| 771 | 2737 | 2736 | 5129 | 5128 |
| 772 | 2739 | 2738 | 5131 | 5130 |
| 773 | 2741 | 2740 | 5133 | 5132 |
| 774 | 2743 | 2742 | 5135 | 5134 |
| 775 | 2745 | 2744 | 5137 | 5136 |
| 776 | 2747 | 2746 | 5139 | 5138 |
| 777 | 2749 | 2748 | 5141 | 5140 |
| 778 | 2751 | 2750 | 5143 | 5142 |
| 779 | 2753 | 2752 | 5145 | 5144 |
| 780 | 2755 | 2754 | 5147 | 5146 |
| 781 | 2757 | 2756 | 5149 | 5148 |
| 782 | 2759 | 2758 | 5151 | 5150 |
| 783 | 2761 | 2760 | 5153 | 5152 |
| 784 | 2763 | 2762 | 5155 | 5154 |
| 785 | 2765 | 2764 | 5157 | 5156 |
| 786 | 2767 | 2766 | 5159 | 5158 |
| 787 | 2769 | 2768 | 5161 | 5160 |
| 788 | 2771 | 2770 | 5163 | 5162 |
| 789 | 2773 | 2772 | 5165 | 5164 |
| 790 | 2775 | 2774 | 5167 | 5166 |
| 791 | 2777 | 2776 | 5169 | 5168 |
| 792 | 2779 | 2778 | 5171 | 5170 |
| 793 | 2781 | 2780 | 5173 | 5172 |
| 794 | 2783 | 2782 | 5175 | 5174 |
| 795 | 2785 | 2784 | 5177 | 5176 |
| 796 | 2787 | 2786 | 5179 | 5178 |
| 797 | 2789 | 2788 | 5181 | 5180 |
| 798 | 2791 | 2790 | 5183 | 5182 |
| 799 | 2793 | 2792 | 5185 | 5184 |
| 800 | 2795 | 2794 | 5187 | 5186 |
| 801 | 2797 | 2796 | 5189 | 5188 |
| 802 | 2799 | 2798 | 5191 | 5190 |
| 803 | 2801 | 2800 | 5193 | 5192 |
| 804 | 2803 | 2802 | 5195 | 5194 |
| 805 | 2805 | 2804 | 5197 | 5196 |
| 806 | 2807 | 2806 | 5199 | 5198 |
| 807 | 2809 | 2808 | 5201 | 5200 |
| 808 | 2811 | 2810 | 5203 | 5202 |
| 809 | 2813 | 2812 | 5205 | 5204 |
| 810 | 2815 | 2814 | 5207 | 5206 |
| 811 | 2817 | 2816 | 5209 | 5208 |
| 812 | 2819 | 2818 | 5211 | 5210 |
| 813 | 2821 | 2820 | 5213 | 5212 |
| 814 | 2823 | 2822 | 5215 | 5214 |
| 815 | 2825 | 2824 | 5217 | 5216 |
| 816 | 2827 | 2826 | 5219 | 5218 |
| 817 | 2829 | 2828 | 5221 | 5220 |
| 818 | 2831 | 2830 | 5223 | 5222 |
| 819 | 2833 | 2832 | 5225 | 5224 |
| 820 | 2835 | 2834 | 5227 | 5226 |
| 821 | 2837 | 2836 | 5229 | 5228 |
| 822 | 2839 | 2838 | 5231 | 5230 |
| 823 | 2841 | 2840 | 5233 | 5232 |
| 824 | 2843 | 2842 | 5235 | 5234 |
| 825 | 2845 | 2844 | 5237 | 5236 |
| 826 | 2847 | 2846 | 5239 | 5238 |

TABLE 4-continued

| ORF-Gen-set | ORFoligosFd | ORFoligosFp | ORFoligosBd | ORFoligosBp |
|---|---|---|---|---|
| 827 | 2849 | 2848 | 5241 | 5240 |
| 828 | 2851 | 2850 | 5243 | 5242 |
| 829 | 2853 | 2852 | 5245 | 5244 |
| 830 | 2855 | 2854 | 5247 | 5246 |
| 831 | 2857 | 2856 | 5249 | 5248 |
| 832 | 2859 | 2858 | 5251 | 5250 |
| 833 | 2861 | 2860 | 5253 | 5252 |
| 834 | 2863 | 2862 | 5255 | 5254 |
| 835 | 2865 | 2864 | 5257 | 5256 |
| 836 | 2867 | 2866 | 5259 | 5258 |
| 837 | 2869 | 2868 | 5261 | 5260 |
| 838 | 2871 | 2870 | 5263 | 5262 |
| 839 | 2873 | 2872 | 5265 | 5264 |
| 840 | 2875 | 2874 | 5267 | 5266 |
| 841 | 2877 | 2876 | 5269 | 5268 |
| 842 | 2879 | 2878 | 5271 | 5270 |
| 843 | 2881 | 2880 | 5273 | 5272 |
| 844 | 2883 | 2882 | 5275 | 5274 |
| 845 | 2885 | 2884 | 5277 | 5276 |
| 846 | 2887 | 2886 | 5279 | 5278 |
| 847 | 2889 | 2888 | 5281 | 5280 |
| 848 | 2891 | 2890 | 5283 | 5282 |
| 849 | 2893 | 2892 | 5285 | 5284 |
| 850 | 2895 | 2894 | 5287 | 5286 |
| 851 | 2897 | 2896 | 5289 | 5288 |
| 852 | 2899 | 2898 | 5291 | 5290 |
| 853 | 2901 | 2900 | 5293 | 5292 |
| 854 | 2903 | 2902 | 5295 | 5294 |
| 855 | 2905 | 2904 | 5297 | 5296 |
| 856 | 2907 | 2906 | 5299 | 5298 |
| 857 | 2909 | 2908 | 5301 | 5300 |
| 858 | 2911 | 2910 | 5303 | 5302 |
| 859 | 2913 | 2912 | 5305 | 5304 |
| 860 | 2915 | 2914 | 5307 | 5306 |
| 861 | 2917 | 2916 | 5309 | 5308 |
| 862 | 2919 | 2918 | 5311 | 5310 |
| 863 | 2921 | 2920 | 5313 | 5312 |
| 864 | 2923 | 2922 | 5315 | 5314 |
| 865 | 2925 | 2924 | 5317 | 5316 |
| 866 | 2927 | 2926 | 5319 | 5318 |
| 867 | 2929 | 2928 | 5321 | 5320 |
| 868 | 2931 | 2930 | 5323 | 5322 |
| 869 | 2933 | 2932 | 5325 | 5324 |
| 870 | 2935 | 2934 | 5327 | 5326 |
| 871 | 2937 | 2936 | 5329 | 5328 |
| 872 | 2939 | 2938 | 5331 | 5330 |
| 873 | 2941 | 2940 | 5333 | 5332 |
| 874 | 2943 | 2942 | 5335 | 5334 |
| 875 | 2945 | 2944 | 5337 | 5336 |
| 876 | 2947 | 2946 | 5339 | 5338 |
| 877 | 2949 | 2948 | 5341 | 5340 |
| 878 | 2951 | 2950 | 5343 | 5342 |
| 879 | 2953 | 2952 | 5345 | 5344 |
| 880 | 2955 | 2954 | 5347 | 5346 |
| 881 | 2957 | 2956 | 5349 | 5348 |
| 882 | 2959 | 2958 | 5351 | 5350 |
| 883 | 2961 | 2960 | 5353 | 5352 |
| 884 | 2963 | 2962 | 5355 | 5354 |
| 885 | 2965 | 2964 | 5357 | 5356 |
| 886 | 2967 | 2966 | 5359 | 5358 |
| 887 | 2969 | 2968 | 5361 | 5360 |
| 888 | 2971 | 2970 | 5363 | 5362 |
| 889 | 2973 | 2972 | 5365 | 5364 |
| 890 | 2975 | 2974 | 5367 | 5366 |
| 891 | 2977 | 2976 | 5369 | 5368 |
| 892 | 2979 | 2978 | 5371 | 5370 |
| 893 | 2981 | 2980 | 5373 | 5372 |
| 894 | 2983 | 2982 | 5375 | 5374 |
| 895 | 2985 | 2984 | 5377 | 5376 |
| 896 | 2987 | 2986 | 5379 | 5378 |
| 897 | 2989 | 2988 | 5381 | 5380 |
| 898 | 2991 | 2990 | 5383 | 5382 |
| 899 | 2993 | 2992 | 5385 | 5384 |
| 900 | 2995 | 2994 | 5387 | 5386 |
| 901 | 2997 | 2996 | 5389 | 5388 |

TABLE 4-continued

| ORF-Gen-set | ORFoligosFd | ORFoligosFp | ORFoligosBd | ORFoligosBp |
|---|---|---|---|---|
| 902 | 2999 | 2998 | 5391 | 5390 |
| 903 | 3001 | 3000 | 5393 | 5392 |
| 904 | 3003 | 3002 | 5395 | 5394 |
| 905 | 3005 | 3004 | 5397 | 5396 |
| 906 | 3007 | 3006 | 5399 | 5398 |
| 907 | 3009 | 3008 | 5401 | 5400 |
| 908 | 3011 | 3010 | 5403 | 5402 |
| 909 | 3013 | 3012 | 5405 | 5404 |
| 910 | 3015 | 3014 | 5407 | 5406 |
| 911 | 3017 | 3016 | 5409 | 5408 |
| 912 | 3019 | 3018 | 5411 | 5410 |
| 913 | 3021 | 3020 | 5413 | 5412 |
| 914 | 3023 | 3022 | 5415 | 5414 |
| 915 | 3025 | 3024 | 5417 | 5416 |
| 916 | 3027 | 3026 | 5419 | 5418 |
| 917 | 3029 | 3028 | 5421 | 5420 |
| 918 | 3031 | 3030 | 5423 | 5422 |
| 919 | 3033 | 3032 | 5425 | 5424 |
| 920 | 3035 | 3034 | 5427 | 5426 |
| 921 | 3037 | 3036 | 5429 | 5428 |
| 922 | 3039 | 3038 | 5431 | 5430 |
| 923 | 3041 | 3040 | 5433 | 5432 |
| 924 | 3043 | 3042 | 5435 | 5434 |
| 925 | 3045 | 3044 | 5437 | 5436 |
| 926 | 3047 | 3046 | 5439 | 5438 |
| 927 | 3049 | 3048 | 5441 | 5440 |
| 928 | 3051 | 3050 | 5443 | 5442 |
| 929 | 3053 | 3052 | 5445 | 5444 |
| 930 | 3055 | 3054 | 5447 | 5446 |
| 931 | 3057 | 3056 | 5449 | 5448 |
| 932 | 3059 | 3058 | 5451 | 5450 |
| 933 | 3061 | 3060 | 5453 | 5452 |
| 934 | 3063 | 3062 | 5455 | 5454 |
| 935 | 3065 | 3064 | 5457 | 5456 |
| 936 | 3067 | 3066 | 5459 | 5458 |
| 937 | 3069 | 3068 | 5461 | 5460 |
| 938 | 3071 | 3070 | 5463 | 5462 |
| 939 | 3073 | 3072 | 5465 | 5464 |
| 940 | 3075 | 3074 | 5467 | 5466 |
| 941 | 3077 | 3076 | 5469 | 5468 |
| 942 | 3079 | 3078 | 5471 | 5470 |
| 943 | 3081 | 3080 | 5473 | 5472 |
| 944 | 3083 | 3082 | 5475 | 5474 |
| 945 | 3085 | 3084 | 5477 | 5476 |
| 946 | 3087 | 3086 | 5479 | 5478 |
| 947 | 3089 | 3088 | 5481 | 5480 |
| 948 | 3091 | 3090 | 5483 | 5482 |
| 949 | 3093 | 3092 | 5485 | 5484 |
| 950 | 3095 | 3094 | 5487 | 5486 |
| 951 | 3097 | 3096 | 5489 | 5488 |
| 952 | 3099 | 3098 | 5491 | 5490 |
| 953 | 3101 | 3100 | 5493 | 5492 |
| 954 | 3103 | 3102 | 5495 | 5494 |
| 955 | 3105 | 3104 | 5497 | 5496 |
| 956 | 3107 | 3106 | 5499 | 5498 |
| 957 | 3109 | 3108 | 5501 | 5500 |
| 958 | 3111 | 3110 | 5503 | 5502 |
| 959 | 3113 | 3112 | 5505 | 5504 |
| 960 | 3115 | 3114 | 5507 | 5506 |
| 961 | 3117 | 3116 | 5509 | 5508 |
| 962 | 3119 | 3118 | 5511 | 5510 |
| 963 | 3121 | 3120 | 5513 | 5512 |
| 964 | 3123 | 3122 | 5515 | 5514 |
| 965 | 3125 | 3124 | 5517 | 5516 |
| 966 | 3127 | 3126 | 5519 | 5518 |
| 967 | 3129 | 3128 | 5521 | 5520 |
| 968 | 3131 | 3130 | 5523 | 5522 |
| 969 | 3133 | 3132 | 5525 | 5524 |
| 970 | 3135 | 3134 | 5527 | 5526 |
| 971 | 3137 | 3136 | 5529 | 5528 |
| 972 | 3139 | 3138 | 5531 | 5530 |
| 973 | 3141 | 3140 | 5533 | 5532 |
| 974 | 3143 | 3142 | 5535 | 5534 |
| 975 | 3145 | 3144 | 5537 | 5536 |
| 976 | 3147 | 3146 | 5539 | 5538 |
| 977 | 3149 | 3148 | 5541 | 5540 |
| 978 | 3151 | 3150 | 5543 | 5542 |
| 979 | 3153 | 3152 | 5545 | 5544 |
| 980 | 3155 | 3154 | 5547 | 5546 |
| 981 | 3157 | 3156 | 5549 | 5548 |
| 982 | 3159 | 3158 | 5551 | 5550 |
| 983 | 3161 | 3160 | 5553 | 5552 |
| 984 | 3163 | 3162 | 5555 | 5554 |
| 985 | 3165 | 3164 | 5557 | 5556 |
| 986 | 3167 | 3166 | 5559 | 5558 |
| 987 | 3169 | 3168 | 5561 | 5560 |
| 988 | 3171 | 3170 | 5563 | 5562 |
| 989 | 3173 | 3172 | 5565 | 5564 |
| 990 | 3175 | 3174 | 5567 | 5566 |
| 991 | 3177 | 3176 | 5569 | 5568 |
| 992 | 3179 | 3178 | 5571 | 5570 |
| 993 | 3181 | 3180 | 5573 | 5572 |
| 994 | 3183 | 3182 | 5575 | 5574 |
| 995 | 3185 | 3184 | 5577 | 5576 |
| 996 | 3187 | 3186 | 5579 | 5578 |
| 997 | 3189 | 3188 | 5581 | 5580 |
| 998 | 3191 | 3190 | 5583 | 5582 |
| 999 | 3193 | 3192 | 5585 | 5584 |
| 1000 | 3195 | 3194 | 5587 | 5586 |
| 1001 | 3197 | 3196 | 5589 | 5588 |
| 1002 | 3199 | 3198 | 5591 | 5590 |
| 1003 | 3201 | 3200 | 5593 | 5592 |
| 1004 | 3203 | 3202 | 5595 | 5594 |
| 1005 | 3205 | 3204 | 5597 | 5596 |
| 1006 | 3207 | 3206 | 5599 | 5598 |
| 1007 | 3209 | 3208 | 5601 | 5600 |
| 1008 | 3211 | 3210 | 5603 | 5602 |
| 1009 | 3213 | 3212 | 5605 | 5604 |
| 1010 | 3215 | 3214 | 5607 | 5606 |
| 1011 | 3217 | 3216 | 5609 | 5608 |
| 1012 | 3219 | 3218 | 5611 | 5610 |
| 1013 | 3221 | 3220 | 5613 | 5612 |
| 1014 | 3223 | 3222 | 5615 | 5614 |
| 1015 | 3225 | 3224 | 5617 | 5616 |
| 1016 | 3227 | 3226 | 5619 | 5618 |
| 1017 | 3229 | 3228 | 5621 | 5620 |
| 1018 | 3231 | 3230 | 5623 | 5622 |
| 1019 | 3233 | 3232 | 5625 | 5624 |
| 1020 | 3235 | 3234 | 5627 | 5626 |
| 1021 | 3237 | 3236 | 5629 | 5628 |
| 1022 | 3239 | 3238 | 5631 | 5630 |
| 1023 | 3241 | 3240 | 5633 | 5632 |
| 1024 | 3243 | 3242 | 5635 | 5634 |
| 1025 | 3245 | 3244 | 5637 | 5636 |
| 1026 | 3247 | 3246 | 5639 | 5638 |
| 1027 | 3249 | 3248 | 5641 | 5640 |
| 1028 | 3251 | 3250 | 5643 | 5642 |
| 1029 | 3253 | 3252 | 5645 | 5644 |
| 1030 | 3255 | 3254 | 5647 | 5646 |
| 1031 | 3257 | 3256 | 5649 | 5648 |
| 1032 | 3259 | 3258 | 5651 | 5650 |
| 1033 | 3261 | 3260 | 5653 | 5652 |
| 1034 | 3263 | 3262 | 5655 | 5654 |
| 1035 | 3265 | 3264 | 5657 | 5656 |
| 1036 | 3267 | 3266 | 5659 | 5658 |
| 1037 | 3269 | 3268 | 5661 | 5660 |
| 1038 | 3271 | 3270 | 5663 | 5662 |
| 1039 | 3273 | 3272 | 5665 | 5664 |
| 1040 | 3275 | 3274 | 5667 | 5666 |
| 1041 | 3277 | 3276 | 5669 | 5668 |
| 1042 | 3279 | 3278 | 5671 | 5670 |
| 1043 | 3281 | 3280 | 5673 | 5672 |
| 1044 | 3283 | 3282 | 5675 | 5674 |
| 1045 | 3285 | 3284 | 5677 | 5676 |
| 1046 | 3287 | 3286 | 5679 | 5678 |
| 1047 | 3289 | 3288 | 5681 | 5680 |
| 1048 | 3291 | 3290 | 5683 | 5682 |
| 1049 | 3293 | 3292 | 5685 | 5684 |
| 1050 | 3295 | 3294 | 5687 | 5686 |
| 1051 | 3297 | 3296 | 5689 | 5688 |

TABLE 4-continued

| ORF-Gen-set | ORFoligosFd | ORFoligosFp | ORFoligosBd | ORFoligosBp |
|---|---|---|---|---|
| 1052 | 3299 | 3298 | 5691 | 5690 |
| 1053 | 3301 | 3300 | 5693 | 5692 |
| 1054 | 3303 | 3302 | 5695 | 5694 |
| 1055 | 3305 | 3304 | 5697 | 5696 |
| 1056 | 3307 | 3306 | 5699 | 5698 |
| 1057 | 3309 | 3308 | 5701 | 5700 |
| 1058 | 3311 | 3310 | 5703 | 5702 |
| 1059 | 3313 | 3312 | 5705 | 5704 |
| 1060 | 3315 | 3314 | 5707 | 5706 |
| 1061 | 3317 | 3316 | 5709 | 5708 |
| 1062 | 3319 | 3318 | 5711 | 5710 |
| 1063 | 3321 | 3320 | 5713 | 5712 |
| 1064 | 3323 | 3322 | 5715 | 5714 |
| 1065 | 3325 | 3324 | 5717 | 5716 |
| 1066 | 3327 | 3326 | 5719 | 5718 |
| 1067 | 3329 | 3328 | 5721 | 5720 |
| 1068 | 3331 | 3330 | 5723 | 5722 |
| 1069 | 3333 | 3332 | 5725 | 5724 |
| 1070 | 3335 | 3334 | 5727 | 5726 |
| 1071 | 3337 | 3336 | 5729 | 5728 |
| 1072 | 3339 | 3338 | 5731 | 5730 |
| 1073 | 3341 | 3340 | 5733 | 5732 |
| 1074 | 3343 | 3342 | 5735 | 5734 |
| 1075 | 3345 | 3344 | 5737 | 5736 |
| 1076 | 3347 | 3346 | 5739 | 5738 |
| 1077 | 3349 | 3348 | 5741 | 5740 |
| 1078 | 3351 | 3350 | 5743 | 5742 |
| 1079 | 3353 | 3352 | 5745 | 5744 |
| 1080 | 3355 | 3354 | 5747 | 5746 |
| 1081 | 3357 | 3356 | 5749 | 5748 |
| 1082 | 3359 | 3358 | 5751 | 5750 |
| 1083 | 3361 | 3360 | 5753 | 5752 |
| 1084 | 3363 | 3362 | 5755 | 5754 |
| 1085 | 3365 | 3364 | 5757 | 5756 |
| 1086 | 3367 | 3366 | 5759 | 5758 |
| 1087 | 3369 | 3368 | 5761 | 5760 |
| 1088 | 3371 | 3370 | 5763 | 5762 |
| 1089 | 3373 | 3372 | 5765 | 5764 |
| 1090 | 3375 | 3374 | 5767 | 5766 |
| 1091 | 3377 | 3376 | 5769 | 5768 |
| 1092 | 3379 | 3378 | 5771 | 5770 |
| 1093 | 3381 | 3380 | 5773 | 5772 |
| 1094 | 3383 | 3382 | 5775 | 5774 |
| 1095 | 3385 | 3384 | 5777 | 5776 |
| 1096 | 3387 | 3386 | 5779 | 5778 |
| 1097 | 3389 | 3388 | 5781 | 5780 |
| 1098 | 3391 | 3390 | 5783 | 5782 |
| 1099 | 3393 | 3392 | 5785 | 5784 |
| 1100 | 3395 | 3394 | 5787 | 5786 |
| 1101 | 3397 | 3396 | 5789 | 5788 |
| 1102 | 3399 | 3398 | 5791 | 5790 |
| 1103 | 3401 | 3400 | 5793 | 5792 |
| 1104 | 3403 | 3402 | 5795 | 5794 |
| 1105 | 3405 | 3404 | 5797 | 5796 |
| 1106 | 3407 | 3406 | 5799 | 5798 |
| 1107 | 3409 | 3408 | 5801 | 5800 |
| 1108 | 3411 | 3410 | 5803 | 5802 |
| 1109 | 3413 | 3412 | 5805 | 5804 |
| 1110 | 3415 | 3414 | 5807 | 5806 |
| 1111 | 3417 | 3416 | 5809 | 5808 |
| 1112 | 3419 | 3418 | 5811 | 5810 |
| 1113 | 3421 | 3420 | 5813 | 5812 |
| 1114 | 3423 | 3422 | 5815 | 5814 |
| 1115 | 3425 | 3424 | 5817 | 5816 |
| 1116 | 3427 | 3426 | 5819 | 5818 |
| 1117 | 3429 | 3428 | 5821 | 5820 |
| 1118 | 3431 | 3430 | 5823 | 5822 |
| 1119 | 3433 | 3432 | 5825 | 5824 |
| 1120 | 3435 | 3434 | 5827 | 5826 |
| 1121 | 3437 | 3436 | 5829 | 5828 |
| 1122 | 3439 | 3438 | 5831 | 5830 |
| 1123 | 3441 | 3440 | 5833 | 5832 |
| 1124 | 3443 | 3442 | 5835 | 5834 |
| 1125 | 3445 | 3444 | 5837 | 5836 |
| 1126 | 3447 | 3446 | 5839 | 5838 |

TABLE 4-continued

| ORF-Gen-set | ORFoligosFd | ORFoligosFp | ORFoligosBd | ORFoligosBp |
|---|---|---|---|---|
| 1127 | 3449 | 3448 | 5841 | 5840 |
| 1128 | 3451 | 3450 | 5843 | 5842 |
| 1129 | 3453 | 3452 | 5845 | 5844 |
| 1130 | 3455 | 3454 | 5847 | 5846 |
| 1131 | 3457 | 3456 | 5849 | 5848 |
| 1132 | 3459 | 3458 | 5851 | 5850 |
| 1133 | 3461 | 3460 | 5853 | 5852 |
| 1134 | 3463 | 3462 | 5855 | 5854 |
| 1135 | 3465 | 3464 | 5857 | 5856 |
| 1136 | 3467 | 3466 | 5859 | 5858 |
| 1137 | 3469 | 3468 | 5861 | 5860 |
| 1138 | 3471 | 3470 | 5863 | 5862 |
| 1139 | 3473 | 3472 | 5865 | 5864 |
| 1140 | 3475 | 3474 | 5867 | 5866 |
| 1141 | 3477 | 3476 | 5869 | 5868 |
| 1142 | 3479 | 3478 | 5871 | 5870 |
| 1143 | 3481 | 3480 | 5873 | 5872 |
| 1144 | 3483 | 3482 | 5875 | 5874 |
| 1145 | 3485 | 3484 | 5877 | 5876 |
| 1146 | 3487 | 3486 | 5879 | 5878 |
| 1147 | 3489 | 3488 | 5881 | 5880 |
| 1148 | 3491 | 3490 | 5883 | 5882 |
| 1149 | 3493 | 3492 | 5885 | 5884 |
| 1150 | 3495 | 3494 | 5887 | 5886 |
| 1151 | 3497 | 3496 | 5889 | 5888 |
| 1152 | 3499 | 3498 | 5891 | 5890 |
| 1153 | 3501 | 3500 | 5893 | 5892 |
| 1154 | 3503 | 3502 | 5895 | 5894 |
| 1155 | 3505 | 3504 | 5897 | 5896 |
| 1156 | 3507 | 3506 | 5899 | 5898 |
| 1157 | 3509 | 3508 | 5901 | 5900 |
| 1158 | 3511 | 3510 | 5903 | 5902 |
| 1159 | 3513 | 3512 | 5905 | 5904 |
| 1160 | 3515 | 3514 | 5907 | 5906 |
| 1161 | 3517 | 3516 | 5909 | 5908 |
| 1162 | 3519 | 3518 | 5911 | 5910 |
| 1163 | 3521 | 3520 | 5913 | 5912 |
| 1164 | 3523 | 3522 | 5915 | 5914 |
| 1165 | 3525 | 3524 | 5917 | 5916 |
| 1166 | 3527 | 3526 | 5919 | 5918 |
| 1167 | 3529 | 3528 | 5921 | 5920 |
| 1168 | 3531 | 3530 | 5923 | 5922 |
| 1169 | 3533 | 3532 | 5925 | 5924 |
| 1170 | 3535 | 3534 | 5927 | 5926 |
| 1171 | 3537 | 3536 | 5929 | 5928 |
| 1172 | 3539 | 3538 | 5931 | 5930 |
| 1173 | 3541 | 3540 | 5933 | 5932 |
| 1174 | 3543 | 3542 | 5935 | 5934 |
| 1175 | 3545 | 3544 | 5937 | 5936 |
| 1176 | 3547 | 3546 | 5939 | 5938 |
| 1177 | 3549 | 3548 | 5941 | 5940 |
| 1178 | 3551 | 3550 | 5943 | 5942 |
| 1179 | 3553 | 3552 | 5945 | 5944 |
| 1180 | 3555 | 3554 | 5947 | 5946 |
| 1181 | 3557 | 3556 | 5949 | 5948 |
| 1182 | 3559 | 3558 | 5951 | 5950 |
| 1183 | 3561 | 3560 | 5953 | 5952 |
| 1184 | 3563 | 3562 | 5955 | 5954 |
| 1185 | 3565 | 3564 | 5957 | 5956 |
| 1186 | 3567 | 3566 | 5959 | 5958 |
| 1187 | 3569 | 3568 | 5961 | 5960 |
| 1188 | 3571 | 3570 | 5963 | 5962 |
| 1189 | 3573 | 3572 | 5965 | 5964 |
| 1190 | 3575 | 3574 | 5967 | 5966 |
| 1191 | 3577 | 3576 | 5969 | 5968 |
| 1192 | 3579 | 3578 | 5971 | 5970 |
| 1193 | 3581 | 3580 | 5973 | 5972 |
| 1194 | 3583 | 3582 | 5975 | 5974 |
| 1195 | 3585 | 3584 | 5977 | 5976 |
| 1196 | 3587 | 3586 | 5979 | 5978 |
| 1197 | 3589 | 3588 | 5981 | 5980 |

TABLE 5

| SEQ ID | Or. | position |
|---|---|---|
| 1198 | F | 1038449 |
| 1199 | F | 1036517 |
| 1200 | F | 250 |
| 1201 | F | 1036965 |
| 1202 | F | 3011 |
| 1203 | F | 1123 |
| 1204 | F | 4907 |
| 1205 | F | 2996 |
| 1206 | F | 6379 |
| 1207 | F | 4483 |
| 1208 | F | 7837 |
| 1209 | F | 5961 |
| 1210 | F | 8351 |
| 1211 | F | 6467 |
| 1212 | F | 8705 |
| 1213 | F | 6834 |
| 1214 | F | 9598 |
| 1215 | F | 7709 |
| 1216 | F | 10134 |
| 1217 | F | 8248 |
| 1218 | F | 10990 |
| 1219 | F | 9060 |
| 1220 | F | 11823 |
| 1221 | F | 9946 |
| 1222 | F | 13236 |
| 1223 | F | 11410 |
| 1224 | F | 14529 |
| 1225 | F | 12643 |
| 1226 | F | 14668 |
| 1227 | F | 12813 |
| 1228 | F | 15747 |
| 1229 | F | 13844 |
| 1230 | F | 15903 |
| 1231 | F | 14019 |
| 1232 | F | 17198 |
| 1233 | F | 15298 |
| 1234 | F | 18218 |
| 1235 | F | 16263 |
| 1236 | F | 20595 |
| 1237 | F | 18692 |
| 1238 | F | 21932 |
| 1239 | F | 19969 |
| 1240 | F | 22259 |
| 1241 | F | 20338 |
| 1242 | F | 22605 |
| 1243 | F | 20659 |
| 1244 | F | 22890 |
| 1245 | F | 20987 |
| 1246 | F | 23150 |
| 1247 | F | 21244 |
| 1248 | F | 24413 |
| 1249 | F | 22506 |
| 1250 | F | 26379 |
| 1251 | F | 24476 |
| 1252 | F | 27498 |
| 1253 | F | 25602 |
| 1254 | F | 28476 |
| 1255 | F | 26621 |
| 1256 | F | 29785 |
| 1257 | F | 27860 |
| 1258 | F | 30276 |
| 1259 | F | 28363 |
| 1260 | F | 31184 |
| 1261 | F | 29287 |
| 1262 | F | 31574 |
| 1263 | F | 29650 |
| 1264 | F | 33095 |
| 1265 | F | 31184 |
| 1266 | F | 33840 |
| 1267 | F | 31949 |
| 1268 | F | 34769 |
| 1269 | F | 32869 |
| 1270 | F | 34915 |
| 1271 | F | 32961 |
| 1272 | F | 35696 |
| 1273 | F | 33793 |
| 1274 | F | 36794 |

TABLE 5-continued

| SEQ ID | Or. | position |
|---|---|---|
| 1275 | F | 34893 |
| 1276 | F | 37960 |
| 1277 | F | 36085 |
| 1278 | F | 38924 |
| 1279 | F | 37017 |
| 1280 | F | 39704 |
| 1281 | F | 37754 |
| 1282 | F | 40541 |
| 1283 | F | 38615 |
| 1284 | F | 41945 |
| 1285 | F | 40054 |
| 1286 | F | 42779 |
| 1287 | F | 40859 |
| 1288 | F | 43991 |
| 1289 | F | 42061 |
| 1290 | F | 45056 |
| 1291 | F | 43155 |
| 1292 | F | 45755 |
| 1293 | F | 43821 |
| 1294 | F | 46272 |
| 1295 | F | 44382 |
| 1296 | F | 46654 |
| 1297 | F | 44763 |
| 1298 | F | 47926 |
| 1299 | F | 46059 |
| 1300 | F | 48403 |
| 1301 | F | 46485 |
| 1302 | F | 49871 |
| 1303 | F | 47980 |
| 1304 | F | 50706 |
| 1305 | F | 48792 |
| 1306 | F | 52129 |
| 1307 | F | 50199 |
| 1308 | F | 53247 |
| 1309 | F | 51346 |
| 1310 | F | 54376 |
| 1311 | F | 52462 |
| 1312 | F | 54790 |
| 1313 | F | 52890 |
| 1314 | F | 55404 |
| 1315 | F | 53540 |
| 1316 | F | 56602 |
| 1317 | F | 54695 |
| 1318 | F | 58151 |
| 1319 | F | 56284 |
| 1320 | F | 58965 |
| 1321 | F | 57039 |
| 1322 | F | 59955 |
| 1323 | F | 58032 |
| 1324 | F | 61247 |
| 1325 | F | 59364 |
| 1326 | F | 62249 |
| 1327 | F | 60375 |
| 1328 | F | 63117 |
| 1329 | F | 61247 |
| 1330 | F | 63829 |
| 1331 | F | 61908 |
| 1332 | F | 64066 |
| 1333 | F | 62136 |
| 1334 | F | 64369 |
| 1335 | F | 62437 |
| 1336 | F | 65124 |
| 1337 | F | 63225 |
| 1338 | F | 67407 |
| 1339 | F | 65513 |
| 1340 | F | 68652 |
| 1341 | F | 66758 |
| 1342 | F | 68946 |
| 1343 | F | 67080 |
| 1344 | F | 69660 |
| 1345 | F | 67818 |
| 1346 | F | 70432 |
| 1347 | F | 68572 |
| 1348 | F | 70866 |
| 1349 | F | 68946 |
| 1350 | F | 73272 |
| 1351 | F | 71373 |

TABLE 5-continued

| SEQ ID | Or. | position |
|---|---|---|
| 1352 | F | 74657 |
| 1353 | F | 72752 |
| 1354 | F | 75282 |
| 1355 | F | 73383 |
| 1356 | F | 76781 |
| 1357 | F | 74878 |
| 1358 | F | 76925 |
| 1359 | F | 75017 |
| 1360 | F | 77935 |
| 1361 | F | 76028 |
| 1362 | F | 79611 |
| 1363 | F | 77750 |
| 1364 | F | 82371 |
| 1365 | F | 80509 |
| 1366 | F | 83502 |
| 1367 | F | 81655 |
| 1368 | F | 84657 |
| 1369 | F | 82740 |
| 1370 | F | 87093 |
| 1371 | F | 85186 |
| 1372 | F | 87188 |
| 1373 | F | 85320 |
| 1374 | F | 88179 |
| 1375 | F | 86281 |
| 1376 | F | 88486 |
| 1377 | F | 86598 |
| 1378 | F | 89077 |
| 1379 | F | 87236 |
| 1380 | F | 89495 |
| 1381 | F | 87578 |
| 1382 | F | 91202 |
| 1383 | F | 89232 |
| 1384 | F | 91526 |
| 1385 | F | 89598 |
| 1386 | F | 92085 |
| 1387 | F | 90203 |
| 1388 | F | 93104 |
| 1389 | F | 91239 |
| 1390 | F | 93833 |
| 1391 | F | 91938 |
| 1392 | F | 94392 |
| 1393 | F | 92508 |
| 1394 | F | 97894 |
| 1395 | F | 95984 |
| 1396 | F | 98502 |
| 1397 | F | 96620 |
| 1398 | F | 100117 |
| 1399 | F | 98215 |
| 1400 | F | 101104 |
| 1401 | F | 99158 |
| 1402 | F | 101981 |
| 1403 | F | 100080 |
| 1404 | F | 102499 |
| 1405 | F | 100546 |
| 1406 | F | 104014 |
| 1407 | F | 102126 |
| 1408 | F | 105028 |
| 1409 | F | 103092 |
| 1410 | F | 107210 |
| 1411 | F | 105310 |
| 1412 | F | 108446 |
| 1413 | F | 106545 |
| 1414 | F | 108792 |
| 1415 | F | 106853 |
| 1416 | F | 109472 |
| 1417 | F | 107561 |
| 1418 | F | 111060 |
| 1419 | F | 109147 |
| 1420 | F | 112669 |
| 1421 | F | 110796 |
| 1422 | F | 113335 |
| 1423 | F | 111435 |
| 1424 | F | 113733 |
| 1425 | F | 111882 |
| 1426 | F | 114479 |
| 1427 | F | 112580 |
| 1428 | F | 115138 |

TABLE 5-continued

| SEQ ID | Or. | position |
|---|---|---|
| 1429 | F | 113196 |
| 1430 | F | 115765 |
| 1431 | F | 113891 |
| 1432 | F | 119580 |
| 1433 | F | 117660 |
| 1434 | F | 123834 |
| 1435 | F | 121914 |
| 1436 | F | 124649 |
| 1437 | F | 122753 |
| 1438 | F | 125280 |
| 1439 | F | 123416 |
| 1440 | F | 126101 |
| 1441 | F | 124208 |
| 1442 | F | 126871 |
| 1443 | F | 125013 |
| 1444 | F | 127698 |
| 1445 | F | 125787 |
| 1446 | F | 129465 |
| 1447 | F | 127467 |
| 1448 | F | 130799 |
| 1449 | F | 128869 |
| 1450 | F | 131615 |
| 1451 | F | 129711 |
| 1452 | F | 132856 |
| 1453 | F | 130914 |
| 1454 | F | 133401 |
| 1455 | F | 131474 |
| 1456 | F | 133624 |
| 1457 | F | 131706 |
| 1458 | F | 134385 |
| 1459 | F | 132500 |
| 1460 | F | 137183 |
| 1461 | F | 135320 |
| 1462 | F | 140106 |
| 1463 | F | 138215 |
| 1464 | F | 140839 |
| 1465 | F | 138927 |
| 1466 | F | 141535 |
| 1467 | F | 139614 |
| 1468 | F | 142909 |
| 1469 | F | 140952 |
| 1470 | F | 143684 |
| 1471 | F | 141782 |
| 1472 | F | 144309 |
| 1473 | F | 142375 |
| 1474 | F | 146178 |
| 1475 | F | 144294 |
| 1476 | F | 146894 |
| 1477 | F | 144997 |
| 1478 | F | 147858 |
| 1479 | F | 145960 |
| 1480 | F | 148277 |
| 1481 | F | 146347 |
| 1482 | F | 148781 |
| 1483 | F | 146846 |
| 1484 | F | 148947 |
| 1485 | F | 147021 |
| 1486 | F | 149424 |
| 1487 | F | 147592 |
| 1488 | F | 150769 |
| 1489 | F | 148884 |
| 1490 | F | 151743 |
| 1491 | F | 149880 |
| 1492 | F | 152659 |
| 1493 | F | 150769 |
| 1494 | F | 153101 |
| 1495 | F | 151270 |
| 1496 | F | 153719 |
| 1497 | F | 151850 |
| 1498 | F | 155002 |
| 1499 | F | 153096 |
| 1500 | F | 156550 |
| 1501 | F | 154687 |
| 1502 | F | 157206 |
| 1503 | F | 155353 |
| 1504 | F | 158818 |
| 1505 | F | 156924 |

TABLE 5-continued

| SEQ ID | Or. | position |
|---|---|---|
| 1506 | F | 159676 |
| 1507 | F | 157795 |
| 1508 | F | 160957 |
| 1509 | F | 159063 |
| 1510 | F | 161319 |
| 1511 | F | 159504 |
| 1512 | F | 162131 |
| 1513 | F | 160240 |
| 1514 | F | 162775 |
| 1515 | F | 160865 |
| 1516 | F | 164236 |
| 1517 | F | 162345 |
| 1518 | F | 165837 |
| 1519 | F | 163923 |
| 1520 | F | 166508 |
| 1521 | F | 164605 |
| 1522 | F | 168612 |
| 1523 | F | 166683 |
| 1524 | F | 169367 |
| 1525 | F | 167436 |
| 1526 | F | 170556 |
| 1527 | F | 168661 |
| 1528 | F | 171067 |
| 1529 | F | 169173 |
| 1530 | F | 172090 |
| 1531 | F | 170171 |
| 1532 | F | 172797 |
| 1533 | F | 170904 |
| 1534 | F | 174176 |
| 1535 | F | 172236 |
| 1536 | F | 175048 |
| 1537 | F | 173138 |
| 1538 | F | 175476 |
| 1539 | F | 173595 |
| 1540 | F | 177183 |
| 1541 | F | 175275 |
| 1542 | F | 177858 |
| 1543 | F | 175942 |
| 1544 | F | 179819 |
| 1545 | F | 177923 |
| 1546 | F | 180412 |
| 1547 | F | 178455 |
| 1548 | F | 181169 |
| 1549 | F | 179226 |
| 1550 | F | 182628 |
| 1551 | F | 180694 |
| 1552 | F | 183403 |
| 1553 | F | 181494 |
| 1554 | F | 184577 |
| 1555 | F | 182628 |
| 1556 | F | 185763 |
| 1557 | F | 183843 |
| 1558 | F | 186496 |
| 1559 | F | 184614 |
| 1560 | F | 187187 |
| 1561 | F | 185262 |
| 1562 | F | 188542 |
| 1563 | F | 186632 |
| 1564 | F | 189410 |
| 1565 | F | 187514 |
| 1566 | F | 190016 |
| 1567 | F | 188083 |
| 1568 | F | 190545 |
| 1569 | F | 188666 |
| 1570 | F | 191538 |
| 1571 | F | 189595 |
| 1572 | F | 192173 |
| 1573 | F | 190247 |
| 1574 | F | 193015 |
| 1575 | F | 191135 |
| 1576 | F | 194471 |
| 1577 | F | 192522 |
| 1578 | F | 194946 |
| 1579 | F | 193015 |
| 1580 | F | 196798 |
| 1581 | F | 194896 |
| 1582 | F | 197440 |

TABLE 5-continued

| SEQ ID | Or. | position |
|---|---|---|
| 1583 | F | 195550 |
| 1584 | F | 197440 |
| 1585 | F | 195549 |
| 1586 | F | 198736 |
| 1587 | F | 196802 |
| 1588 | F | 199722 |
| 1589 | F | 197822 |
| 1590 | F | 200003 |
| 1591 | F | 198147 |
| 1592 | F | 200361 |
| 1593 | F | 198453 |
| 1594 | F | 200945 |
| 1595 | F | 199009 |
| 1596 | F | 202122 |
| 1597 | F | 200215 |
| 1598 | F | 203251 |
| 1599 | F | 201352 |
| 1600 | F | 203807 |
| 1601 | F | 201903 |
| 1602 | F | 206555 |
| 1603 | F | 204669 |
| 1604 | F | 207269 |
| 1605 | F | 205369 |
| 1606 | F | 208293 |
| 1607 | F | 206395 |
| 1608 | F | 209252 |
| 1609 | F | 207345 |
| 1610 | F | 210330 |
| 1611 | F | 208414 |
| 1612 | F | 210632 |
| 1613 | F | 208694 |
| 1614 | F | 211151 |
| 1615 | F | 209255 |
| 1616 | F | 212650 |
| 1617 | F | 210756 |
| 1618 | F | 213920 |
| 1619 | F | 212036 |
| 1620 | F | 214535 |
| 1621 | F | 212635 |
| 1622 | F | 215003 |
| 1623 | F | 213077 |
| 1624 | F | 216641 |
| 1625 | F | 214772 |
| 1626 | F | 216869 |
| 1627 | F | 214961 |
| 1628 | F | 218145 |
| 1629 | F | 216218 |
| 1630 | F | 218461 |
| 1631 | F | 216576 |
| 1632 | F | 218960 |
| 1633 | F | 217044 |
| 1634 | F | 219646 |
| 1635 | F | 217772 |
| 1636 | F | 220257 |
| 1637 | F | 218379 |
| 1638 | F | 220903 |
| 1639 | F | 218989 |
| 1640 | F | 221314 |
| 1641 | F | 219470 |
| 1642 | F | 222253 |
| 1643 | F | 220338 |
| 1644 | F | 223186 |
| 1645 | F | 221278 |
| 1646 | F | 223994 |
| 1647 | F | 222146 |
| 1648 | F | 224908 |
| 1649 | F | 223014 |
| 1650 | F | 225051 |
| 1651 | F | 223131 |
| 1652 | F | 225510 |
| 1653 | F | 223615 |
| 1654 | F | 226550 |
| 1655 | F | 224609 |
| 1656 | F | 226928 |
| 1657 | F | 225029 |
| 1658 | F | 227528 |
| 1659 | F | 225631 |

TABLE 5-continued

| SEQ ID | Or. | position |
|---|---|---|
| 1660 | F | 228388 |
| 1661 | F | 226475 |
| 1662 | F | 229930 |
| 1663 | F | 228032 |
| 1664 | F | 231129 |
| 1665 | F | 229205 |
| 1666 | F | 232785 |
| 1667 | F | 230915 |
| 1668 | F | 233561 |
| 1669 | F | 231664 |
| 1670 | F | 234013 |
| 1671 | F | 232149 |
| 1672 | F | 234942 |
| 1673 | F | 233061 |
| 1674 | F | 236015 |
| 1675 | F | 234123 |
| 1676 | F | 237945 |
| 1677 | F | 236045 |
| 1678 | F | 238482 |
| 1679 | F | 236599 |
| 1680 | F | 240094 |
| 1681 | F | 238190 |
| 1682 | F | 241713 |
| 1683 | F | 239820 |
| 1684 | F | 242569 |
| 1685 | F | 240653 |
| 1686 | F | 244253 |
| 1687 | F | 242360 |
| 1688 | F | 245693 |
| 1689 | F | 243796 |
| 1690 | F | 246762 |
| 1691 | F | 244825 |
| 1692 | F | 247498 |
| 1693 | F | 245575 |
| 1694 | F | 248343 |
| 1695 | F | 246444 |
| 1696 | F | 249500 |
| 1697 | F | 247625 |
| 1698 | F | 250315 |
| 1699 | F | 248425 |
| 1700 | F | 250832 |
| 1701 | F | 248942 |
| 1702 | F | 251847 |
| 1703 | F | 249939 |
| 1704 | F | 254897 |
| 1705 | F | 252955 |
| 1706 | F | 256543 |
| 1707 | F | 254643 |
| 1708 | F | 257692 |
| 1709 | F | 255790 |
| 1710 | F | 258561 |
| 1711 | F | 256651 |
| 1712 | F | 258927 |
| 1713 | F | 257036 |
| 1714 | F | 261368 |
| 1715 | F | 259469 |
| 1716 | F | 263887 |
| 1717 | F | 262000 |
| 1718 | F | 264503 |
| 1719 | F | 262599 |
| 1720 | F | 265364 |
| 1721 | F | 263512 |
| 1722 | F | 266202 |
| 1723 | F | 264277 |
| 1724 | F | 266709 |
| 1725 | F | 264801 |
| 1726 | F | 267847 |
| 1727 | F | 265947 |
| 1728 | F | 267980 |
| 1729 | F | 266077 |
| 1730 | F | 268271 |
| 1731 | F | 266341 |
| 1732 | F | 269840 |
| 1733 | F | 267913 |
| 1734 | F | 270961 |
| 1735 | F | 269072 |
| 1736 | F | 271883 |

TABLE 5-continued

| SEQ ID | Or. | position |
|---|---|---|
| 1737 | F | 270080 |
| 1738 | F | 272642 |
| 1739 | F | 270748 |
| 1740 | F | 273367 |
| 1741 | F | 271477 |
| 1742 | F | 274562 |
| 1743 | F | 272702 |
| 1744 | F | 275882 |
| 1745 | F | 273984 |
| 1746 | F | 278004 |
| 1747 | F | 276149 |
| 1748 | F | 278747 |
| 1749 | F | 276893 |
| 1750 | F | 279521 |
| 1751 | F | 277632 |
| 1752 | F | 281076 |
| 1753 | F | 279118 |
| 1754 | F | 281551 |
| 1755 | F | 279668 |
| 1756 | F | 282573 |
| 1757 | F | 280663 |
| 1758 | F | 284229 |
| 1759 | F | 282316 |
| 1760 | F | 284598 |
| 1761 | F | 282655 |
| 1762 | F | 285418 |
| 1763 | F | 283518 |
| 1764 | F | 286104 |
| 1765 | F | 284229 |
| 1766 | F | 286456 |
| 1767 | F | 284531 |
| 1768 | F | 287865 |
| 1769 | F | 286008 |
| 1770 | F | 289163 |
| 1771 | F | 287384 |
| 1772 | F | 290609 |
| 1773 | F | 288709 |
| 1774 | F | 291264 |
| 1775 | F | 289389 |
| 1776 | F | 292107 |
| 1777 | F | 290166 |
| 1778 | F | 293099 |
| 1779 | F | 291211 |
| 1780 | F | 294791 |
| 1781 | F | 292883 |
| 1782 | F | 295464 |
| 1783 | F | 293573 |
| 1784 | F | 296018 |
| 1785 | F | 294095 |
| 1786 | F | 297572 |
| 1787 | F | 295664 |
| 1788 | F | 298686 |
| 1789 | F | 296716 |
| 1790 | F | 300305 |
| 1791 | F | 298407 |
| 1792 | F | 301852 |
| 1793 | F | 299946 |
| 1794 | F | 304754 |
| 1795 | F | 302849 |
| 1796 | F | 305854 |
| 1797 | F | 303992 |
| 1798 | F | 306214 |
| 1799 | F | 304303 |
| 1800 | F | 306758 |
| 1801 | F | 304856 |
| 1802 | F | 309057 |
| 1803 | F | 307125 |
| 1804 | F | 309635 |
| 1805 | F | 307750 |
| 1806 | F | 310491 |
| 1807 | F | 308597 |
| 1808 | F | 311753 |
| 1809 | F | 309790 |
| 1810 | F | 313188 |
| 1811 | F | 311292 |
| 1812 | F | 314121 |
| 1813 | F | 312194 |

TABLE 5-continued

| SEQ ID | Or. | position |
|---|---|---|
| 1814 | F | 314489 |
| 1815 | F | 312539 |
| 1816 | F | 315431 |
| 1817 | F | 313526 |
| 1818 | F | 316309 |
| 1819 | F | 314380 |
| 1820 | F | 317102 |
| 1821 | F | 315214 |
| 1822 | F | 317271 |
| 1823 | F | 315343 |
| 1824 | F | 317380 |
| 1825 | F | 315480 |
| 1826 | F | 318256 |
| 1827 | F | 316352 |
| 1828 | F | 319047 |
| 1829 | F | 317181 |
| 1830 | F | 320325 |
| 1831 | F | 318338 |
| 1832 | F | 321228 |
| 1833 | F | 319366 |
| 1834 | F | 321676 |
| 1835 | F | 319782 |
| 1836 | F | 322066 |
| 1837 | F | 320097 |
| 1838 | F | 322910 |
| 1839 | F | 320982 |
| 1840 | F | 324744 |
| 1841 | F | 322849 |
| 1842 | F | 325392 |
| 1843 | F | 323445 |
| 1844 | F | 326217 |
| 1845 | F | 324331 |
| 1846 | F | 327038 |
| 1847 | F | 325162 |
| 1848 | F | 327957 |
| 1849 | F | 326079 |
| 1850 | F | 328458 |
| 1851 | F | 326612 |
| 1852 | F | 329032 |
| 1853 | F | 327173 |
| 1854 | F | 329329 |
| 1855 | F | 327489 |
| 1856 | F | 330446 |
| 1857 | F | 328551 |
| 1858 | F | 330915 |
| 1859 | F | 329032 |
| 1860 | F | 331410 |
| 1861 | F | 329602 |
| 1862 | F | 332534 |
| 1863 | F | 330626 |
| 1864 | F | 332782 |
| 1865 | F | 330879 |
| 1866 | F | 333587 |
| 1867 | F | 331632 |
| 1868 | F | 333870 |
| 1869 | F | 331962 |
| 1870 | F | 334510 |
| 1871 | F | 332594 |
| 1872 | F | 334958 |
| 1873 | F | 333049 |
| 1874 | F | 334958 |
| 1875 | F | 333049 |
| 1876 | F | 335655 |
| 1877 | F | 333766 |
| 1878 | F | 336117 |
| 1879 | F | 334219 |
| 1880 | F | 337108 |
| 1881 | F | 335210 |
| 1882 | F | 340251 |
| 1883 | F | 338372 |
| 1884 | F | 341538 |
| 1885 | F | 339662 |
| 1886 | F | 341953 |
| 1887 | F | 339995 |
| 1888 | F | 342348 |
| 1889 | F | 340450 |
| 1890 | F | 343112 |

TABLE 5-continued

| SEQ ID | Or. | position |
|---|---|---|
| 1891 | F | 341242 |
| 1892 | F | 343736 |
| 1893 | F | 341811 |
| 1894 | F | 344117 |
| 1895 | F | 342207 |
| 1896 | F | 344940 |
| 1897 | F | 343000 |
| 1898 | F | 345837 |
| 1899 | F | 343958 |
| 1900 | F | 346872 |
| 1901 | F | 344994 |
| 1902 | F | 347910 |
| 1903 | F | 345971 |
| 1904 | F | 350124 |
| 1905 | F | 348298 |
| 1906 | F | 351095 |
| 1907 | F | 349167 |
| 1908 | F | 351996 |
| 1909 | F | 350122 |
| 1910 | F | 353051 |
| 1911 | F | 351186 |
| 1912 | F | 353413 |
| 1913 | F | 351481 |
| 1914 | F | 353908 |
| 1915 | F | 351996 |
| 1916 | F | 354723 |
| 1917 | F | 352799 |
| 1918 | F | 356466 |
| 1919 | F | 354569 |
| 1920 | F | 357107 |
| 1921 | F | 355178 |
| 1922 | F | 357767 |
| 1923 | F | 355878 |
| 1924 | F | 360528 |
| 1925 | F | 358628 |
| 1926 | F | 360877 |
| 1927 | F | 358974 |
| 1928 | F | 361573 |
| 1929 | F | 359692 |
| 1930 | F | 362584 |
| 1931 | F | 360681 |
| 1932 | F | 363835 |
| 1933 | F | 361966 |
| 1934 | F | 364960 |
| 1935 | F | 363021 |
| 1936 | F | 365240 |
| 1937 | F | 363360 |
| 1938 | F | 367060 |
| 1939 | F | 365115 |
| 1940 | F | 368383 |
| 1941 | F | 366505 |
| 1942 | F | 368862 |
| 1943 | F | 366963 |
| 1944 | F | 370513 |
| 1945 | F | 368631 |
| 1946 | F | 370974 |
| 1947 | F | 369076 |
| 1948 | F | 372891 |
| 1949 | F | 370980 |
| 1950 | F | 373395 |
| 1951 | F | 371495 |
| 1952 | F | 374005 |
| 1953 | F | 372033 |
| 1954 | F | 374474 |
| 1955 | F | 372572 |
| 1956 | F | 376509 |
| 1957 | F | 374624 |
| 1958 | F | 377630 |
| 1959 | F | 375708 |
| 1960 | F | 378384 |
| 1961 | F | 376507 |
| 1962 | F | 378798 |
| 1963 | F | 376871 |
| 1964 | F | 379413 |
| 1965 | F | 377501 |
| 1966 | F | 379890 |
| 1967 | F | 377989 |

TABLE 5-continued

| SEQ ID | Or. | position |
|---|---|---|
| 1968 | F | 381241 |
| 1969 | F | 379348 |
| 1970 | F | 382485 |
| 1971 | F | 380579 |
| 1972 | F | 383395 |
| 1973 | F | 381536 |
| 1974 | F | 383730 |
| 1975 | F | 381782 |
| 1976 | F | 384948 |
| 1977 | F | 383057 |
| 1978 | F | 385474 |
| 1979 | F | 383532 |
| 1980 | F | 385908 |
| 1981 | F | 384008 |
| 1982 | F | 386643 |
| 1983 | F | 384750 |
| 1984 | F | 387099 |
| 1985 | F | 385204 |
| 1986 | F | 387581 |
| 1987 | F | 385677 |
| 1988 | F | 388009 |
| 1989 | F | 386062 |
| 1990 | F | 388927 |
| 1991 | F | 387033 |
| 1992 | F | 389726 |
| 1993 | F | 387821 |
| 1994 | F | 391295 |
| 1995 | F | 389365 |
| 1996 | F | 392171 |
| 1997 | F | 390291 |
| 1998 | F | 393930 |
| 1999 | F | 392014 |
| 2000 | F | 395085 |
| 2001 | F | 393185 |
| 2002 | F | 395827 |
| 2003 | F | 393940 |
| 2004 | F | 396274 |
| 2005 | F | 394423 |
| 2006 | F | 397156 |
| 2007 | F | 395216 |
| 2008 | F | 398641 |
| 2009 | F | 396790 |
| 2010 | F | 399550 |
| 2011 | F | 397659 |
| 2012 | F | 399797 |
| 2013 | F | 397915 |
| 2014 | F | 401527 |
| 2015 | F | 399623 |
| 2016 | F | 401907 |
| 2017 | F | 399960 |
| 2018 | F | 403017 |
| 2019 | F | 401131 |
| 2020 | F | 403017 |
| 2021 | F | 401131 |
| 2022 | F | 404910 |
| 2023 | F | 403010 |
| 2024 | F | 405728 |
| 2025 | F | 403836 |
| 2026 | F | 406837 |
| 2027 | F | 404932 |
| 2028 | F | 410291 |
| 2029 | F | 408347 |
| 2030 | F | 411488 |
| 2031 | F | 409518 |
| 2032 | F | 412379 |
| 2033 | F | 410487 |
| 2034 | F | 413164 |
| 2035 | F | 411263 |
| 2036 | F | 413606 |
| 2037 | F | 411626 |
| 2038 | F | 413721 |
| 2039 | F | 411859 |
| 2040 | F | 414921 |
| 2041 | F | 413049 |
| 2042 | F | 416517 |
| 2043 | F | 414606 |
| 2044 | F | 417445 |

TABLE 5-continued

| SEQ ID | Or. | position |
|---|---|---|
| 2045 | F | 415557 |
| 2046 | F | 417812 |
| 2047 | F | 415912 |
| 2048 | F | 418381 |
| 2049 | F | 416517 |
| 2050 | F | 419453 |
| 2051 | F | 417447 |
| 2052 | F | 420026 |
| 2053 | F | 418068 |
| 2054 | F | 421270 |
| 2055 | F | 419392 |
| 2056 | F | 422262 |
| 2057 | F | 420364 |
| 2058 | F | 423007 |
| 2059 | F | 421107 |
| 2060 | F | 424834 |
| 2061 | F | 423018 |
| 2062 | F | 426026 |
| 2063 | F | 424110 |
| 2064 | F | 426883 |
| 2065 | F | 425040 |
| 2066 | F | 429303 |
| 2067 | F | 427438 |
| 2068 | F | 429609 |
| 2069 | F | 427737 |
| 2070 | F | 430104 |
| 2071 | F | 428191 |
| 2072 | F | 430622 |
| 2073 | F | 428814 |
| 2074 | F | 431439 |
| 2075 | F | 429537 |
| 2076 | F | 431968 |
| 2077 | F | 430108 |
| 2078 | F | 434401 |
| 2079 | F | 432485 |
| 2080 | F | 436050 |
| 2081 | F | 434134 |
| 2082 | F | 436342 |
| 2083 | F | 434428 |
| 2084 | F | 437672 |
| 2085 | F | 435775 |
| 2086 | F | 438051 |
| 2087 | F | 436165 |
| 2088 | F | 438767 |
| 2089 | F | 436866 |
| 2090 | F | 439139 |
| 2091 | F | 437145 |
| 2092 | F | 439479 |
| 2093 | F | 437574 |
| 2094 | F | 440823 |
| 2095 | F | 438923 |
| 2096 | F | 441668 |
| 2097 | F | 439746 |
| 2098 | F | 444271 |
| 2099 | F | 442371 |
| 2100 | F | 446233 |
| 2101 | F | 444302 |
| 2102 | F | 447687 |
| 2103 | F | 445803 |
| 2104 | F | 450318 |
| 2105 | F | 448399 |
| 2106 | F | 450876 |
| 2107 | F | 449025 |
| 2108 | F | 451274 |
| 2109 | F | 449397 |
| 2110 | F | 452413 |
| 2111 | F | 450513 |
| 2112 | F | 453303 |
| 2113 | F | 451427 |
| 2114 | F | 454713 |
| 2115 | F | 452853 |
| 2116 | F | 455096 |
| 2117 | F | 453248 |
| 2118 | F | 455808 |
| 2119 | F | 453928 |
| 2120 | F | 457440 |
| 2121 | F | 455488 |

TABLE 5-continued

| SEQ ID | Or. | position |
|---|---|---|
| 2122 | F | 458282 |
| 2123 | F | 456354 |
| 2124 | F | 459558 |
| 2125 | F | 457686 |
| 2126 | F | 460960 |
| 2127 | F | 459060 |
| 2128 | F | 461659 |
| 2129 | F | 459758 |
| 2130 | F | 462674 |
| 2131 | F | 460775 |
| 2132 | F | 463788 |
| 2133 | F | 461895 |
| 2134 | F | 464479 |
| 2135 | F | 462602 |
| 2136 | F | 465882 |
| 2137 | F | 463989 |
| 2138 | F | 467200 |
| 2139 | F | 465300 |
| 2140 | F | 468680 |
| 2141 | F | 466787 |
| 2142 | F | 469130 |
| 2143 | F | 467224 |
| 2144 | F | 469572 |
| 2145 | F | 467707 |
| 2146 | F | 470887 |
| 2147 | F | 468984 |
| 2148 | F | 471590 |
| 2149 | F | 469835 |
| 2150 | F | 473033 |
| 2151 | F | 471133 |
| 2152 | F | 473761 |
| 2153 | F | 471861 |
| 2154 | F | 474383 |
| 2155 | F | 472478 |
| 2156 | F | 475333 |
| 2157 | F | 473465 |
| 2158 | F | 476279 |
| 2159 | F | 474390 |
| 2160 | F | 478446 |
| 2161 | F | 476546 |
| 2162 | F | 478869 |
| 2163 | F | 476918 |
| 2164 | F | 479441 |
| 2165 | F | 477548 |
| 2166 | F | 479676 |
| 2167 | F | 477775 |
| 2168 | F | 481277 |
| 2169 | F | 479377 |
| 2170 | F | 481635 |
| 2171 | F | 479745 |
| 2172 | F | 483172 |
| 2173 | F | 481279 |
| 2174 | F | 484659 |
| 2175 | F | 482764 |
| 2176 | F | 485003 |
| 2177 | F | 483097 |
| 2178 | F | 487946 |
| 2179 | F | 486083 |
| 2180 | F | 487946 |
| 2181 | F | 486093 |
| 2182 | F | 489220 |
| 2183 | F | 487274 |
| 2184 | F | 490276 |
| 2185 | F | 488388 |
| 2186 | F | 492138 |
| 2187 | F | 490229 |
| 2188 | F | 492475 |
| 2189 | F | 490618 |
| 2190 | F | 493591 |
| 2191 | F | 491719 |
| 2192 | F | 494297 |
| 2193 | F | 492436 |
| 2194 | F | 494530 |
| 2195 | F | 492679 |
| 2196 | F | 494637 |
| 2197 | F | 492753 |
| 2198 | F | 495467 |

TABLE 5-continued

| SEQ ID | Or. | position |
|---|---|---|
| 2199 | F | 493559 |
| 2200 | F | 496076 |
| 2201 | F | 494126 |
| 2202 | F | 497468 |
| 2203 | F | 495569 |
| 2204 | F | 498050 |
| 2205 | F | 496160 |
| 2206 | F | 498994 |
| 2207 | F | 497096 |
| 2208 | F | 500571 |
| 2209 | F | 498671 |
| 2210 | F | 501547 |
| 2211 | F | 499671 |
| 2212 | F | 502469 |
| 2213 | F | 500572 |
| 2214 | F | 503435 |
| 2215 | F | 501547 |
| 2216 | F | 505469 |
| 2217 | F | 503545 |
| 2218 | F | 506768 |
| 2219 | F | 504880 |
| 2220 | F | 507356 |
| 2221 | F | 505530 |
| 2222 | F | 508015 |
| 2223 | F | 506157 |
| 2224 | F | 508247 |
| 2225 | F | 506351 |
| 2226 | F | 509270 |
| 2227 | F | 507356 |
| 2228 | F | 510759 |
| 2229 | F | 508918 |
| 2230 | F | 511268 |
| 2231 | F | 509359 |
| 2232 | F | 512124 |
| 2233 | F | 510202 |
| 2234 | F | 512836 |
| 2235 | F | 510926 |
| 2236 | F | 514569 |
| 2237 | F | 512663 |
| 2238 | F | 514688 |
| 2239 | F | 512874 |
| 2240 | F | 515334 |
| 2241 | F | 513415 |
| 2242 | F | 515516 |
| 2243 | F | 513670 |
| 2244 | F | 516230 |
| 2245 | F | 514348 |
| 2246 | F | 517181 |
| 2247 | F | 515261 |
| 2248 | F | 517840 |
| 2249 | F | 515977 |
| 2250 | F | 518184 |
| 2251 | F | 516283 |
| 2252 | F | 518704 |
| 2253 | F | 516804 |
| 2254 | F | 519358 |
| 2255 | F | 517404 |
| 2256 | F | 520483 |
| 2257 | F | 518598 |
| 2258 | F | 521632 |
| 2259 | F | 519765 |
| 2260 | F | 521919 |
| 2261 | F | 520024 |
| 2262 | F | 523372 |
| 2263 | F | 521495 |
| 2264 | F | 524404 |
| 2265 | F | 522508 |
| 2266 | F | 525498 |
| 2267 | F | 523600 |
| 2268 | F | 525687 |
| 2269 | F | 523753 |
| 2270 | F | 526036 |
| 2271 | F | 524164 |
| 2272 | F | 526632 |
| 2273 | F | 524732 |
| 2274 | F | 528073 |
| 2275 | F | 526158 |

TABLE 5-continued

| SEQ ID | Or. | position |
|---|---|---|
| 2276 | F | 528835 |
| 2277 | F | 526999 |
| 2278 | F | 529393 |
| 2279 | F | 527504 |
| 2280 | F | 530004 |
| 2281 | F | 528082 |
| 2282 | F | 530518 |
| 2283 | F | 528594 |
| 2284 | F | 532100 |
| 2285 | F | 530224 |
| 2286 | F | 533025 |
| 2287 | F | 531125 |
| 2288 | F | 533710 |
| 2289 | F | 531825 |
| 2290 | F | 534658 |
| 2291 | F | 532758 |
| 2292 | F | 535737 |
| 2293 | F | 533828 |
| 2294 | F | 539456 |
| 2295 | F | 537568 |
| 2296 | F | 540290 |
| 2297 | F | 538375 |
| 2298 | F | 540672 |
| 2299 | F | 538777 |
| 2300 | F | 541573 |
| 2301 | F | 539706 |
| 2302 | F | 542999 |
| 2303 | F | 541102 |
| 2304 | F | 543922 |
| 2305 | F | 542057 |
| 2306 | F | 544268 |
| 2307 | F | 542354 |
| 2308 | F | 544691 |
| 2309 | F | 542785 |
| 2310 | F | 546323 |
| 2311 | F | 544441 |
| 2312 | F | 546467 |
| 2313 | F | 544650 |
| 2314 | F | 547257 |
| 2315 | F | 545357 |
| 2316 | F | 547658 |
| 2317 | F | 545781 |
| 2318 | F | 548406 |
| 2319 | F | 546466 |
| 2320 | F | 549443 |
| 2321 | F | 547527 |
| 2322 | F | 550193 |
| 2323 | F | 548288 |
| 2324 | F | 551554 |
| 2325 | F | 549665 |
| 2326 | F | 552877 |
| 2327 | F | 550963 |
| 2328 | F | 554708 |
| 2329 | F | 552807 |
| 2330 | F | 556293 |
| 2331 | F | 554381 |
| 2332 | F | 557095 |
| 2333 | F | 555164 |
| 2334 | F | 557522 |
| 2335 | F | 555656 |
| 2336 | F | 558021 |
| 2337 | F | 556191 |
| 2338 | F | 558964 |
| 2339 | F | 557076 |
| 2340 | F | 560913 |
| 2341 | F | 559007 |
| 2342 | F | 562832 |
| 2343 | F | 561002 |
| 2344 | F | 563374 |
| 2345 | F | 561474 |
| 2346 | F | 565061 |
| 2347 | F | 563198 |
| 2348 | F | 566840 |
| 2349 | F | 564908 |
| 2350 | F | 567802 |
| 2351 | F | 565896 |
| 2352 | F | 571045 |

TABLE 5-continued

| SEQ ID | Or. | position |
|---|---|---|
| 2353 | F | 569137 |
| 2354 | F | 572300 |
| 2355 | F | 570362 |
| 2356 | F | 572512 |
| 2357 | F | 570612 |
| 2358 | F | 572627 |
| 2359 | F | 570753 |
| 2360 | F | 573416 |
| 2361 | F | 571539 |
| 2362 | F | 573964 |
| 2363 | F | 572065 |
| 2364 | F | 574221 |
| 2365 | F | 572303 |
| 2366 | F | 574704 |
| 2367 | F | 572781 |
| 2368 | F | 574795 |
| 2369 | F | 572936 |
| 2370 | F | 575229 |
| 2371 | F | 573350 |
| 2372 | F | 576318 |
| 2373 | F | 574384 |
| 2374 | F | 577796 |
| 2375 | F | 575893 |
| 2376 | F | 578774 |
| 2377 | F | 576870 |
| 2378 | F | 581976 |
| 2379 | F | 580073 |
| 2380 | F | 582589 |
| 2381 | F | 580679 |
| 2382 | F | 582962 |
| 2383 | F | 581060 |
| 2384 | F | 583210 |
| 2385 | F | 581316 |
| 2386 | F | 583564 |
| 2387 | F | 581697 |
| 2388 | F | 584048 |
| 2389 | F | 582179 |
| 2390 | F | 584797 |
| 2391 | F | 582897 |
| 2392 | F | 584978 |
| 2393 | F | 583031 |
| 2394 | F | 586256 |
| 2395 | F | 584320 |
| 2396 | F | 587527 |
| 2397 | F | 585631 |
| 2398 | F | 588892 |
| 2399 | F | 587052 |
| 2400 | F | 589362 |
| 2401 | F | 587452 |
| 2402 | F | 590516 |
| 2403 | F | 588616 |
| 2404 | F | 592168 |
| 2405 | F | 590235 |
| 2406 | F | 592629 |
| 2407 | F | 590708 |
| 2408 | F | 592901 |
| 2409 | F | 590973 |
| 2410 | F | 593863 |
| 2411 | F | 591990 |
| 2412 | F | 595416 |
| 2413 | F | 593484 |
| 2414 | F | 595935 |
| 2415 | F | 593962 |
| 2416 | F | 597025 |
| 2417 | F | 595158 |
| 2418 | F | 598254 |
| 2419 | F | 596402 |
| 2420 | F | 600515 |
| 2421 | F | 598575 |
| 2422 | F | 601691 |
| 2423 | F | 599745 |
| 2424 | F | 603291 |
| 2425 | F | 601376 |
| 2426 | F | 603538 |
| 2427 | F | 601638 |
| 2428 | F | 604263 |
| 2429 | F | 602388 |

TABLE 5-continued

| SEQ ID | Or. | position |
|---|---|---|
| 2430 | F | 605359 |
| 2431 | F | 603425 |
| 2432 | F | 606622 |
| 2433 | F | 604721 |
| 2434 | F | 607722 |
| 2435 | F | 605908 |
| 2436 | F | 609039 |
| 2437 | F | 607143 |
| 2438 | F | 609842 |
| 2439 | F | 607958 |
| 2440 | F | 611565 |
| 2441 | F | 609657 |
| 2442 | F | 612719 |
| 2443 | F | 610819 |
| 2444 | F | 613473 |
| 2445 | F | 611565 |
| 2446 | F | 614096 |
| 2447 | F | 612172 |
| 2448 | F | 615072 |
| 2449 | F | 613207 |
| 2450 | F | 615645 |
| 2451 | F | 613745 |
| 2452 | F | 617266 |
| 2453 | F | 615347 |
| 2454 | F | 618142 |
| 2455 | F | 616242 |
| 2456 | F | 619019 |
| 2457 | F | 617128 |
| 2458 | F | 619637 |
| 2459 | F | 617695 |
| 2460 | F | 620182 |
| 2461 | F | 618257 |
| 2462 | F | 620929 |
| 2463 | F | 619019 |
| 2464 | F | 621446 |
| 2465 | F | 619529 |
| 2466 | F | 622195 |
| 2467 | F | 620292 |
| 2468 | F | 623244 |
| 2469 | F | 621446 |
| 2470 | F | 623834 |
| 2471 | F | 621954 |
| 2472 | F | 625024 |
| 2473 | F | 623208 |
| 2474 | F | 626291 |
| 2475 | F | 624369 |
| 2476 | F | 626724 |
| 2477 | F | 624821 |
| 2478 | F | 627597 |
| 2479 | F | 625703 |
| 2480 | F | 627927 |
| 2481 | F | 626025 |
| 2482 | F | 628712 |
| 2483 | F | 626787 |
| 2484 | F | 629535 |
| 2485 | F | 627685 |
| 2486 | F | 630055 |
| 2487 | F | 628178 |
| 2488 | F | 630672 |
| 2489 | F | 628789 |
| 2490 | F | 637125 |
| 2491 | F | 635224 |
| 2492 | F | 637807 |
| 2493 | F | 635913 |
| 2494 | F | 639960 |
| 2495 | F | 638102 |
| 2496 | F | 639960 |
| 2497 | F | 638012 |
| 2498 | F | 643252 |
| 2499 | F | 641355 |
| 2500 | F | 644146 |
| 2501 | F | 642204 |
| 2502 | F | 645175 |
| 2503 | F | 643275 |
| 2504 | F | 645519 |
| 2505 | F | 643652 |
| 2506 | F | 646869 |

TABLE 5-continued

| SEQ ID | Or. | position |
|---|---|---|
| 2507 | F | 644983 |
| 2508 | F | 649714 |
| 2509 | F | 647800 |
| 2510 | F | 650199 |
| 2511 | F | 648260 |
| 2512 | F | 651421 |
| 2513 | F | 649536 |
| 2514 | F | 652285 |
| 2515 | F | 650397 |
| 2516 | F | 652562 |
| 2517 | F | 650653 |
| 2518 | F | 659653 |
| 2519 | F | 657741 |
| 2520 | F | 661449 |
| 2521 | F | 659621 |
| 2522 | F | 662058 |
| 2523 | F | 660167 |
| 2524 | F | 662726 |
| 2525 | F | 660831 |
| 2526 | F | 663526 |
| 2527 | F | 661591 |
| 2528 | F | 664035 |
| 2529 | F | 662134 |
| 2530 | F | 665504 |
| 2531 | F | 663591 |
| 2532 | F | 665530 |
| 2533 | F | 663663 |
| 2534 | F | 666606 |
| 2535 | F | 664705 |
| 2536 | F | 667901 |
| 2537 | F | 665987 |
| 2538 | F | 667953 |
| 2539 | F | 666037 |
| 2540 | F | 668397 |
| 2541 | F | 666496 |
| 2542 | F | 669235 |
| 2543 | F | 667366 |
| 2544 | F | 669763 |
| 2545 | F | 667879 |
| 2546 | F | 670513 |
| 2547 | F | 668612 |
| 2548 | F | 670963 |
| 2549 | F | 669058 |
| 2550 | F | 672473 |
| 2551 | F | 670573 |
| 2552 | F | 672985 |
| 2553 | F | 671072 |
| 2554 | F | 674381 |
| 2555 | F | 672493 |
| 2556 | F | 675029 |
| 2557 | F | 673135 |
| 2558 | F | 676254 |
| 2559 | F | 674357 |
| 2560 | F | 677481 |
| 2561 | F | 675559 |
| 2562 | F | 678423 |
| 2563 | F | 676580 |
| 2564 | F | 679049 |
| 2565 | F | 677156 |
| 2566 | F | 680360 |
| 2567 | F | 678423 |
| 2568 | F | 681257 |
| 2569 | F | 679420 |
| 2570 | F | 682281 |
| 2571 | F | 680435 |
| 2572 | F | 682870 |
| 2573 | F | 681012 |
| 2574 | F | 684147 |
| 2575 | F | 682281 |
| 2576 | F | 684582 |
| 2577 | F | 682664 |
| 2578 | F | 685978 |
| 2579 | F | 684033 |
| 2580 | F | 687121 |
| 2581 | F | 685186 |
| 2582 | F | 687974 |
| 2583 | F | 686044 |

TABLE 5-continued

| SEQ ID | Or. | position |
|---|---|---|
| 2584 | F | 688169 |
| 2585 | F | 686313 |
| 2586 | F | 689393 |
| 2587 | F | 687511 |
| 2588 | F | 689580 |
| 2589 | F | 687727 |
| 2590 | F | 690204 |
| 2591 | F | 688342 |
| 2592 | F | 690431 |
| 2593 | F | 688497 |
| 2594 | F | 691790 |
| 2595 | F | 689919 |
| 2596 | F | 693614 |
| 2597 | F | 691704 |
| 2598 | F | 694723 |
| 2599 | F | 692821 |
| 2600 | F | 696922 |
| 2601 | F | 695033 |
| 2602 | F | 697714 |
| 2603 | F | 695816 |
| 2604 | F | 698510 |
| 2605 | F | 696612 |
| 2606 | F | 700037 |
| 2607 | F | 698119 |
| 2608 | F | 700691 |
| 2609 | F | 698783 |
| 2610 | F | 701885 |
| 2611 | F | 699984 |
| 2612 | F | 703303 |
| 2613 | F | 701403 |
| 2614 | F | 704791 |
| 2615 | F | 702877 |
| 2616 | F | 705452 |
| 2617 | F | 703584 |
| 2618 | F | 705918 |
| 2619 | F | 704019 |
| 2620 | F | 706241 |
| 2621 | F | 704322 |
| 2622 | F | 707833 |
| 2623 | F | 705939 |
| 2624 | F | 708029 |
| 2625 | F | 706086 |
| 2626 | F | 708653 |
| 2627 | F | 706753 |
| 2628 | F | 710042 |
| 2629 | F | 708142 |
| 2630 | F | 711185 |
| 2631 | F | 709291 |
| 2632 | F | 712521 |
| 2633 | F | 710641 |
| 2634 | F | 713432 |
| 2635 | F | 711506 |
| 2636 | F | 713901 |
| 2637 | F | 711987 |
| 2638 | F | 714557 |
| 2639 | F | 712708 |
| 2640 | F | 715339 |
| 2641 | F | 713437 |
| 2642 | F | 715702 |
| 2643 | F | 713761 |
| 2644 | F | 716892 |
| 2645 | F | 714970 |
| 2646 | F | 718240 |
| 2647 | F | 716381 |
| 2648 | F | 718240 |
| 2649 | F | 716380 |
| 2650 | F | 719563 |
| 2651 | F | 717658 |
| 2652 | F | 719916 |
| 2653 | F | 718025 |
| 2654 | F | 720346 |
| 2655 | F | 718429 |
| 2656 | F | 721306 |
| 2657 | F | 719440 |
| 2658 | F | 722178 |
| 2659 | F | 720271 |
| 2660 | F | 723159 |

TABLE 5-continued

| SEQ ID | Or. | position |
|---|---|---|
| 2661 | F | 721259 |
| 2662 | F | 724357 |
| 2663 | F | 722451 |
| 2664 | F | 725491 |
| 2665 | F | 723647 |
| 2666 | F | 726312 |
| 2667 | F | 724417 |
| 2668 | F | 726526 |
| 2669 | F | 724590 |
| 2670 | F | 727245 |
| 2671 | F | 725325 |
| 2672 | F | 728081 |
| 2673 | F | 726209 |
| 2674 | F | 728510 |
| 2675 | F | 726618 |
| 2676 | F | 729214 |
| 2677 | F | 727319 |
| 2678 | F | 733006 |
| 2679 | F | 731064 |
| 2680 | F | 734566 |
| 2681 | F | 732618 |
| 2682 | F | 735410 |
| 2683 | F | 733522 |
| 2684 | F | 736226 |
| 2685 | F | 734388 |
| 2686 | F | 736969 |
| 2687 | F | 735092 |
| 2688 | F | 737678 |
| 2689 | F | 735820 |
| 2690 | F | 738618 |
| 2691 | F | 736719 |
| 2692 | F | 739841 |
| 2693 | F | 737941 |
| 2694 | F | 741797 |
| 2695 | F | 739895 |
| 2696 | F | 742583 |
| 2697 | F | 740705 |
| 2698 | F | 743087 |
| 2699 | F | 741169 |
| 2700 | F | 744211 |
| 2701 | F | 742277 |
| 2702 | F | 744391 |
| 2703 | F | 742492 |
| 2704 | F | 744739 |
| 2705 | F | 742813 |
| 2706 | F | 745342 |
| 2707 | F | 743438 |
| 2708 | F | 746197 |
| 2709 | F | 744273 |
| 2710 | F | 746725 |
| 2711 | F | 744784 |
| 2712 | F | 748041 |
| 2713 | F | 746142 |
| 2714 | F | 748723 |
| 2715 | F | 746795 |
| 2716 | F | 749171 |
| 2717 | F | 747310 |
| 2718 | F | 749475 |
| 2719 | F | 747568 |
| 2720 | F | 749761 |
| 2721 | F | 747855 |
| 2722 | F | 752284 |
| 2723 | F | 750384 |
| 2724 | F | 753397 |
| 2725 | F | 751497 |
| 2726 | F | 754693 |
| 2727 | F | 752818 |
| 2728 | F | 756537 |
| 2729 | F | 754648 |
| 2730 | F | 758227 |
| 2731 | F | 756276 |
| 2732 | F | 759119 |
| 2733 | F | 757196 |
| 2734 | F | 759639 |
| 2735 | F | 757745 |
| 2736 | F | 759957 |
| 2737 | F | 758069 |

TABLE 5-continued

| SEQ ID | Or. | position |
|---|---|---|
| 2738 | F | 760675 |
| 2739 | F | 758798 |
| 2740 | F | 761489 |
| 2741 | F | 759589 |
| 2742 | F | 762033 |
| 2743 | F | 760133 |
| 2744 | F | 763116 |
| 2745 | F | 761215 |
| 2746 | F | 764209 |
| 2747 | F | 762315 |
| 2748 | F | 764602 |
| 2749 | F | 762702 |
| 2750 | F | 765834 |
| 2751 | F | 763904 |
| 2752 | F | 766671 |
| 2753 | F | 764806 |
| 2754 | F | 768033 |
| 2755 | F | 766063 |
| 2756 | F | 768572 |
| 2757 | F | 766671 |
| 2758 | F | 769873 |
| 2759 | F | 768006 |
| 2760 | F | 769966 |
| 2761 | F | 768060 |
| 2762 | F | 770411 |
| 2763 | F | 768455 |
| 2764 | F | 771103 |
| 2765 | F | 769211 |
| 2766 | F | 771980 |
| 2767 | F | 770116 |
| 2768 | F | 773176 |
| 2769 | F | 771305 |
| 2770 | F | 773937 |
| 2771 | F | 771980 |
| 2772 | F | 776399 |
| 2773 | F | 774514 |
| 2774 | F | 776672 |
| 2775 | F | 774773 |
| 2776 | F | 777446 |
| 2777 | F | 775596 |
| 2778 | F | 779102 |
| 2779 | F | 777192 |
| 2780 | F | 781078 |
| 2781 | F | 779148 |
| 2782 | F | 782192 |
| 2783 | F | 780236 |
| 2784 | F | 785250 |
| 2785 | F | 783413 |
| 2786 | F | 785324 |
| 2787 | F | 783427 |
| 2788 | F | 786392 |
| 2789 | F | 784488 |
| 2790 | F | 787401 |
| 2791 | F | 785488 |
| 2792 | F | 787693 |
| 2793 | F | 785793 |
| 2794 | F | 789918 |
| 2795 | F | 788039 |
| 2796 | F | 790378 |
| 2797 | F | 788456 |
| 2798 | F | 791834 |
| 2799 | F | 789918 |
| 2800 | F | 793102 |
| 2801 | F | 791176 |
| 2802 | F | 793826 |
| 2803 | F | 791921 |
| 2804 | F | 794911 |
| 2805 | F | 793023 |
| 2806 | F | 795296 |
| 2807 | F | 793427 |
| 2808 | F | 796005 |
| 2809 | F | 794127 |
| 2810 | F | 796729 |
| 2811 | F | 794811 |
| 2812 | F | 797041 |
| 2813 | F | 795065 |
| 2814 | F | 797553 |
| 2815 | F | 795651 |
| 2816 | F | 797716 |
| 2817 | F | 795815 |
| 2818 | F | 798197 |
| 2819 | F | 796285 |
| 2820 | F | 799004 |
| 2821 | F | 797173 |
| 2822 | F | 799785 |
| 2823 | F | 797910 |
| 2824 | F | 800789 |
| 2825 | F | 798866 |
| 2826 | F | 801800 |
| 2827 | F | 799847 |
| 2828 | F | 802561 |
| 2829 | F | 800732 |
| 2830 | F | 802881 |
| 2831 | F | 800926 |
| 2832 | F | 804088 |
| 2833 | F | 802162 |
| 2834 | F | 805071 |
| 2835 | F | 803150 |
| 2836 | F | 806224 |
| 2837 | F | 804333 |
| 2838 | F | 807742 |
| 2839 | F | 805907 |
| 2840 | F | 808860 |
| 2841 | F | 806959 |
| 2842 | F | 810074 |
| 2843 | F | 808209 |
| 2844 | F | 811442 |
| 2845 | F | 809555 |
| 2846 | F | 812088 |
| 2847 | F | 810158 |
| 2848 | F | 813225 |
| 2849 | F | 811336 |
| 2850 | F | 813512 |
| 2851 | F | 811473 |
| 2852 | F | 814095 |
| 2853 | F | 812185 |
| 2854 | F | 814173 |
| 2855 | F | 812276 |
| 2856 | F | 815188 |
| 2857 | F | 813268 |
| 2858 | F | 815897 |
| 2859 | F | 813968 |
| 2860 | F | 817367 |
| 2861 | F | 815456 |
| 2862 | F | 819089 |
| 2863 | F | 817201 |
| 2864 | F | 819482 |
| 2865 | F | 817563 |
| 2866 | F | 820143 |
| 2867 | F | 818252 |
| 2868 | F | 820800 |
| 2869 | F | 818900 |
| 2870 | F | 821426 |
| 2871 | F | 819500 |
| 2872 | F | 821943 |
| 2873 | F | 820003 |
| 2874 | F | 822811 |
| 2875 | F | 820926 |
| 2876 | F | 824117 |
| 2877 | F | 822214 |
| 2878 | F | 825659 |
| 2879 | F | 823747 |
| 2880 | F | 826112 |
| 2881 | F | 824151 |
| 2882 | F | 826773 |
| 2883 | F | 824894 |
| 2884 | F | 826945 |
| 2885 | F | 825061 |
| 2886 | F | 827754 |
| 2887 | F | 825869 |
| 2888 | F | 829117 |
| 2889 | F | 827236 |
| 2890 | F | 830870 |
| 2891 | F | 828917 |

TABLE 5-continued

| SEQ ID | Or. | position |
|---|---|---|
| 2892 | F | 831522 |
| 2893 | F | 829613 |
| 2894 | F | 831995 |
| 2895 | F | 830093 |
| 2896 | F | 832585 |
| 2897 | F | 830686 |
| 2898 | F | 833149 |
| 2899 | F | 831240 |
| 2900 | F | 833660 |
| 2901 | F | 831704 |
| 2902 | F | 834442 |
| 2903 | F | 832539 |
| 2904 | F | 835147 |
| 2905 | F | 833252 |
| 2906 | F | 835536 |
| 2907 | F | 833656 |
| 2908 | F | 836378 |
| 2909 | F | 834480 |
| 2910 | F | 836990 |
| 2911 | F | 835067 |
| 2912 | F | 838512 |
| 2913 | F | 836603 |
| 2914 | F | 839718 |
| 2915 | F | 837811 |
| 2916 | F | 840211 |
| 2917 | F | 838266 |
| 2918 | F | 841434 |
| 2919 | F | 839485 |
| 2920 | F | 842250 |
| 2921 | F | 840377 |
| 2922 | F | 842761 |
| 2923 | F | 840912 |
| 2924 | F | 843000 |
| 2925 | F | 841103 |
| 2926 | F | 843583 |
| 2927 | F | 841683 |
| 2928 | F | 845985 |
| 2929 | F | 844098 |
| 2930 | F | 847919 |
| 2931 | F | 846025 |
| 2932 | F | 850011 |
| 2933 | F | 848109 |
| 2934 | F | 851442 |
| 2935 | F | 849547 |
| 2936 | F | 853479 |
| 2937 | F | 851567 |
| 2938 | F | 854701 |
| 2939 | F | 852801 |
| 2940 | F | 855197 |
| 2941 | F | 853282 |
| 2942 | F | 856012 |
| 2943 | F | 854111 |
| 2944 | F | 857227 |
| 2945 | F | 855326 |
| 2946 | F | 859309 |
| 2947 | F | 857458 |
| 2948 | F | 859418 |
| 2949 | F | 857515 |
| 2950 | F | 860468 |
| 2951 | F | 858583 |
| 2952 | F | 861361 |
| 2953 | F | 859441 |
| 2954 | F | 861872 |
| 2955 | F | 859979 |
| 2956 | F | 863352 |
| 2957 | F | 861444 |
| 2958 | F | 863777 |
| 2959 | F | 861872 |
| 2960 | F | 864636 |
| 2961 | F | 862792 |
| 2962 | F | 866084 |
| 2963 | F | 864184 |
| 2964 | F | 866443 |
| 2965 | F | 864500 |
| 2966 | F | 867576 |
| 2967 | F | 865673 |
| 2968 | F | 868841 |

TABLE 5-continued

| SEQ ID | Or. | position |
|---|---|---|
| 2969 | F | 866960 |
| 2970 | F | 869050 |
| 2971 | F | 867150 |
| 2972 | F | 871062 |
| 2973 | F | 869138 |
| 2974 | F | 872210 |
| 2975 | F | 870310 |
| 2976 | F | 872497 |
| 2977 | F | 870597 |
| 2978 | F | 873141 |
| 2979 | F | 871236 |
| 2980 | F | 873800 |
| 2981 | F | 871909 |
| 2982 | F | 874558 |
| 2983 | F | 872648 |
| 2984 | F | 875521 |
| 2985 | F | 873612 |
| 2986 | F | 876781 |
| 2987 | F | 874848 |
| 2988 | F | 877657 |
| 2989 | F | 875727 |
| 2990 | F | 877935 |
| 2991 | F | 876044 |
| 2992 | F | 878633 |
| 2993 | F | 876695 |
| 2994 | F | 878886 |
| 2995 | F | 876963 |
| 2996 | F | 879824 |
| 2997 | F | 877933 |
| 2998 | F | 880670 |
| 2999 | F | 878769 |
| 3000 | F | 881719 |
| 3001 | F | 879824 |
| 3002 | F | 882682 |
| 3003 | F | 880774 |
| 3004 | F | 883432 |
| 3005 | F | 881540 |
| 3006 | F | 884263 |
| 3007 | F | 882357 |
| 3008 | F | 884947 |
| 3009 | F | 883044 |
| 3010 | F | 888721 |
| 3011 | F | 886762 |
| 3012 | F | 890084 |
| 3013 | F | 888182 |
| 3014 | F | 890897 |
| 3015 | F | 888996 |
| 3016 | F | 891749 |
| 3017 | F | 889830 |
| 3018 | F | 893136 |
| 3019 | F | 891228 |
| 3020 | F | 893415 |
| 3021 | F | 891471 |
| 3022 | F | 893591 |
| 3023 | F | 891684 |
| 3024 | F | 894005 |
| 3025 | F | 892127 |
| 3026 | F | 894827 |
| 3027 | F | 892900 |
| 3028 | F | 895732 |
| 3029 | F | 893790 |
| 3030 | F | 896823 |
| 3031 | F | 894907 |
| 3032 | F | 900571 |
| 3033 | F | 898639 |
| 3034 | F | 902407 |
| 3035 | F | 900507 |
| 3036 | F | 903243 |
| 3037 | F | 901346 |
| 3038 | F | 903616 |
| 3039 | F | 901726 |
| 3040 | F | 905486 |
| 3041 | F | 903589 |
| 3042 | F | 906234 |
| 3043 | F | 904350 |
| 3044 | F | 906774 |
| 3045 | F | 904846 |

TABLE 5-continued

| SEQ ID | Or. | position |
|---|---|---|
| 3046 | F | 907868 |
| 3047 | F | 905924 |
| 3048 | F | 908501 |
| 3049 | F | 906583 |
| 3050 | F | 908975 |
| 3051 | F | 907079 |
| 3052 | F | 909351 |
| 3053 | F | 907456 |
| 3054 | F | 909835 |
| 3055 | F | 907957 |
| 3056 | F | 910382 |
| 3057 | F | 908496 |
| 3058 | F | 910693 |
| 3059 | F | 908829 |
| 3060 | F | 912169 |
| 3061 | F | 910248 |
| 3062 | F | 912376 |
| 3063 | F | 910476 |
| 3064 | F | 912984 |
| 3065 | F | 911084 |
| 3066 | F | 913437 |
| 3067 | F | 911545 |
| 3068 | F | 914282 |
| 3069 | F | 912376 |
| 3070 | F | 914925 |
| 3071 | F | 913023 |
| 3072 | F | 915394 |
| 3073 | F | 913510 |
| 3074 | F | 915827 |
| 3075 | F | 913912 |
| 3076 | F | 916683 |
| 3077 | F | 914788 |
| 3078 | F | 917347 |
| 3079 | F | 915438 |
| 3080 | F | 918089 |
| 3081 | F | 916189 |
| 3082 | F | 918399 |
| 3083 | F | 916506 |
| 3084 | F | 919296 |
| 3085 | F | 917406 |
| 3086 | F | 919457 |
| 3087 | F | 917598 |
| 3088 | F | 919864 |
| 3089 | F | 917963 |
| 3090 | F | 920641 |
| 3091 | F | 918711 |
| 3092 | F | 921029 |
| 3093 | F | 919138 |
| 3094 | F | 921239 |
| 3095 | F | 919366 |
| 3096 | F | 921526 |
| 3097 | F | 919638 |
| 3098 | F | 921930 |
| 3099 | F | 919979 |
| 3100 | F | 922212 |
| 3101 | F | 920325 |
| 3102 | F | 922925 |
| 3103 | F | 921029 |
| 3104 | F | 923258 |
| 3105 | F | 921324 |
| 3106 | F | 923808 |
| 3107 | F | 921929 |
| 3108 | F | 924185 |
| 3109 | F | 922311 |
| 3110 | F | 924680 |
| 3111 | F | 922764 |
| 3112 | F | 925111 |
| 3113 | F | 923258 |
| 3114 | F | 926538 |
| 3115 | F | 924638 |
| 3116 | F | 926972 |
| 3117 | F | 925072 |
| 3118 | F | 927351 |
| 3119 | F | 925415 |
| 3120 | F | 927870 |
| 3121 | F | 925924 |
| 3122 | F | 928974 |

TABLE 5-continued

| SEQ ID | Or. | position |
|---|---|---|
| 3123 | F | 927031 |
| 3124 | F | 930003 |
| 3125 | F | 928103 |
| 3126 | F | 930383 |
| 3127 | F | 928402 |
| 3128 | F | 931084 |
| 3129 | F | 929222 |
| 3130 | F | 931307 |
| 3131 | F | 929397 |
| 3132 | F | 931824 |
| 3133 | F | 929927 |
| 3134 | F | 932352 |
| 3135 | F | 930470 |
| 3136 | F | 933044 |
| 3137 | F | 931084 |
| 3138 | F | 933303 |
| 3139 | F | 931396 |
| 3140 | F | 933626 |
| 3141 | F | 931686 |
| 3142 | F | 934320 |
| 3143 | F | 932412 |
| 3144 | F | 936427 |
| 3145 | F | 934508 |
| 3146 | F | 938309 |
| 3147 | F | 936402 |
| 3148 | F | 939110 |
| 3149 | F | 937204 |
| 3150 | F | 940791 |
| 3151 | F | 938889 |
| 3152 | F | 941806 |
| 3153 | F | 939906 |
| 3154 | F | 944314 |
| 3155 | F | 942412 |
| 3156 | F | 944987 |
| 3157 | F | 943090 |
| 3158 | F | 946072 |
| 3159 | F | 944166 |
| 3160 | F | 946877 |
| 3161 | F | 944986 |
| 3162 | F | 948258 |
| 3163 | F | 946403 |
| 3164 | F | 949037 |
| 3165 | F | 947137 |
| 3166 | F | 949581 |
| 3167 | F | 947671 |
| 3168 | F | 950455 |
| 3169 | F | 948558 |
| 3170 | F | 951058 |
| 3171 | F | 949151 |
| 3172 | F | 951569 |
| 3173 | F | 949653 |
| 3174 | F | 953340 |
| 3175 | F | 951431 |
| 3176 | F | 954174 |
| 3177 | F | 952288 |
| 3178 | F | 955475 |
| 3179 | F | 953604 |
| 3180 | F | 957601 |
| 3181 | F | 955703 |
| 3182 | F | 959053 |
| 3183 | F | 957168 |
| 3184 | F | 960824 |
| 3185 | F | 958932 |
| 3186 | F | 961268 |
| 3187 | F | 959368 |
| 3188 | F | 961365 |
| 3189 | F | 959465 |
| 3190 | F | 962324 |
| 3191 | F | 960423 |
| 3192 | F | 964706 |
| 3193 | F | 962822 |
| 3194 | F | 965974 |
| 3195 | F | 964074 |
| 3196 | F | 967210 |
| 3197 | F | 965307 |
| 3198 | F | 967808 |
| 3199 | F | 965925 |

TABLE 5-continued

| SEQ ID | Or. | position |
|---|---|---|
| 3200 | F | 969286 |
| 3201 | F | 967320 |
| 3202 | F | 970802 |
| 3203 | F | 968888 |
| 3204 | F | 972169 |
| 3205 | F | 970269 |
| 3206 | F | 973487 |
| 3207 | F | 971616 |
| 3208 | F | 974339 |
| 3209 | F | 972408 |
| 3210 | F | 974988 |
| 3211 | F | 973035 |
| 3212 | F | 976035 |
| 3213 | F | 974114 |
| 3214 | F | 976367 |
| 3215 | F | 974411 |
| 3216 | F | 976665 |
| 3217 | F | 974730 |
| 3218 | F | 977439 |
| 3219 | F | 975500 |
| 3220 | F | 977698 |
| 3221 | F | 975799 |
| 3222 | F | 978389 |
| 3223 | F | 976478 |
| 3224 | F | 978665 |
| 3225 | F | 976760 |
| 3226 | F | 979134 |
| 3227 | F | 977270 |
| 3228 | F | 979473 |
| 3229 | F | 977592 |
| 3230 | F | 980915 |
| 3231 | F | 979026 |
| 3232 | F | 982043 |
| 3233 | F | 980178 |
| 3234 | F | 983628 |
| 3235 | F | 981736 |
| 3236 | F | 984149 |
| 3237 | F | 982271 |
| 3238 | F | 985180 |
| 3239 | F | 983280 |
| 3240 | F | 985815 |
| 3241 | F | 983882 |
| 3242 | F | 986458 |
| 3243 | F | 984547 |
| 3244 | F | 987340 |
| 3245 | F | 985462 |
| 3246 | F | 987686 |
| 3247 | F | 985815 |
| 3248 | F | 988559 |
| 3249 | F | 986670 |
| 3250 | F | 989455 |
| 3251 | F | 987558 |
| 3252 | F | 993122 |
| 3253 | F | 991289 |
| 3254 | F | 993186 |
| 3255 | F | 991297 |
| 3256 | F | 993650 |
| 3257 | F | 991727 |
| 3258 | F | 994007 |
| 3259 | F | 992107 |
| 3260 | F | 995743 |
| 3261 | F | 993915 |
| 3262 | F | 996663 |
| 3263 | F | 994763 |
| 3264 | F | 998586 |
| 3265 | F | 996755 |
| 3266 | F | 999153 |
| 3267 | F | 997253 |
| 3268 | F | 1000967 |
| 3269 | F | 999092 |
| 3270 | F | 1001173 |
| 3271 | F | 999246 |
| 3272 | F | 1001604 |
| 3273 | F | 999645 |
| 3274 | F | 1004159 |
| 3275 | F | 1002326 |
| 3276 | F | 1004763 |

TABLE 5-continued

| SEQ ID | Or. | position |
|---|---|---|
| 3277 | F | 1002871 |
| 3278 | F | 1005160 |
| 3279 | F | 1003235 |
| 3280 | F | 1007181 |
| 3281 | F | 1005250 |
| 3282 | F | 1007561 |
| 3283 | F | 1005665 |
| 3284 | F | 1008855 |
| 3285 | F | 1007002 |
| 3286 | F | 1010205 |
| 3287 | F | 1008342 |
| 3288 | F | 1011716 |
| 3289 | F | 1009823 |
| 3290 | F | 1011812 |
| 3291 | F | 1009914 |
| 3292 | F | 1012372 |
| 3293 | F | 1010385 |
| 3294 | F | 1012567 |
| 3295 | F | 1010624 |
| 3296 | F | 1013237 |
| 3297 | F | 1011337 |
| 3298 | F | 1013690 |
| 3299 | F | 1011856 |
| 3300 | F | 1014301 |
| 3301 | F | 1012396 |
| 3302 | F | 1014926 |
| 3303 | F | 1013010 |
| 3304 | F | 1015664 |
| 3305 | F | 1013820 |
| 3306 | F | 1017026 |
| 3307 | F | 1015099 |
| 3308 | F | 1017674 |
| 3309 | F | 1015786 |
| 3310 | F | 1018353 |
| 3311 | F | 1016460 |
| 3312 | F | 1019602 |
| 3313 | F | 1017674 |
| 3314 | F | 1019876 |
| 3315 | F | 1017948 |
| 3316 | F | 1020853 |
| 3317 | F | 1018956 |
| 3318 | F | 1021878 |
| 3319 | F | 1019972 |
| 3320 | F | 1023054 |
| 3321 | F | 1021186 |
| 3322 | F | 1023415 |
| 3323 | F | 1021579 |
| 3324 | F | 1023748 |
| 3325 | F | 1021850 |
| 3326 | F | 1024485 |
| 3327 | F | 1022574 |
| 3328 | F | 1024744 |
| 3329 | F | 1022836 |
| 3330 | F | 1025618 |
| 3331 | F | 1023720 |
| 3332 | F | 1026323 |
| 3333 | F | 1024403 |
| 3334 | F | 1027710 |
| 3335 | F | 1025809 |
| 3336 | F | 1030272 |
| 3337 | F | 1028389 |
| 3338 | F | 1031486 |
| 3339 | F | 1029602 |
| 3340 | F | 1033215 |
| 3341 | F | 1031334 |
| 3342 | F | 1035425 |
| 3343 | F | 1033555 |
| 3344 | F | 1035956 |
| 3345 | F | 1034055 |
| 3346 | F | 1036748 |
| 3347 | F | 1034844 |
| 3348 | F | 16372 |
| 3349 | F | 14463 |
| 3350 | F | 31184 |
| 3351 | F | 29287 |
| 3352 | F | 56283 |
| 3353 | F | 54383 |

TABLE 5-continued

| SEQ ID | Or. | position |
|---|---|---|
| 3354 | F | 56384 |
| 3355 | F | 54538 |
| 3356 | F | 64528 |
| 3357 | F | 62600 |
| 3358 | F | 72965 |
| 3359 | F | 71054 |
| 3360 | F | 78245 |
| 3361 | F | 76347 |
| 3362 | F | 79133 |
| 3363 | F | 77291 |
| 3364 | F | 81740 |
| 3365 | F | 79840 |
| 3366 | F | 86772 |
| 3367 | F | 84880 |
| 3368 | F | 109188 |
| 3369 | F | 107337 |
| 3370 | F | 111132 |
| 3371 | F | 109188 |
| 3372 | F | 111505 |
| 3373 | F | 109597 |
| 3374 | F | 112432 |
| 3375 | F | 110462 |
| 3376 | F | 113446 |
| 3377 | F | 111592 |
| 3378 | F | 120225 |
| 3379 | F | 118303 |
| 3380 | F | 124892 |
| 3381 | F | 123004 |
| 3382 | F | 131327 |
| 3383 | F | 129485 |
| 3384 | F | 143944 |
| 3385 | F | 142043 |
| 3386 | F | 150138 |
| 3387 | F | 148247 |
| 3388 | F | 163715 |
| 3389 | F | 161804 |
| 3390 | F | 165186 |
| 3391 | F | 163274 |
| 3392 | F | 168143 |
| 3393 | F | 166302 |
| 3394 | F | 170287 |
| 3395 | F | 168387 |
| 3396 | F | 176838 |
| 3397 | F | 174996 |
| 3398 | F | 187776 |
| 3399 | F | 185900 |
| 3400 | F | 188083 |
| 3401 | F | 186208 |
| 3402 | F | 190117 |
| 3403 | F | 188168 |
| 3404 | F | 196802 |
| 3405 | F | 194946 |
| 3406 | F | 210685 |
| 3407 | F | 208785 |
| 3408 | F | 234633 |
| 3409 | F | 232727 |
| 3410 | F | 236682 |
| 3411 | F | 234794 |
| 3412 | F | 249227 |
| 3413 | F | 247310 |
| 3414 | F | 252939 |
| 3415 | F | 251036 |
| 3416 | F | 253406 |
| 3417 | F | 251562 |
| 3418 | F | 271365 |
| 3419 | F | 269466 |
| 3420 | F | 275390 |
| 3421 | F | 273489 |
| 3422 | F | 277681 |
| 3423 | F | 275765 |
| 3424 | F | 282260 |
| 3425 | F | 280357 |
| 3426 | F | 292925 |
| 3427 | F | 291054 |
| 3428 | F | 302910 |
| 3429 | F | 301032 |
| 3430 | F | 308746 |

TABLE 5-continued

| SEQ ID | Or. | position |
|---|---|---|
| 3431 | F | 306806 |
| 3432 | F | 311994 |
| 3433 | F | 310073 |
| 3434 | F | 312375 |
| 3435 | F | 310483 |
| 3436 | F | 312531 |
| 3437 | F | 310647 |
| 3438 | F | 319923 |
| 3439 | F | 318009 |
| 3440 | F | 339991 |
| 3441 | F | 338104 |
| 3442 | F | 352535 |
| 3443 | F | 350653 |
| 3444 | F | 373218 |
| 3445 | F | 371320 |
| 3446 | F | 376994 |
| 3447 | F | 375085 |
| 3448 | F | 378954 |
| 3449 | F | 377011 |
| 3450 | F | 394604 |
| 3451 | F | 392704 |
| 3452 | F | 400915 |
| 3453 | F | 398972 |
| 3454 | F | 409744 |
| 3455 | F | 407904 |
| 3456 | F | 411155 |
| 3457 | F | 409253 |
| 3458 | F | 414197 |
| 3459 | F | 412281 |
| 3460 | F | 422638 |
| 3461 | F | 420770 |
| 3462 | F | 427595 |
| 3463 | F | 425701 |
| 3464 | F | 428453 |
| 3465 | F | 426553 |
| 3466 | F | 442272 |
| 3467 | F | 440364 |
| 3468 | F | 443303 |
| 3469 | F | 441380 |
| 3470 | F | 442939 |
| 3471 | F | 441047 |
| 3472 | F | 445572 |
| 3473 | F | 443707 |
| 3474 | F | 467757 |
| 3475 | F | 465801 |
| 3476 | F | 471583 |
| 3477 | F | 469712 |
| 3478 | F | 487813 |
| 3479 | F | 485913 |
| 3480 | F | 496852 |
| 3481 | F | 494952 |
| 3482 | F | 499979 |
| 3483 | F | 498074 |
| 3484 | F | 508715 |
| 3485 | F | 506798 |
| 3486 | F | 510584 |
| 3487 | F | 508632 |
| 3488 | F | 526255 |
| 3489 | F | 524350 |
| 3490 | F | 531098 |
| 3491 | F | 529150 |
| 3492 | F | 556575 |
| 3493 | F | 554706 |
| 3494 | F | 564318 |
| 3495 | F | 562390 |
| 3496 | F | 566692 |
| 3497 | F | 564838 |
| 3498 | F | 570033 |
| 3499 | F | 568150 |
| 3500 | F | 570844 |
| 3501 | F | 568915 |
| 3502 | F | 575571 |
| 3503 | F | 573671 |
| 3504 | F | 590045 |
| 3505 | F | 588196 |
| 3506 | F | 597631 |
| 3507 | F | 595698 |

TABLE 5-continued

| SEQ ID | Or. | position |
|---|---|---|
| 3508 | F | 606387 |
| 3509 | F | 604507 |
| 3510 | F | 607566 |
| 3511 | F | 605637 |
| 3512 | F | 609842 |
| 3513 | F | 607958 |
| 3514 | F | 632472 |
| 3515 | F | 630572 |
| 3516 | F | 636994 |
| 3517 | F | 635071 |
| 3518 | F | 649681 |
| 3519 | F | 647800 |
| 3520 | F | 652059 |
| 3521 | F | 650101 |
| 3522 | F | 654522 |
| 3523 | F | 652562 |
| 3524 | F | 660587 |
| 3525 | F | 658691 |
| 3526 | F | 676785 |
| 3527 | F | 674938 |
| 3528 | F | 679031 |
| 3529 | F | 677133 |
| 3530 | F | 731967 |
| 3531 | F | 730091 |
| 3532 | F | 741797 |
| 3533 | F | 739935 |
| 3534 | F | 758555 |
| 3535 | F | 756641 |
| 3536 | F | 760010 |
| 3537 | F | 758082 |
| 3538 | F | 770670 |
| 3539 | F | 768751 |
| 3540 | F | 771896 |
| 3541 | F | 769996 |
| 3542 | F | 787857 |
| 3543 | F | 785958 |
| 3544 | F | 815714 |
| 3545 | F | 813840 |
| 3546 | F | 846380 |
| 3547 | F | 844470 |
| 3548 | F | 867576 |
| 3549 | F | 865673 |
| 3550 | F | 875167 |
| 3551 | F | 873254 |
| 3552 | F | 876214 |
| 3553 | F | 874314 |
| 3554 | F | 884093 |
| 3555 | F | 882162 |
| 3556 | F | 891248 |
| 3557 | F | 889348 |
| 3558 | F | 900125 |
| 3559 | F | 898298 |
| 3560 | F | 902048 |
| 3561 | F | 900125 |
| 3562 | F | 907563 |
| 3563 | F | 905656 |
| 3564 | F | 912076 |
| 3565 | F | 910133 |
| 3566 | F | 935157 |
| 3567 | F | 933211 |
| 3568 | F | 946473 |
| 3569 | F | 944568 |
| 3570 | F | 952562 |
| 3571 | F | 950664 |
| 3572 | F | 965649 |
| 3573 | F | 963730 |
| 3574 | F | 968519 |
| 3575 | F | 966614 |
| 3576 | F | 970497 |
| 3577 | F | 968601 |
| 3578 | F | 971879 |
| 3579 | F | 970043 |
| 3580 | F | 972888 |
| 3581 | F | 970962 |
| 3582 | F | 998162 |
| 3583 | F | 996241 |
| 3584 | F | 1003657 |

TABLE 5-continued

| SEQ ID | Or. | position |
|---|---|---|
| 3585 | F | 1001756 |
| 3586 | F | 1009313 |
| 3587 | F | 1007413 |
| 3588 | F | 1028954 |
| 3589 | F | 1027039 |
| 3590 | B | 730 |
| 3591 | B | 2645 |
| 3592 | B | 3521 |
| 3593 | B | 5431 |
| 3594 | B | 5295 |
| 3595 | B | 7188 |
| 3596 | B | 6740 |
| 3597 | B | 8652 |
| 3598 | B | 8240 |
| 3599 | B | 10138 |
| 3600 | B | 8959 |
| 3601 | B | 10816 |
| 3602 | B | 9285 |
| 3603 | B | 11160 |
| 3604 | B | 9689 |
| 3605 | B | 11591 |
| 3606 | B | 10679 |
| 3607 | B | 12568 |
| 3608 | B | 11515 |
| 3609 | B | 13376 |
| 3610 | B | 12136 |
| 3611 | B | 14038 |
| 3612 | B | 13565 |
| 3613 | B | 15450 |
| 3614 | B | 14667 |
| 3615 | B | 16535 |
| 3616 | B | 15254 |
| 3617 | B | 17183 |
| 3618 | B | 16189 |
| 3619 | B | 18097 |
| 3620 | B | 16790 |
| 3621 | B | 18621 |
| 3622 | B | 16710 |
| 3623 | B | 18587 |
| 3624 | B | 18458 |
| 3625 | B | 20318 |
| 3626 | B | 20768 |
| 3627 | B | 22647 |
| 3628 | B | 22438 |
| 3629 | B | 24335 |
| 3630 | B | 22892 |
| 3631 | B | 24752 |
| 3632 | B | 23046 |
| 3633 | B | 24924 |
| 3634 | B | 23442 |
| 3635 | B | 25313 |
| 3636 | B | 23623 |
| 3637 | B | 25528 |
| 3638 | B | 24822 |
| 3639 | B | 26708 |
| 3640 | B | 26618 |
| 3641 | B | 28544 |
| 3642 | B | 27972 |
| 3643 | B | 29859 |
| 3644 | B | 29000 |
| 3645 | B | 30908 |
| 3646 | B | 30242 |
| 3647 | B | 32160 |
| 3648 | B | 30966 |
| 3649 | B | 32849 |
| 3650 | B | 31516 |
| 3651 | B | 33401 |
| 3652 | B | 32032 |
| 3653 | B | 33900 |
| 3654 | B | 33576 |
| 3655 | B | 35496 |
| 3656 | B | 34121 |
| 3657 | B | 36052 |
| 3658 | B | 35251 |
| 3659 | B | 37164 |
| 3660 | B | 35588 |
| 3661 | B | 37502 |

TABLE 5-continued

| SEQ ID | Or. | position |
|---|---|---|
| 3662 | B | 36152 |
| 3663 | B | 38041 |
| 3664 | B | 37216 |
| 3665 | B | 39127 |
| 3666 | B | 38041 |
| 3667 | B | 39980 |
| 3668 | B | 39322 |
| 3669 | B | 41205 |
| 3670 | B | 40161 |
| 3671 | B | 42074 |
| 3672 | B | 40985 |
| 3673 | B | 42887 |
| 3674 | B | 42284 |
| 3675 | B | 44180 |
| 3676 | B | 43337 |
| 3677 | B | 45275 |
| 3678 | B | 44022 |
| 3679 | B | 45927 |
| 3680 | B | 45451 |
| 3681 | B | 47375 |
| 3682 | B | 46308 |
| 3683 | B | 48208 |
| 3684 | B | 46560 |
| 3685 | B | 48485 |
| 3686 | B | 47115 |
| 3687 | B | 49053 |
| 3688 | B | 48208 |
| 3689 | B | 50118 |
| 3690 | B | 48806 |
| 3691 | B | 50708 |
| 3692 | B | 50333 |
| 3693 | B | 52220 |
| 3694 | B | 50960 |
| 3695 | B | 52890 |
| 3696 | B | 52660 |
| 3697 | B | 54606 |
| 3698 | B | 53737 |
| 3699 | B | 55645 |
| 3700 | B | 54793 |
| 3701 | B | 56691 |
| 3702 | B | 55329 |
| 3703 | B | 57226 |
| 3704 | B | 56691 |
| 3705 | B | 58566 |
| 3706 | B | 56317 |
| 3707 | B | 58226 |
| 3708 | B | 58469 |
| 3709 | B | 60363 |
| 3710 | B | 59406 |
| 3711 | B | 61301 |
| 3712 | B | 60450 |
| 3713 | B | 62316 |
| 3714 | B | 61722 |
| 3715 | B | 63603 |
| 3716 | B | 62585 |
| 3717 | B | 64473 |
| 3718 | B | 63362 |
| 3719 | B | 65285 |
| 3720 | B | 64203 |
| 3721 | B | 66103 |
| 3722 | B | 64850 |
| 3723 | B | 66749 |
| 3724 | B | 64899 |
| 3725 | B | 66776 |
| 3726 | B | 65164 |
| 3727 | B | 67067 |
| 3728 | B | 67514 |
| 3729 | B | 69390 |
| 3730 | B | 69097 |
| 3731 | B | 71033 |
| 3732 | B | 69470 |
| 3733 | B | 71354 |
| 3734 | B | 69961 |
| 3735 | B | 71898 |
| 3736 | B | 70707 |
| 3737 | B | 72579 |
| 3738 | B | 71249 |

TABLE 5-continued

| SEQ ID | Or. | position |
|---|---|---|
| 3739 | B | 73134 |
| 3740 | B | 73458 |
| 3741 | B | 75376 |
| 3742 | B | 75121 |
| 3743 | B | 77020 |
| 3744 | B | 75741 |
| 3745 | B | 77608 |
| 3746 | B | 77447 |
| 3747 | B | 79300 |
| 3748 | B | 77535 |
| 3749 | B | 79430 |
| 3750 | B | 78333 |
| 3751 | B | 80243 |
| 3752 | B | 79300 |
| 3753 | B | 81197 |
| 3754 | B | 82201 |
| 3755 | B | 84100 |
| 3756 | B | 83493 |
| 3757 | B | 85405 |
| 3758 | B | 85075 |
| 3759 | B | 86973 |
| 3760 | B | 87141 |
| 3761 | B | 89086 |
| 3762 | B | 88903 |
| 3763 | B | 90810 |
| 3764 | B | 88038 |
| 3765 | B | 89946 |
| 3766 | B | 88981 |
| 3767 | B | 90884 |
| 3768 | B | 89485 |
| 3769 | B | 91385 |
| 3770 | B | 89975 |
| 3771 | B | 91855 |
| 3772 | B | 91680 |
| 3773 | B | 93567 |
| 3774 | B | 92008 |
| 3775 | B | 93902 |
| 3776 | B | 92633 |
| 3777 | B | 94569 |
| 3778 | B | 93390 |
| 3779 | B | 95288 |
| 3780 | B | 94354 |
| 3781 | B | 96254 |
| 3782 | B | 94897 |
| 3783 | B | 96772 |
| 3784 | B | 98519 |
| 3785 | B | 100439 |
| 3786 | B | 98962 |
| 3787 | B | 100853 |
| 3788 | B | 100451 |
| 3789 | B | 102387 |
| 3790 | B | 101639 |
| 3791 | B | 103473 |
| 3792 | B | 102457 |
| 3793 | B | 104357 |
| 3794 | B | 102745 |
| 3795 | B | 104666 |
| 3796 | B | 104544 |
| 3797 | B | 106464 |
| 3798 | B | 105338 |
| 3799 | B | 107237 |
| 3800 | B | 106127 |
| 3801 | B | 108014 |
| 3802 | B | 108693 |
| 3803 | B | 110587 |
| 3804 | B | 109189 |
| 3805 | B | 111079 |
| 3806 | B | 109684 |
| 3807 | B | 111580 |
| 3808 | B | 110587 |
| 3809 | B | 112486 |
| 3810 | B | 112740 |
| 3811 | B | 114673 |
| 3812 | B | 113684 |
| 3813 | B | 115653 |
| 3814 | B | 114216 |
| 3815 | B | 116158 |

TABLE 5-continued

| SEQ ID | Or. | position |
|---|---|---|
| 3816 | B | 114836 |
| 3817 | B | 116732 |
| 3818 | B | 115473 |
| 3819 | B | 117380 |
| 3820 | B | 115898 |
| 3821 | B | 117797 |
| 3822 | B | 120031 |
| 3823 | B | 121926 |
| 3824 | B | 124231 |
| 3825 | B | 126158 |
| 3826 | B | 125215 |
| 3827 | B | 127115 |
| 3828 | B | 125352 |
| 3829 | B | 127271 |
| 3830 | B | 126492 |
| 3831 | B | 128390 |
| 3832 | B | 127150 |
| 3833 | B | 129050 |
| 3834 | B | 128010 |
| 3835 | B | 129905 |
| 3836 | B | 129947 |
| 3837 | B | 131873 |
| 3838 | B | 131255 |
| 3839 | B | 133205 |
| 3840 | B | 131873 |
| 3841 | B | 133749 |
| 3842 | B | 133381 |
| 3843 | B | 135305 |
| 3844 | B | 133804 |
| 3845 | B | 135704 |
| 3846 | B | 134219 |
| 3847 | B | 136133 |
| 3848 | B | 134729 |
| 3849 | B | 136633 |
| 3850 | B | 137694 |
| 3851 | B | 139583 |
| 3852 | B | 140496 |
| 3853 | B | 142396 |
| 3854 | B | 140953 |
| 3855 | B | 142856 |
| 3856 | B | 142031 |
| 3857 | B | 143950 |
| 3858 | B | 143520 |
| 3859 | B | 145425 |
| 3860 | B | 144066 |
| 3861 | B | 145967 |
| 3862 | B | 144629 |
| 3863 | B | 146519 |
| 3864 | B | 146547 |
| 3865 | B | 148446 |
| 3866 | B | 147304 |
| 3867 | B | 149227 |
| 3868 | B | 148296 |
| 3869 | B | 150255 |
| 3870 | B | 148769 |
| 3871 | B | 150670 |
| 3872 | B | 149320 |
| 3873 | B | 151168 |
| 3874 | B | 149532 |
| 3875 | B | 151470 |
| 3876 | B | 149934 |
| 3877 | B | 151845 |
| 3878 | B | 151168 |
| 3879 | B | 153047 |
| 3880 | B | 152275 |
| 3881 | B | 154165 |
| 3882 | B | 152887 |
| 3883 | B | 154804 |
| 3884 | B | 153600 |
| 3885 | B | 155482 |
| 3886 | B | 154217 |
| 3887 | B | 156157 |
| 3888 | B | 155523 |
| 3889 | B | 157396 |
| 3890 | B | 156823 |
| 3891 | B | 158731 |
| 3892 | B | 157745 |

TABLE 5-continued

| SEQ ID | Or. | position |
|---|---|---|
| 3893 | B | 159645 |
| 3894 | B | 159207 |
| 3895 | B | 161084 |
| 3896 | B | 160216 |
| 3897 | B | 162127 |
| 3898 | B | 161451 |
| 3899 | B | 163350 |
| 3900 | B | 161818 |
| 3901 | B | 163726 |
| 3902 | B | 162601 |
| 3903 | B | 164501 |
| 3904 | B | 163282 |
| 3905 | B | 165205 |
| 3906 | B | 164171 |
| 3907 | B | 166082 |
| 3908 | B | 165812 |
| 3909 | B | 167672 |
| 3910 | B | 166939 |
| 3911 | B | 168861 |
| 3912 | B | 168421 |
| 3913 | B | 170322 |
| 3914 | B | 169503 |
| 3915 | B | 171369 |
| 3916 | B | 170715 |
| 3917 | B | 172587 |
| 3918 | B | 171554 |
| 3919 | B | 173512 |
| 3920 | B | 172596 |
| 3921 | B | 174496 |
| 3922 | B | 173021 |
| 3923 | B | 174847 |
| 3924 | B | 174716 |
| 3925 | B | 176619 |
| 3926 | B | 175205 |
| 3927 | B | 177143 |
| 3928 | B | 175943 |
| 3929 | B | 177830 |
| 3930 | B | 177244 |
| 3931 | B | 179180 |
| 3932 | B | 178337 |
| 3933 | B | 180239 |
| 3934 | B | 180274 |
| 3935 | B | 182181 |
| 3936 | B | 180972 |
| 3937 | B | 182864 |
| 3938 | B | 181659 |
| 3939 | B | 183572 |
| 3940 | B | 182864 |
| 3941 | B | 184750 |
| 3942 | B | 183876 |
| 3943 | B | 185778 |
| 3944 | B | 185007 |
| 3945 | B | 186910 |
| 3946 | B | 186246 |
| 3947 | B | 188160 |
| 3948 | B | 187080 |
| 3949 | B | 189016 |
| 3950 | B | 187490 |
| 3951 | B | 189421 |
| 3952 | B | 188044 |
| 3953 | B | 189929 |
| 3954 | B | 189711 |
| 3955 | B | 191656 |
| 3956 | B | 190594 |
| 3957 | B | 192533 |
| 3958 | B | 190731 |
| 3959 | B | 192679 |
| 3960 | B | 192027 |
| 3961 | B | 193906 |
| 3962 | B | 192684 |
| 3963 | B | 194643 |
| 3964 | B | 193419 |
| 3965 | B | 195348 |
| 3966 | B | 194878 |
| 3967 | B | 196750 |
| 3968 | B | 195270 |
| 3969 | B | 197166 |

TABLE 5-continued

| SEQ ID | Or. | position |
|---|---|---|
| 3970 | B | 197255 |
| 3971 | B | 199165 |
| 3972 | B | 197859 |
| 3973 | B | 199756 |
| 3974 | B | 198443 |
| 3975 | B | 200328 |
| 3976 | B | 199202 |
| 3977 | B | 201084 |
| 3978 | B | 200198 |
| 3979 | B | 202084 |
| 3980 | B | 200547 |
| 3981 | B | 202447 |
| 3982 | B | 200934 |
| 3983 | B | 202806 |
| 3984 | B | 201224 |
| 3985 | B | 203115 |
| 3986 | B | 202606 |
| 3987 | B | 204583 |
| 3988 | B | 203735 |
| 3989 | B | 205603 |
| 3990 | B | 204218 |
| 3991 | B | 206147 |
| 3992 | B | 206686 |
| 3993 | B | 208569 |
| 3994 | B | 207672 |
| 3995 | B | 209558 |
| 3996 | B | 208799 |
| 3997 | B | 210648 |
| 3998 | B | 209701 |
| 3999 | B | 211599 |
| 4000 | B | 210500 |
| 4001 | B | 212364 |
| 4002 | B | 211064 |
| 4003 | B | 212957 |
| 4004 | B | 211557 |
| 4005 | B | 213453 |
| 4006 | B | 213248 |
| 4007 | B | 215101 |
| 4008 | B | 214372 |
| 4009 | B | 216286 |
| 4010 | B | 214931 |
| 4011 | B | 216887 |
| 4012 | B | 215375 |
| 4013 | B | 217268 |
| 4014 | B | 216928 |
| 4015 | B | 218828 |
| 4016 | B | 218137 |
| 4017 | B | 220037 |
| 4018 | B | 217661 |
| 4019 | B | 219561 |
| 4020 | B | 218937 |
| 4021 | B | 220822 |
| 4022 | B | 219229 |
| 4023 | B | 221130 |
| 4024 | B | 220005 |
| 4025 | B | 221868 |
| 4026 | B | 220654 |
| 4027 | B | 222560 |
| 4028 | B | 221294 |
| 4029 | B | 223195 |
| 4030 | B | 221762 |
| 4031 | B | 223673 |
| 4032 | B | 222338 |
| 4033 | B | 224212 |
| 4034 | B | 223510 |
| 4035 | B | 225417 |
| 4036 | B | 224094 |
| 4037 | B | 226033 |
| 4038 | B | 225417 |
| 4039 | B | 227291 |
| 4040 | B | 226033 |
| 4041 | B | 227907 |
| 4042 | B | 225811 |
| 4043 | B | 227671 |
| 4044 | B | 226947 |
| 4045 | B | 228871 |
| 4046 | B | 227523 |

TABLE 5-continued

| SEQ ID | Or. | position |
|---|---|---|
| 4047 | B | 229432 |
| 4048 | B | 227907 |
| 4049 | B | 229784 |
| 4050 | B | 228692 |
| 4051 | B | 230578 |
| 4052 | B | 230253 |
| 4053 | B | 232157 |
| 4054 | B | 231299 |
| 4055 | B | 233194 |
| 4056 | B | 233226 |
| 4057 | B | 235130 |
| 4058 | B | 234073 |
| 4059 | B | 235950 |
| 4060 | B | 234510 |
| 4061 | B | 236399 |
| 4062 | B | 235094 |
| 4063 | B | 236993 |
| 4064 | B | 236552 |
| 4065 | B | 238440 |
| 4066 | B | 238440 |
| 4067 | B | 240381 |
| 4068 | B | 238989 |
| 4069 | B | 240917 |
| 4070 | B | 240294 |
| 4071 | B | 242181 |
| 4072 | B | 242260 |
| 4073 | B | 244157 |
| 4074 | B | 243066 |
| 4075 | B | 245029 |
| 4076 | B | 244703 |
| 4077 | B | 246603 |
| 4078 | B | 246151 |
| 4079 | B | 248017 |
| 4080 | B | 247104 |
| 4081 | B | 248997 |
| 4082 | B | 248001 |
| 4083 | B | 249872 |
| 4084 | B | 248835 |
| 4085 | B | 250713 |
| 4086 | B | 249697 |
| 4087 | B | 251574 |
| 4088 | B | 250643 |
| 4089 | B | 252560 |
| 4090 | B | 251439 |
| 4091 | B | 253306 |
| 4092 | B | 252401 |
| 4093 | B | 254231 |
| 4094 | B | 253312 |
| 4095 | B | 255224 |
| 4096 | B | 256969 |
| 4097 | B | 258840 |
| 4098 | B | 258065 |
| 4099 | B | 259964 |
| 4100 | B | 258945 |
| 4101 | B | 260826 |
| 4102 | B | 259428 |
| 4103 | B | 261313 |
| 4104 | B | 261845 |
| 4105 | B | 263746 |
| 4106 | B | 264350 |
| 4107 | B | 266263 |
| 4108 | B | 264963 |
| 4109 | B | 266887 |
| 4110 | B | 265848 |
| 4111 | B | 267749 |
| 4112 | B | 266644 |
| 4113 | B | 268546 |
| 4114 | B | 268188 |
| 4115 | B | 270091 |
| 4116 | B | 268188 |
| 4117 | B | 270091 |
| 4118 | B | 268546 |
| 4119 | B | 270440 |
| 4120 | B | 268785 |
| 4121 | B | 270697 |
| 4122 | B | 270439 |
| 4123 | B | 272288 |

TABLE 5-continued

| SEQ ID | Or. | position |
|---|---|---|
| 4124 | B | 271181 |
| 4125 | B | 273043 |
| 4126 | B | 271833 |
| 4127 | B | 273738 |
| 4128 | B | 273188 |
| 4129 | B | 275062 |
| 4130 | B | 273817 |
| 4131 | B | 275718 |
| 4132 | B | 275062 |
| 4133 | B | 277005 |
| 4134 | B | 275886 |
| 4135 | B | 277857 |
| 4136 | B | 277923 |
| 4137 | B | 279868 |
| 4138 | B | 279043 |
| 4139 | B | 281004 |
| 4140 | B | 280126 |
| 4141 | B | 282004 |
| 4142 | B | 281004 |
| 4143 | B | 282911 |
| 4144 | B | 281825 |
| 4145 | B | 283746 |
| 4146 | B | 282335 |
| 4147 | B | 284236 |
| 4148 | B | 284583 |
| 4149 | B | 286455 |
| 4150 | B | 285055 |
| 4151 | B | 286921 |
| 4152 | B | 285894 |
| 4153 | B | 287794 |
| 4154 | B | 286441 |
| 4155 | B | 288315 |
| 4156 | B | 286921 |
| 4157 | B | 288811 |
| 4158 | B | 288145 |
| 4159 | B | 290018 |
| 4160 | B | 289448 |
| 4161 | B | 291407 |
| 4162 | B | 290899 |
| 4163 | B | 292805 |
| 4164 | B | 291814 |
| 4165 | B | 293655 |
| 4166 | B | 292489 |
| 4167 | B | 294373 |
| 4168 | B | 293317 |
| 4169 | B | 295183 |
| 4170 | B | 295073 |
| 4171 | B | 297037 |
| 4172 | B | 295932 |
| 4173 | B | 297846 |
| 4174 | B | 296556 |
| 4175 | B | 298475 |
| 4176 | B | 297474 |
| 4177 | B | 299413 |
| 4178 | B | 298970 |
| 4179 | B | 300855 |
| 4180 | B | 300679 |
| 4181 | B | 302595 |
| 4182 | B | 302372 |
| 4183 | B | 304272 |
| 4184 | B | 305137 |
| 4185 | B | 307039 |
| 4186 | B | 306377 |
| 4187 | B | 308287 |
| 4188 | B | 306730 |
| 4189 | B | 308614 |
| 4190 | B | 307199 |
| 4191 | B | 309120 |
| 4192 | B | 309018 |
| 4193 | B | 310903 |
| 4194 | B | 310128 |
| 4195 | B | 312001 |
| 4196 | B | 310966 |
| 4197 | B | 312899 |
| 4198 | B | 311790 |
| 4199 | B | 313705 |
| 4200 | B | 312671 |

TABLE 5-continued

| SEQ ID | Or. | position |
|---|---|---|
| 4201 | B | 314590 |
| 4202 | B | 314590 |
| 4203 | B | 316484 |
| 4204 | B | 314977 |
| 4205 | B | 316880 |
| 4206 | B | 315775 |
| 4207 | B | 317646 |
| 4208 | B | 316760 |
| 4209 | B | 318627 |
| 4210 | B | 317541 |
| 4211 | B | 319422 |
| 4212 | B | 317829 |
| 4213 | B | 319763 |
| 4214 | B | 318703 |
| 4215 | B | 320628 |
| 4216 | B | 318094 |
| 4217 | B | 320048 |
| 4218 | B | 319182 |
| 4219 | B | 321067 |
| 4220 | B | 320404 |
| 4221 | B | 322278 |
| 4222 | B | 321720 |
| 4223 | B | 323625 |
| 4224 | B | 322158 |
| 4225 | B | 324071 |
| 4226 | B | 322582 |
| 4227 | B | 324500 |
| 4228 | B | 323371 |
| 4229 | B | 325260 |
| 4230 | B | 325173 |
| 4231 | B | 327057 |
| 4232 | B | 325882 |
| 4233 | B | 327770 |
| 4234 | B | 326509 |
| 4235 | B | 328388 |
| 4236 | B | 327463 |
| 4237 | B | 329330 |
| 4238 | B | 328374 |
| 4239 | B | 330270 |
| 4240 | B | 328850 |
| 4241 | B | 330751 |
| 4242 | B | 329330 |
| 4243 | B | 331210 |
| 4244 | B | 329883 |
| 4245 | B | 331822 |
| 4246 | B | 330886 |
| 4247 | B | 332797 |
| 4248 | B | 331395 |
| 4249 | B | 333375 |
| 4250 | B | 331990 |
| 4251 | B | 333884 |
| 4252 | B | 332669 |
| 4253 | B | 334575 |
| 4254 | B | 333375 |
| 4255 | B | 335166 |
| 4256 | B | 333811 |
| 4257 | B | 335709 |
| 4258 | B | 334579 |
| 4259 | B | 336497 |
| 4260 | B | 334590 |
| 4261 | B | 336497 |
| 4262 | B | 335362 |
| 4263 | B | 337262 |
| 4264 | B | 335863 |
| 4265 | B | 337723 |
| 4266 | B | 335939 |
| 4267 | B | 337848 |
| 4268 | B | 336558 |
| 4269 | B | 338461 |
| 4270 | B | 337647 |
| 4271 | B | 339503 |
| 4272 | B | 340181 |
| 4273 | B | 342110 |
| 4274 | B | 342069 |
| 4275 | B | 343977 |
| 4276 | B | 342269 |
| 4277 | B | 344168 |

TABLE 5-continued

| SEQ ID | Or. | position |
|---|---|---|
| 4278 | B | 342694 |
| 4279 | B | 344593 |
| 4280 | B | 343594 |
| 4281 | B | 345503 |
| 4282 | B | 344269 |
| 4283 | B | 346199 |
| 4284 | B | 344452 |
| 4285 | B | 346382 |
| 4286 | B | 345362 |
| 4287 | B | 347262 |
| 4288 | B | 346199 |
| 4289 | B | 348069 |
| 4290 | B | 347326 |
| 4291 | B | 349228 |
| 4292 | B | 348165 |
| 4293 | B | 350060 |
| 4294 | B | 350399 |
| 4295 | B | 352288 |
| 4296 | B | 351503 |
| 4297 | B | 353403 |
| 4298 | B | 352460 |
| 4299 | B | 354356 |
| 4300 | B | 352948 |
| 4301 | B | 354901 |
| 4302 | B | 353959 |
| 4303 | B | 355890 |
| 4304 | B | 354438 |
| 4305 | B | 356378 |
| 4306 | B | 354997 |
| 4307 | B | 356866 |
| 4308 | B | 356897 |
| 4309 | B | 358793 |
| 4310 | B | 357643 |
| 4311 | B | 359499 |
| 4312 | B | 358323 |
| 4313 | B | 360222 |
| 4314 | B | 360972 |
| 4315 | B | 362863 |
| 4316 | B | 361348 |
| 4317 | B | 363263 |
| 4318 | B | 362109 |
| 4319 | B | 364008 |
| 4320 | B | 362983 |
| 4321 | B | 364867 |
| 4322 | B | 364110 |
| 4323 | B | 366002 |
| 4324 | B | 365415 |
| 4325 | B | 367338 |
| 4326 | B | 365807 |
| 4327 | B | 367733 |
| 4328 | B | 367607 |
| 4329 | B | 369440 |
| 4330 | B | 368881 |
| 4331 | B | 370788 |
| 4332 | B | 369317 |
| 4333 | B | 371209 |
| 4334 | B | 370522 |
| 4335 | B | 372440 |
| 4336 | B | 371311 |
| 4337 | B | 373206 |
| 4338 | B | 373097 |
| 4339 | B | 374941 |
| 4340 | B | 373753 |
| 4341 | B | 375649 |
| 4342 | B | 374424 |
| 4343 | B | 376324 |
| 4344 | B | 374956 |
| 4345 | B | 376888 |
| 4346 | B | 376611 |
| 4347 | B | 378511 |
| 4348 | B | 377297 |
| 4349 | B | 379209 |
| 4350 | B | 378960 |
| 4351 | B | 380880 |
| 4352 | B | 379309 |
| 4353 | B | 381180 |
| 4354 | B | 379667 |

TABLE 5-continued

| SEQ ID | Or. | position |
|---|---|---|
| 4355 | B | 381553 |
| 4356 | B | 380238 |
| 4357 | B | 382152 |
| 4358 | B | 381699 |
| 4359 | B | 383615 |
| 4360 | B | 382790 |
| 4361 | B | 384687 |
| 4362 | B | 383935 |
| 4363 | B | 385837 |
| 4364 | B | 384167 |
| 4365 | B | 386065 |
| 4366 | B | 385479 |
| 4367 | B | 387365 |
| 4368 | B | 385730 |
| 4369 | B | 387635 |
| 4370 | B | 387115 |
| 4371 | B | 389019 |
| 4372 | B | 386903 |
| 4373 | B | 388753 |
| 4374 | B | 387595 |
| 4375 | B | 389504 |
| 4376 | B | 388133 |
| 4377 | B | 390055 |
| 4378 | B | 388524 |
| 4379 | B | 390455 |
| 4380 | B | 389428 |
| 4381 | B | 391321 |
| 4382 | B | 390313 |
| 4383 | B | 392241 |
| 4384 | B | 391321 |
| 4385 | B | 393147 |
| 4386 | B | 392032 |
| 4387 | B | 393943 |
| 4388 | B | 394245 |
| 4389 | B | 396116 |
| 4390 | B | 395604 |
| 4391 | B | 397475 |
| 4392 | B | 396249 |
| 4393 | B | 398133 |
| 4394 | B | 396759 |
| 4395 | B | 398660 |
| 4396 | B | 397746 |
| 4397 | B | 399639 |
| 4398 | B | 398973 |
| 4399 | B | 400878 |
| 4400 | B | 399921 |
| 4401 | B | 401846 |
| 4402 | B | 400393 |
| 4403 | B | 402287 |
| 4404 | B | 401444 |
| 4405 | B | 403344 |
| 4406 | B | 402258 |
| 4407 | B | 404150 |
| 4408 | B | 403461 |
| 4409 | B | 405340 |
| 4410 | B | 405400 |
| 4411 | B | 407325 |
| 4412 | B | 404027 |
| 4413 | B | 405941 |
| 4414 | B | 406141 |
| 4415 | B | 408055 |
| 4416 | B | 407325 |
| 4417 | B | 409172 |
| 4418 | B | 409999 |
| 4419 | B | 411893 |
| 4420 | B | 411645 |
| 4421 | B | 413542 |
| 4422 | B | 413693 |
| 4423 | B | 415530 |
| 4424 | B | 413693 |
| 4425 | B | 415559 |
| 4426 | B | 414172 |
| 4427 | B | 416072 |
| 4428 | B | 415337 |
| 4429 | B | 417275 |
| 4430 | B | 414599 |
| 4431 | B | 416499 |

TABLE 5-continued

| SEQ ID | Or. | position |
|---|---|---|
| 4432 | B | 416887 |
| 4433 | B | 418821 |
| 4434 | B | 417700 |
| 4435 | B | 419585 |
| 4436 | B | 418274 |
| 4437 | B | 420173 |
| 4438 | B | 418823 |
| 4439 | B | 420732 |
| 4440 | B | 419778 |
| 4441 | B | 421678 |
| 4442 | B | 420461 |
| 4443 | B | 422361 |
| 4444 | B | 421460 |
| 4445 | B | 423336 |
| 4446 | B | 422265 |
| 4447 | B | 424120 |
| 4448 | B | 423263 |
| 4449 | B | 425182 |
| 4450 | B | 425302 |
| 4451 | B | 427252 |
| 4452 | B | 426283 |
| 4453 | B | 428210 |
| 4454 | B | 427252 |
| 4455 | B | 429129 |
| 4456 | B | 428040 |
| 4457 | B | 429940 |
| 4458 | B | 430106 |
| 4459 | B | 432063 |
| 4460 | B | 430580 |
| 4461 | B | 432480 |
| 4462 | B | 430860 |
| 4463 | B | 432776 |
| 4464 | B | 432063 |
| 4465 | B | 433919 |
| 4466 | B | 432263 |
| 4467 | B | 434137 |
| 4468 | B | 434730 |
| 4469 | B | 436671 |
| 4470 | B | 436671 |
| 4471 | B | 438495 |
| 4472 | B | 436803 |
| 4473 | B | 438696 |
| 4474 | B | 437953 |
| 4475 | B | 439850 |
| 4476 | B | 438490 |
| 4477 | B | 440383 |
| 4478 | B | 439374 |
| 4479 | B | 441289 |
| 4480 | B | 439562 |
| 4481 | B | 441466 |
| 4482 | B | 439976 |
| 4483 | B | 441847 |
| 4484 | B | 441301 |
| 4485 | B | 443216 |
| 4486 | B | 442161 |
| 4487 | B | 444066 |
| 4488 | B | 442834 |
| 4489 | B | 444713 |
| 4490 | B | 446608 |
| 4491 | B | 448508 |
| 4492 | B | 448288 |
| 4493 | B | 450225 |
| 4494 | B | 449798 |
| 4495 | B | 451705 |
| 4496 | B | 451345 |
| 4497 | B | 453199 |
| 4498 | B | 451891 |
| 4499 | B | 453768 |
| 4500 | B | 452813 |
| 4501 | B | 454720 |
| 4502 | B | 453439 |
| 4503 | B | 455315 |
| 4504 | B | 455088 |
| 4505 | B | 456988 |
| 4506 | B | 455682 |
| 4507 | B | 457551 |
| 4508 | B | 456302 |
| 4509 | B | 458221 |
| 4510 | B | 457645 |
| 4511 | B | 459519 |
| 4512 | B | 458699 |
| 4513 | B | 460570 |
| 4514 | B | 459867 |
| 4515 | B | 461758 |
| 4516 | B | 461464 |
| 4517 | B | 463337 |
| 4518 | B | 461887 |
| 4519 | B | 463795 |
| 4520 | B | 462842 |
| 4521 | B | 464780 |
| 4522 | B | 464031 |
| 4523 | B | 465946 |
| 4524 | B | 464849 |
| 4525 | B | 466801 |
| 4526 | B | 466078 |
| 4527 | B | 467968 |
| 4528 | B | 467670 |
| 4529 | B | 469540 |
| 4530 | B | 469208 |
| 4531 | B | 471075 |
| 4532 | B | 469520 |
| 4533 | B | 471400 |
| 4534 | B | 469895 |
| 4535 | B | 471798 |
| 4536 | B | 471533 |
| 4537 | B | 473363 |
| 4538 | B | 471867 |
| 4539 | B | 473744 |
| 4540 | B | 473542 |
| 4541 | B | 475387 |
| 4542 | B | 473919 |
| 4543 | B | 475824 |
| 4544 | B | 474747 |
| 4545 | B | 476666 |
| 4546 | B | 475493 |
| 4547 | B | 477373 |
| 4548 | B | 476747 |
| 4549 | B | 478682 |
| 4550 | B | 478861 |
| 4551 | B | 480821 |
| 4552 | B | 479311 |
| 4553 | B | 481243 |
| 4554 | B | 479943 |
| 4555 | B | 481858 |
| 4556 | B | 480257 |
| 4557 | B | 482146 |
| 4558 | B | 481708 |
| 4559 | B | 483633 |
| 4560 | B | 481969 |
| 4561 | B | 483871 |
| 4562 | B | 483668 |
| 4563 | B | 485559 |
| 4564 | B | 485198 |
| 4565 | B | 487094 |
| 4566 | B | 488084 |
| 4567 | B | 489985 |
| 4568 | B | 485945 |
| 4569 | B | 487859 |
| 4570 | B | 489498 |
| 4571 | B | 491367 |
| 4572 | B | 488799 |
| 4573 | B | 490691 |
| 4574 | B | 490677 |
| 4575 | B | 492589 |
| 4576 | B | 492994 |
| 4577 | B | 494929 |
| 4578 | B | 493113 |
| 4579 | B | 495035 |
| 4580 | B | 493985 |
| 4581 | B | 495864 |
| 4582 | B | 494929 |
| 4583 | B | 496801 |
| 4584 | B | 495090 |
| 4585 | B | 496989 |

TABLE 5-continued

| SEQ ID | Or. | position |
|---|---|---|
| 4586 | B | 495585 |
| 4587 | B | 497485 |
| 4588 | B | 495436 |
| 4589 | B | 497304 |
| 4590 | B | 496854 |
| 4591 | B | 498754 |
| 4592 | B | 497396 |
| 4593 | B | 499316 |
| 4594 | B | 498735 |
| 4595 | B | 500635 |
| 4596 | B | 499484 |
| 4597 | B | 501409 |
| 4598 | B | 501005 |
| 4599 | B | 502852 |
| 4600 | B | 501937 |
| 4601 | B | 503853 |
| 4602 | B | 503083 |
| 4603 | B | 505003 |
| 4604 | B | 503895 |
| 4605 | B | 505846 |
| 4606 | B | 505263 |
| 4607 | B | 507137 |
| 4608 | B | 507214 |
| 4609 | B | 509106 |
| 4610 | B | 507687 |
| 4611 | B | 509559 |
| 4612 | B | 508632 |
| 4613 | B | 510534 |
| 4614 | B | 508863 |
| 4615 | B | 510730 |
| 4616 | B | 509202 |
| 4617 | B | 511062 |
| 4618 | B | 510940 |
| 4619 | B | 512832 |
| 4620 | B | 511747 |
| 4621 | B | 513649 |
| 4622 | B | 512446 |
| 4623 | B | 514305 |
| 4624 | B | 513313 |
| 4625 | B | 515212 |
| 4626 | B | 514529 |
| 4627 | B | 516410 |
| 4628 | B | 515466 |
| 4629 | B | 517364 |
| 4630 | B | 515496 |
| 4631 | B | 517389 |
| 4632 | B | 516069 |
| 4633 | B | 517978 |
| 4634 | B | 516642 |
| 4635 | B | 518551 |
| 4636 | B | 517420 |
| 4637 | B | 519349 |
| 4638 | B | 518187 |
| 4639 | B | 520053 |
| 4640 | B | 518617 |
| 4641 | B | 520500 |
| 4642 | B | 519078 |
| 4643 | B | 520963 |
| 4644 | B | 519736 |
| 4645 | B | 521636 |
| 4646 | B | 520719 |
| 4647 | B | 522655 |
| 4648 | B | 522221 |
| 4649 | B | 524115 |
| 4650 | B | 522354 |
| 4651 | B | 524287 |
| 4652 | B | 523763 |
| 4653 | B | 525689 |
| 4654 | B | 524854 |
| 4655 | B | 526756 |
| 4656 | B | 525970 |
| 4657 | B | 527866 |
| 4658 | B | 526312 |
| 4659 | B | 528202 |
| 4660 | B | 526640 |
| 4661 | B | 528553 |
| 4662 | B | 526991 |

TABLE 5-continued

| SEQ ID | Or. | position |
|---|---|---|
| 4663 | B | 528855 |
| 4664 | B | 528553 |
| 4665 | B | 530443 |
| 4666 | B | 529081 |
| 4667 | B | 530988 |
| 4668 | B | 529943 |
| 4669 | B | 531844 |
| 4670 | B | 530424 |
| 4671 | B | 532301 |
| 4672 | B | 530799 |
| 4673 | B | 532675 |
| 4674 | B | 531670 |
| 4675 | B | 533594 |
| 4676 | B | 533498 |
| 4677 | B | 535393 |
| 4678 | B | 534147 |
| 4679 | B | 535997 |
| 4680 | B | 534892 |
| 4681 | B | 536813 |
| 4682 | B | 536191 |
| 4683 | B | 538068 |
| 4684 | B | 539438 |
| 4685 | B | 541306 |
| 4686 | B | 540771 |
| 4687 | B | 542639 |
| 4688 | B | 541223 |
| 4689 | B | 543141 |
| 4690 | B | 542025 |
| 4691 | B | 543927 |
| 4692 | B | 543495 |
| 4693 | B | 545375 |
| 4694 | B | 544367 |
| 4695 | B | 546253 |
| 4696 | B | 544790 |
| 4697 | B | 546697 |
| 4698 | B | 544982 |
| 4699 | B | 546890 |
| 4700 | B | 546655 |
| 4701 | B | 548555 |
| 4702 | B | 547701 |
| 4703 | B | 549667 |
| 4704 | B | 547609 |
| 4705 | B | 549533 |
| 4706 | B | 548121 |
| 4707 | B | 550040 |
| 4708 | B | 548878 |
| 4709 | B | 550836 |
| 4710 | B | 549681 |
| 4711 | B | 551602 |
| 4712 | B | 550605 |
| 4713 | B | 552527 |
| 4714 | B | 551849 |
| 4715 | B | 553750 |
| 4716 | B | 553261 |
| 4717 | B | 555165 |
| 4718 | B | 555176 |
| 4719 | B | 557075 |
| 4720 | B | 556590 |
| 4721 | B | 558489 |
| 4722 | B | 557130 |
| 4723 | B | 559024 |
| 4724 | B | 558346 |
| 4725 | B | 560246 |
| 4726 | B | 558455 |
| 4727 | B | 560376 |
| 4728 | B | 559450 |
| 4729 | B | 561362 |
| 4730 | B | 561581 |
| 4731 | B | 563478 |
| 4732 | B | 563153 |
| 4733 | B | 565073 |
| 4734 | B | 564319 |
| 4735 | B | 566220 |
| 4736 | B | 564201 |
| 4737 | B | 566078 |
| 4738 | B | 567243 |
| 4739 | B | 569143 |

TABLE 5-continued

| SEQ ID | Or. | position |
|---|---|---|
| 4740 | B | 568192 |
| 4741 | B | 570133 |
| 4742 | B | 570619 |
| 4743 | B | 572532 |
| 4744 | B | 572241 |
| 4745 | B | 574208 |
| 4746 | B | 572994 |
| 4747 | B | 574916 |
| 4748 | B | 573744 |
| 4749 | B | 575640 |
| 4750 | B | 573679 |
| 4751 | B | 575571 |
| 4752 | B | 574398 |
| 4753 | B | 576288 |
| 4754 | B | 574677 |
| 4755 | B | 576633 |
| 4756 | B | 575033 |
| 4757 | B | 576922 |
| 4758 | B | 575482 |
| 4759 | B | 577363 |
| 4760 | B | 575699 |
| 4761 | B | 577606 |
| 4762 | B | 576078 |
| 4763 | B | 577993 |
| 4764 | B | 578265 |
| 4765 | B | 580143 |
| 4766 | B | 578948 |
| 4767 | B | 580848 |
| 4768 | B | 582336 |
| 4769 | B | 584225 |
| 4770 | B | 582917 |
| 4771 | B | 584817 |
| 4772 | B | 583359 |
| 4773 | B | 585252 |
| 4774 | B | 583734 |
| 4775 | B | 585634 |
| 4776 | B | 584122 |
| 4777 | B | 585990 |
| 4778 | B | 584665 |
| 4779 | B | 586598 |
| 4780 | B | 585213 |
| 4781 | B | 587123 |
| 4782 | B | 585517 |
| 4783 | B | 587434 |
| 4784 | B | 586850 |
| 4785 | B | 588730 |
| 4786 | B | 588017 |
| 4787 | B | 589878 |
| 4788 | B | 589628 |
| 4789 | B | 591543 |
| 4790 | B | 589798 |
| 4791 | B | 591723 |
| 4792 | B | 590323 |
| 4793 | B | 592211 |
| 4794 | B | 591492 |
| 4795 | B | 593419 |
| 4796 | B | 593002 |
| 4797 | B | 594885 |
| 4798 | B | 593367 |
| 4799 | B | 595321 |
| 4800 | B | 594166 |
| 4801 | B | 596020 |
| 4802 | B | 595942 |
| 4803 | B | 597826 |
| 4804 | B | 596354 |
| 4805 | B | 598255 |
| 4806 | B | 597147 |
| 4807 | B | 598998 |
| 4808 | B | 597960 |
| 4809 | B | 599851 |
| 4810 | B | 601068 |
| 4811 | B | 602929 |
| 4812 | B | 602096 |
| 4813 | B | 603996 |
| 4814 | B | 603761 |
| 4815 | B | 605643 |
| 4816 | B | 604014 |

TABLE 5-continued

| SEQ ID | Or. | position |
|---|---|---|
| 4817 | B | 605920 |
| 4818 | B | 604634 |
| 4819 | B | 606548 |
| 4820 | B | 605864 |
| 4821 | B | 607736 |
| 4822 | B | 606903 |
| 4823 | B | 608742 |
| 4824 | B | 607722 |
| 4825 | B | 609674 |
| 4826 | B | 609329 |
| 4827 | B | 611215 |
| 4828 | B | 609916 |
| 4829 | B | 611866 |
| 4830 | B | 612090 |
| 4831 | B | 613998 |
| 4832 | B | 613166 |
| 4833 | B | 615091 |
| 4834 | B | 613838 |
| 4835 | B | 615761 |
| 4836 | B | 614217 |
| 4837 | B | 616094 |
| 4838 | B | 615464 |
| 4839 | B | 617391 |
| 4840 | B | 615913 |
| 4841 | B | 617803 |
| 4842 | B | 617932 |
| 4843 | B | 619837 |
| 4844 | B | 618598 |
| 4845 | B | 620532 |
| 4846 | B | 619591 |
| 4847 | B | 621465 |
| 4848 | B | 620636 |
| 4849 | B | 622536 |
| 4850 | B | 620532 |
| 4851 | B | 622381 |
| 4852 | B | 621404 |
| 4853 | B | 623307 |
| 4854 | B | 621932 |
| 4855 | B | 623834 |
| 4856 | B | 622666 |
| 4857 | B | 624588 |
| 4858 | B | 623689 |
| 4859 | B | 625605 |
| 4860 | B | 624435 |
| 4861 | B | 626298 |
| 4862 | B | 625204 |
| 4863 | B | 627128 |
| 4864 | B | 626885 |
| 4865 | B | 628790 |
| 4866 | B | 627128 |
| 4867 | B | 629026 |
| 4868 | B | 628073 |
| 4869 | B | 629983 |
| 4870 | B | 628359 |
| 4871 | B | 630267 |
| 4872 | B | 628976 |
| 4873 | B | 630850 |
| 4874 | B | 630023 |
| 4875 | B | 631988 |
| 4876 | B | 630642 |
| 4877 | B | 632526 |
| 4878 | B | 631205 |
| 4879 | B | 633081 |
| 4880 | B | 632046 |
| 4881 | B | 633969 |
| 4882 | B | 638311 |
| 4883 | B | 640204 |
| 4884 | B | 640448 |
| 4885 | B | 642328 |
| 4886 | B | 643695 |
| 4887 | B | 645639 |
| 4888 | B | 640847 |
| 4889 | B | 642769 |
| 4890 | B | 644745 |
| 4891 | B | 646615 |
| 4892 | B | 645686 |
| 4893 | B | 647558 |

TABLE 5-continued

| SEQ ID | Or. | position |
|---|---|---|
| 4894 | B | 646060 |
| 4895 | B | 647972 |
| 4896 | B | 647331 |
| 4897 | B | 649231 |
| 4898 | B | 649987 |
| 4899 | B | 651829 |
| 4900 | B | 650580 |
| 4901 | B | 652484 |
| 4902 | B | 651942 |
| 4903 | B | 653852 |
| 4904 | B | 652395 |
| 4905 | B | 654310 |
| 4906 | B | 653132 |
| 4907 | B | 655028 |
| 4908 | B | 653827 |
| 4909 | B | 655713 |
| 4910 | B | 662071 |
| 4911 | B | 664023 |
| 4912 | B | 662543 |
| 4913 | B | 664403 |
| 4914 | B | 663295 |
| 4915 | B | 665205 |
| 4916 | B | 663972 |
| 4917 | B | 665850 |
| 4918 | B | 664432 |
| 4919 | B | 666332 |
| 4920 | B | 665860 |
| 4921 | B | 667789 |
| 4922 | B | 666312 |
| 4923 | B | 668233 |
| 4924 | B | 666652 |
| 4925 | B | 668550 |
| 4926 | B | 668338 |
| 4927 | B | 670238 |
| 4928 | B | 668605 |
| 4929 | B | 670495 |
| 4930 | B | 668690 |
| 4931 | B | 670590 |
| 4932 | B | 669766 |
| 4933 | B | 671653 |
| 4934 | B | 670160 |
| 4935 | B | 672109 |
| 4936 | B | 671000 |
| 4937 | B | 672900 |
| 4938 | B | 671470 |
| 4939 | B | 673412 |
| 4940 | B | 672685 |
| 4941 | B | 674567 |
| 4942 | B | 673461 |
| 4943 | B | 675365 |
| 4944 | B | 674786 |
| 4945 | B | 676682 |
| 4946 | B | 675456 |
| 4947 | B | 677375 |
| 4948 | B | 676683 |
| 4949 | B | 678594 |
| 4950 | B | 677334 |
| 4951 | B | 679183 |
| 4952 | B | 678726 |
| 4953 | B | 680596 |
| 4954 | B | 679729 |
| 4955 | B | 681628 |
| 4956 | B | 680747 |
| 4957 | B | 682668 |
| 4958 | B | 681500 |
| 4959 | B | 683406 |
| 4960 | B | 682779 |
| 4961 | B | 684716 |
| 4962 | B | 683320 |
| 4963 | B | 685249 |
| 4964 | B | 684716 |
| 4965 | B | 686585 |
| 4966 | B | 685010 |
| 4967 | B | 686897 |
| 4968 | B | 686423 |
| 4969 | B | 688323 |
| 4970 | B | 687426 |

TABLE 5-continued

| SEQ ID | Or. | position |
|---|---|---|
| 4971 | B | 689324 |
| 4972 | B | 688619 |
| 4973 | B | 690482 |
| 4974 | B | 688653 |
| 4975 | B | 690563 |
| 4976 | B | 689836 |
| 4977 | B | 691775 |
| 4978 | B | 690186 |
| 4979 | B | 692088 |
| 4980 | B | 690715 |
| 4981 | B | 692616 |
| 4982 | B | 690937 |
| 4983 | B | 692837 |
| 4984 | B | 692091 |
| 4985 | B | 693991 |
| 4986 | B | 694171 |
| 4987 | B | 696078 |
| 4988 | B | 695197 |
| 4989 | B | 697093 |
| 4990 | B | 697486 |
| 4991 | B | 699428 |
| 4992 | B | 698313 |
| 4993 | B | 700238 |
| 4994 | B | 698646 |
| 4995 | B | 700515 |
| 4996 | B | 700337 |
| 4997 | B | 702249 |
| 4998 | B | 701115 |
| 4999 | B | 703015 |
| 5000 | B | 702385 |
| 5001 | B | 704285 |
| 5002 | B | 703636 |
| 5003 | B | 705561 |
| 5004 | B | 705271 |
| 5005 | B | 707136 |
| 5006 | B | 705875 |
| 5007 | B | 707725 |
| 5008 | B | 706444 |
| 5009 | B | 708279 |
| 5010 | B | 706741 |
| 5011 | B | 708673 |
| 5012 | B | 708324 |
| 5013 | B | 710226 |
| 5014 | B | 708673 |
| 5015 | B | 710518 |
| 5016 | B | 708876 |
| 5017 | B | 710791 |
| 5018 | B | 710498 |
| 5019 | B | 712447 |
| 5020 | B | 711435 |
| 5021 | B | 713354 |
| 5022 | B | 712993 |
| 5023 | B | 714887 |
| 5024 | B | 713686 |
| 5025 | B | 715574 |
| 5026 | B | 714474 |
| 5027 | B | 716354 |
| 5028 | B | 714867 |
| 5029 | B | 716760 |
| 5030 | B | 716047 |
| 5031 | B | 717877 |
| 5032 | B | 716086 |
| 5033 | B | 717976 |
| 5034 | B | 717189 |
| 5035 | B | 719068 |
| 5036 | B | 718624 |
| 5037 | B | 720503 |
| 5038 | B | 719083 |
| 5039 | B | 720983 |
| 5040 | B | 720047 |
| 5041 | B | 722004 |
| 5042 | B | 720503 |
| 5043 | B | 722393 |
| 5044 | B | 720753 |
| 5045 | B | 722653 |
| 5046 | B | 721798 |
| 5047 | B | 723724 |

TABLE 5-continued

| SEQ ID | Or. | position |
|---|---|---|
| 5048 | B | 722631 |
| 5049 | B | 724493 |
| 5050 | B | 723468 |
| 5051 | B | 725376 |
| 5052 | B | 724852 |
| 5053 | B | 726743 |
| 5054 | B | 726005 |
| 5055 | B | 727903 |
| 5056 | B | 726779 |
| 5057 | B | 728691 |
| 5058 | B | 727058 |
| 5059 | B | 728947 |
| 5060 | B | 727727 |
| 5061 | B | 729613 |
| 5062 | B | 728224 |
| 5063 | B | 730116 |
| 5064 | B | 729048 |
| 5065 | B | 730907 |
| 5066 | B | 729566 |
| 5067 | B | 731468 |
| 5068 | B | 732909 |
| 5069 | B | 734770 |
| 5070 | B | 734663 |
| 5071 | B | 736569 |
| 5072 | B | 735879 |
| 5073 | B | 737785 |
| 5074 | B | 736724 |
| 5075 | B | 738632 |
| 5076 | B | 737474 |
| 5077 | B | 739421 |
| 5078 | B | 738007 |
| 5079 | B | 739907 |
| 5080 | B | 738911 |
| 5081 | B | 740799 |
| 5082 | B | 739960 |
| 5083 | B | 741908 |
| 5084 | B | 742277 |
| 5085 | B | 744187 |
| 5086 | B | 743089 |
| 5087 | B | 744989 |
| 5088 | B | 743603 |
| 5089 | B | 745539 |
| 5090 | B | 744565 |
| 5091 | B | 746432 |
| 5092 | B | 744977 |
| 5093 | B | 746867 |
| 5094 | B | 745249 |
| 5095 | B | 747138 |
| 5096 | B | 745777 |
| 5097 | B | 747677 |
| 5098 | B | 746632 |
| 5099 | B | 748532 |
| 5100 | B | 747054 |
| 5101 | B | 748893 |
| 5102 | B | 748519 |
| 5103 | B | 750396 |
| 5104 | B | 749186 |
| 5105 | B | 751108 |
| 5106 | B | 749646 |
| 5107 | B | 751546 |
| 5108 | B | 749922 |
| 5109 | B | 751824 |
| 5110 | B | 750260 |
| 5111 | B | 752151 |
| 5112 | B | 752527 |
| 5113 | B | 754427 |
| 5114 | B | 753169 |
| 5115 | B | 755064 |
| 5116 | B | 755004 |
| 5117 | B | 756843 |
| 5118 | B | 757034 |
| 5119 | B | 758991 |
| 5120 | B | 758532 |
| 5121 | B | 760452 |
| 5122 | B | 758911 |
| 5123 | B | 760841 |
| 5124 | B | 760015 |

TABLE 5-continued

| SEQ ID | Or. | position |
|---|---|---|
| 5125 | B | 761913 |
| 5126 | B | 760463 |
| 5127 | B | 762363 |
| 5128 | B | 760782 |
| 5129 | B | 762671 |
| 5130 | B | 762053 |
| 5131 | B | 763911 |
| 5132 | B | 762363 |
| 5133 | B | 764264 |
| 5134 | B | 763203 |
| 5135 | B | 765107 |
| 5136 | B | 764690 |
| 5137 | B | 766595 |
| 5138 | B | 765107 |
| 5139 | B | 766977 |
| 5140 | B | 766327 |
| 5141 | B | 768221 |
| 5142 | B | 766932 |
| 5143 | B | 768851 |
| 5144 | B | 768314 |
| 5145 | B | 770221 |
| 5146 | B | 769045 |
| 5147 | B | 770945 |
| 5148 | B | 770315 |
| 5149 | B | 772234 |
| 5150 | B | 770705 |
| 5151 | B | 772598 |
| 5152 | B | 770882 |
| 5153 | B | 772781 |
| 5154 | B | 771156 |
| 5155 | B | 773044 |
| 5156 | B | 772234 |
| 5157 | B | 774148 |
| 5158 | B | 773611 |
| 5159 | B | 775511 |
| 5160 | B | 774513 |
| 5161 | B | 776404 |
| 5162 | B | 776333 |
| 5163 | B | 778191 |
| 5164 | B | 777926 |
| 5165 | B | 779832 |
| 5166 | B | 777455 |
| 5167 | B | 779380 |
| 5168 | B | 779476 |
| 5169 | B | 781342 |
| 5170 | B | 781774 |
| 5171 | B | 783686 |
| 5172 | B | 782667 |
| 5173 | B | 784562 |
| 5174 | B | 785748 |
| 5175 | B | 787658 |
| 5176 | B | 786222 |
| 5177 | B | 788126 |
| 5178 | B | 786803 |
| 5179 | B | 788703 |
| 5180 | B | 787998 |
| 5181 | B | 789876 |
| 5182 | B | 788279 |
| 5183 | B | 790255 |
| 5184 | B | 790369 |
| 5185 | B | 792247 |
| 5186 | B | 790862 |
| 5187 | B | 792787 |
| 5188 | B | 792247 |
| 5189 | B | 794137 |
| 5190 | B | 793352 |
| 5191 | B | 795215 |
| 5192 | B | 794276 |
| 5193 | B | 796196 |
| 5194 | B | 795215 |
| 5195 | B | 797077 |
| 5196 | B | 795667 |
| 5197 | B | 797571 |
| 5198 | B | 796515 |
| 5199 | B | 798382 |
| 5200 | B | 797235 |
| 5201 | B | 799168 |

TABLE 5-continued

| SEQ ID | Or. | position |
|---|---|---|
| 5202 | B | 797585 |
| 5203 | B | 799553 |
| 5204 | B | 798102 |
| 5205 | B | 799976 |
| 5206 | B | 798306 |
| 5207 | B | 800214 |
| 5208 | B | 798662 |
| 5209 | B | 800546 |
| 5210 | B | 799168 |
| 5211 | B | 801074 |
| 5212 | B | 800159 |
| 5213 | B | 802054 |
| 5214 | B | 801153 |
| 5215 | B | 803031 |
| 5216 | B | 802363 |
| 5217 | B | 804257 |
| 5218 | B | 802893 |
| 5219 | B | 804802 |
| 5220 | B | 803466 |
| 5221 | B | 805366 |
| 5222 | B | 804440 |
| 5223 | B | 806374 |
| 5224 | B | 805576 |
| 5225 | B | 807523 |
| 5226 | B | 806511 |
| 5227 | B | 808410 |
| 5228 | B | 808305 |
| 5229 | B | 810207 |
| 5230 | B | 809229 |
| 5231 | B | 811164 |
| 5232 | B | 810700 |
| 5233 | B | 812581 |
| 5234 | B | 811825 |
| 5235 | B | 813787 |
| 5236 | B | 812574 |
| 5237 | B | 814467 |
| 5238 | B | 813787 |
| 5239 | B | 815676 |
| 5240 | B | 814082 |
| 5241 | B | 815892 |
| 5242 | B | 814571 |
| 5243 | B | 816454 |
| 5244 | B | 815441 |
| 5245 | B | 817347 |
| 5246 | B | 815101 |
| 5247 | B | 817025 |
| 5248 | B | 815953 |
| 5249 | B | 817887 |
| 5250 | B | 817709 |
| 5251 | B | 819618 |
| 5252 | B | 819559 |
| 5253 | B | 821442 |
| 5254 | B | 819933 |
| 5255 | B | 821846 |
| 5256 | B | 820622 |
| 5257 | B | 822548 |
| 5258 | B | 821281 |
| 5259 | B | 823181 |
| 5260 | B | 821778 |
| 5261 | B | 823666 |
| 5262 | B | 822494 |
| 5263 | B | 824387 |
| 5264 | B | 823155 |
| 5265 | B | 825057 |
| 5266 | B | 824589 |
| 5267 | B | 826509 |
| 5268 | B | 826122 |
| 5269 | B | 828041 |
| 5270 | B | 826572 |
| 5271 | B | 828500 |
| 5272 | B | 827246 |
| 5273 | B | 829208 |
| 5274 | B | 827489 |
| 5275 | B | 829407 |
| 5276 | B | 828274 |
| 5277 | B | 830176 |
| 5278 | B | 829495 |

TABLE 5-continued

| SEQ ID | Or. | position |
|---|---|---|
| 5279 | B | 831395 |
| 5280 | B | 831192 |
| 5281 | B | 833082 |
| 5282 | B | 832005 |
| 5283 | B | 833870 |
| 5284 | B | 832373 |
| 5285 | B | 834280 |
| 5286 | B | 832964 |
| 5287 | B | 834864 |
| 5288 | B | 833672 |
| 5289 | B | 835604 |
| 5290 | B | 834022 |
| 5291 | B | 835945 |
| 5292 | B | 834907 |
| 5293 | B | 836803 |
| 5294 | B | 835683 |
| 5295 | B | 837593 |
| 5296 | B | 836018 |
| 5297 | B | 837902 |
| 5298 | B | 836714 |
| 5299 | B | 838602 |
| 5300 | B | 837484 |
| 5301 | B | 839424 |
| 5302 | B | 838950 |
| 5303 | B | 840832 |
| 5304 | B | 839800 |
| 5305 | B | 841700 |
| 5306 | B | 840808 |
| 5307 | B | 842715 |
| 5308 | B | 841975 |
| 5309 | B | 843834 |
| 5310 | B | 842679 |
| 5311 | B | 844614 |
| 5312 | B | 843342 |
| 5313 | B | 845247 |
| 5314 | B | 843736 |
| 5315 | B | 845626 |
| 5316 | B | 846423 |
| 5317 | B | 848330 |
| 5318 | B | 844423 |
| 5319 | B | 846258 |
| 5320 | B | 848265 |
| 5321 | B | 850174 |
| 5322 | B | 850343 |
| 5323 | B | 852246 |
| 5324 | B | 851875 |
| 5325 | B | 853765 |
| 5326 | B | 853944 |
| 5327 | B | 855822 |
| 5328 | B | 855056 |
| 5329 | B | 856964 |
| 5330 | B | 855750 |
| 5331 | B | 857714 |
| 5332 | B | 856488 |
| 5333 | B | 858370 |
| 5334 | B | 857403 |
| 5335 | B | 859303 |
| 5336 | B | 859659 |
| 5337 | B | 861570 |
| 5338 | B | 860166 |
| 5339 | B | 862082 |
| 5340 | B | 860879 |
| 5341 | B | 862767 |
| 5342 | B | 861861 |
| 5343 | B | 863727 |
| 5344 | B | 862284 |
| 5345 | B | 864173 |
| 5346 | B | 863792 |
| 5347 | B | 865660 |
| 5348 | B | 864164 |
| 5349 | B | 866050 |
| 5350 | B | 864925 |
| 5351 | B | 866860 |
| 5352 | B | 866468 |
| 5353 | B | 868368 |
| 5354 | B | 866860 |
| 5355 | B | 868734 |

TABLE 5-continued

| SEQ ID | Or. | position |
|---|---|---|
| 5356 | B | 867952 |
| 5357 | B | 869878 |
| 5358 | B | 869311 |
| 5359 | B | 871226 |
| 5360 | B | 869582 |
| 5361 | B | 871517 |
| 5362 | B | 871614 |
| 5363 | B | 873536 |
| 5364 | B | 872804 |
| 5365 | B | 874702 |
| 5366 | B | 873093 |
| 5367 | B | 874980 |
| 5368 | B | 874158 |
| 5369 | B | 876056 |
| 5370 | B | 874033 |
| 5371 | B | 875932 |
| 5372 | B | 874670 |
| 5373 | B | 876580 |
| 5374 | B | 875606 |
| 5375 | B | 877506 |
| 5376 | B | 876619 |
| 5377 | B | 878519 |
| 5378 | B | 878160 |
| 5379 | B | 880034 |
| 5380 | B | 878429 |
| 5381 | B | 880292 |
| 5382 | B | 879336 |
| 5383 | B | 881230 |
| 5384 | B | 879393 |
| 5385 | B | 881281 |
| 5386 | B | 880089 |
| 5387 | B | 881994 |
| 5388 | B | 881108 |
| 5389 | B | 883062 |
| 5390 | B | 882094 |
| 5391 | B | 884013 |
| 5392 | B | 883124 |
| 5393 | B | 885027 |
| 5394 | B | 884014 |
| 5395 | B | 885924 |
| 5396 | B | 884530 |
| 5397 | B | 886432 |
| 5398 | B | 885226 |
| 5399 | B | 887139 |
| 5400 | B | 889010 |
| 5401 | B | 890900 |
| 5402 | B | 890421 |
| 5403 | B | 892310 |
| 5404 | B | 891438 |
| 5405 | B | 893287 |
| 5406 | B | 891703 |
| 5407 | B | 893606 |
| 5408 | B | 893606 |
| 5409 | B | 895490 |
| 5410 | B | 894049 |
| 5411 | B | 896024 |
| 5412 | B | 894139 |
| 5413 | B | 896074 |
| 5414 | B | 894545 |
| 5415 | B | 896413 |
| 5416 | B | 894999 |
| 5417 | B | 896912 |
| 5418 | B | 896127 |
| 5419 | B | 898012 |
| 5420 | B | 897049 |
| 5421 | B | 898949 |
| 5422 | B | 901018 |
| 5423 | B | 902955 |
| 5424 | B | 902393 |
| 5425 | B | 904301 |
| 5426 | B | 904098 |
| 5427 | B | 906002 |
| 5428 | B | 903951 |
| 5429 | B | 905851 |
| 5430 | B | 905825 |
| 5431 | B | 907725 |
| 5432 | B | 906700 |

TABLE 5-continued

| SEQ ID | Or. | position |
|---|---|---|
| 5433 | B | 908669 |
| 5434 | B | 907174 |
| 5435 | B | 909066 |
| 5436 | B | 907579 |
| 5437 | B | 909480 |
| 5438 | B | 908962 |
| 5439 | B | 910922 |
| 5440 | B | 909415 |
| 5441 | B | 911315 |
| 5442 | B | 909804 |
| 5443 | B | 911704 |
| 5444 | B | 910218 |
| 5445 | B | 912075 |
| 5446 | B | 910834 |
| 5447 | B | 912689 |
| 5448 | B | 911225 |
| 5449 | B | 913064 |
| 5450 | B | 912492 |
| 5451 | B | 914381 |
| 5452 | B | 912852 |
| 5453 | B | 914763 |
| 5454 | B | 913438 |
| 5455 | B | 915340 |
| 5456 | B | 913901 |
| 5457 | B | 915814 |
| 5458 | B | 914730 |
| 5459 | B | 916694 |
| 5460 | B | 915356 |
| 5461 | B | 917256 |
| 5462 | B | 915717 |
| 5463 | B | 917608 |
| 5464 | B | 916854 |
| 5465 | B | 918761 |
| 5466 | B | 916762 |
| 5467 | B | 918712 |
| 5468 | B | 917848 |
| 5469 | B | 919756 |
| 5470 | B | 918588 |
| 5471 | B | 920424 |
| 5472 | B | 918875 |
| 5473 | B | 920796 |
| 5474 | B | 919756 |
| 5475 | B | 921710 |
| 5476 | B | 920055 |
| 5477 | B | 921949 |
| 5478 | B | 920389 |
| 5479 | B | 922328 |
| 5480 | B | 921130 |
| 5481 | B | 922978 |
| 5482 | B | 921517 |
| 5483 | B | 923414 |
| 5484 | B | 921740 |
| 5485 | B | 923646 |
| 5486 | B | 921979 |
| 5487 | B | 923926 |
| 5488 | B | 922396 |
| 5489 | B | 924327 |
| 5490 | B | 922729 |
| 5491 | B | 924611 |
| 5492 | B | 923256 |
| 5493 | B | 925216 |
| 5494 | B | 923673 |
| 5495 | B | 925589 |
| 5496 | B | 924297 |
| 5497 | B | 926176 |
| 5498 | B | 924645 |
| 5499 | B | 926555 |
| 5500 | B | 925216 |
| 5501 | B | 927117 |
| 5502 | B | 925589 |
| 5503 | B | 927489 |
| 5504 | B | 926980 |
| 5505 | B | 928903 |
| 5506 | B | 927408 |
| 5507 | B | 929331 |
| 5508 | B | 927824 |
| 5509 | B | 929727 |

TABLE 5-continued

| SEQ ID | Or. | position |
|---|---|---|
| 5510 | B | 928418 |
| 5511 | B | 930287 |
| 5512 | B | 928979 |
| 5513 | B | 930879 |
| 5514 | B | 930474 |
| 5515 | B | 932367 |
| 5516 | B | 930879 |
| 5517 | B | 932776 |
| 5518 | B | 931298 |
| 5519 | B | 933223 |
| 5520 | B | 931886 |
| 5521 | B | 933812 |
| 5522 | B | 932187 |
| 5523 | B | 934117 |
| 5524 | B | 932803 |
| 5525 | B | 934733 |
| 5526 | B | 933421 |
| 5527 | B | 935352 |
| 5528 | B | 933841 |
| 5529 | B | 935758 |
| 5530 | B | 934062 |
| 5531 | B | 935933 |
| 5532 | B | 934794 |
| 5533 | B | 936682 |
| 5534 | B | 936606 |
| 5535 | B | 938521 |
| 5536 | B | 938373 |
| 5537 | B | 940324 |
| 5538 | B | 939321 |
| 5539 | B | 941229 |
| 5540 | B | 941153 |
| 5541 | B | 943053 |
| 5542 | B | 942291 |
| 5543 | B | 944212 |
| 5544 | B | 944964 |
| 5545 | B | 946809 |
| 5546 | B | 945527 |
| 5547 | B | 947426 |
| 5548 | B | 946546 |
| 5549 | B | 948430 |
| 5550 | B | 946896 |
| 5551 | B | 948823 |
| 5552 | B | 948677 |
| 5553 | B | 950581 |
| 5554 | B | 949505 |
| 5555 | B | 951398 |
| 5556 | B | 949834 |
| 5557 | B | 951743 |
| 5558 | B | 950897 |
| 5559 | B | 952796 |
| 5560 | B | 951550 |
| 5561 | B | 953534 |
| 5562 | B | 951870 |
| 5563 | B | 953763 |
| 5564 | B | 953037 |
| 5565 | B | 954930 |
| 5566 | B | 954509 |
| 5567 | B | 956384 |
| 5568 | B | 955397 |
| 5569 | B | 957278 |
| 5570 | B | 958191 |
| 5571 | B | 960060 |
| 5572 | B | 959570 |
| 5573 | B | 961432 |
| 5574 | B | 961273 |
| 5575 | B | 963183 |
| 5576 | B | 961837 |
| 5577 | B | 963749 |
| 5578 | B | 962823 |
| 5579 | B | 964695 |
| 5580 | B | 962199 |
| 5581 | B | 964099 |
| 5582 | B | 965286 |
| 5583 | B | 967118 |
| 5584 | B | 965928 |
| 5585 | B | 967828 |
| 5586 | B | 967261 |

TABLE 5-continued

| SEQ ID | Or. | position |
|---|---|---|
| 5587 | B | 969179 |
| 5588 | B | 968345 |
| 5589 | B | 970181 |
| 5590 | B | 969123 |
| 5591 | B | 971023 |
| 5592 | B | 970973 |
| 5593 | B | 972849 |
| 5594 | B | 972081 |
| 5595 | B | 973933 |
| 5596 | B | 973279 |
| 5597 | B | 975173 |
| 5598 | B | 974803 |
| 5599 | B | 976683 |
| 5600 | B | 975459 |
| 5601 | B | 977346 |
| 5602 | B | 976431 |
| 5603 | B | 978335 |
| 5604 | B | 976740 |
| 5605 | B | 978640 |
| 5606 | B | 977175 |
| 5607 | B | 979042 |
| 5608 | B | 977855 |
| 5609 | B | 979768 |
| 5610 | B | 978153 |
| 5611 | B | 980060 |
| 5612 | B | 978655 |
| 5613 | B | 980553 |
| 5614 | B | 979204 |
| 5615 | B | 981104 |
| 5616 | B | 979554 |
| 5617 | B | 981465 |
| 5618 | B | 981423 |
| 5619 | B | 983319 |
| 5620 | B | 980363 |
| 5621 | B | 982289 |
| 5622 | B | 982361 |
| 5623 | B | 984236 |
| 5624 | B | 983818 |
| 5625 | B | 985718 |
| 5626 | B | 984720 |
| 5627 | B | 986608 |
| 5628 | B | 985607 |
| 5629 | B | 987553 |
| 5630 | B | 986323 |
| 5631 | B | 988223 |
| 5632 | B | 986925 |
| 5633 | B | 988825 |
| 5634 | B | 987850 |
| 5635 | B | 989749 |
| 5636 | B | 988354 |
| 5637 | B | 990252 |
| 5638 | B | 988474 |
| 5639 | B | 990393 |
| 5640 | B | 989437 |
| 5641 | B | 991305 |
| 5642 | B | 993662 |
| 5643 | B | 995596 |
| 5644 | B | 994015 |
| 5645 | B | 995906 |
| 5646 | B | 994084 |
| 5647 | B | 995955 |
| 5648 | B | 994523 |
| 5649 | B | 996382 |
| 5650 | B | 995903 |
| 5651 | B | 997791 |
| 5652 | B | 996831 |
| 5653 | B | 998764 |
| 5654 | B | 998505 |
| 5655 | B | 1000417 |
| 5656 | B | 999445 |
| 5657 | B | 1001345 |
| 5658 | B | 1001253 |
| 5659 | B | 1003169 |
| 5660 | B | 1001751 |
| 5661 | B | 1003637 |
| 5662 | B | 1001954 |
| 5663 | B | 1003786 |

TABLE 5-continued

| SEQ ID | Or. | position |
|---|---|---|
| 5664 | B | 1004003 |
| 5665 | B | 1005872 |
| 5666 | B | 1005114 |
| 5667 | B | 1006999 |
| 5668 | B | 1005620 |
| 5669 | B | 1007561 |
| 5670 | B | 1007761 |
| 5671 | B | 1009618 |
| 5672 | B | 1008052 |
| 5673 | B | 1009941 |
| 5674 | B | 1008954 |
| 5675 | B | 1010818 |
| 5676 | B | 1009679 |
| 5677 | B | 1011621 |
| 5678 | B | 1012274 |
| 5679 | B | 1014193 |
| 5680 | B | 1012682 |
| 5681 | B | 1014550 |
| 5682 | B | 1012855 |
| 5683 | B | 1014755 |
| 5684 | B | 1013104 |
| 5685 | B | 1014996 |
| 5686 | B | 1013698 |
| 5687 | B | 1015571 |
| 5688 | B | 1014289 |
| 5689 | B | 1016181 |
| 5690 | B | 1014730 |
| 5691 | B | 1016653 |
| 5692 | B | 1015459 |
| 5693 | B | 1017377 |
| 5694 | B | 1016272 |
| 5695 | B | 1018122 |
| 5696 | B | 1017377 |
| 5697 | B | 1019285 |
| 5698 | B | 1018043 |
| 5699 | B | 1019888 |
| 5700 | B | 1019146 |
| 5701 | B | 1021064 |
| 5702 | B | 1019421 |
| 5703 | B | 1021323 |
| 5704 | B | 1020440 |
| 5705 | B | 1022319 |
| 5706 | B | 1021269 |
| 5707 | B | 1023161 |
| 5708 | B | 1021789 |
| 5709 | B | 1023722 |
| 5710 | B | 1022638 |
| 5711 | B | 1024535 |
| 5712 | B | 1023900 |
| 5713 | B | 1025787 |
| 5714 | B | 1024169 |
| 5715 | B | 1026083 |
| 5716 | B | 1024996 |
| 5717 | B | 1026938 |
| 5718 | B | 1025295 |
| 5719 | B | 1027165 |
| 5720 | B | 1026136 |
| 5721 | B | 1028031 |
| 5722 | B | 1026823 |
| 5723 | B | 1028699 |
| 5724 | B | 1027642 |
| 5725 | B | 1029524 |
| 5726 | B | 1030824 |
| 5727 | B | 1032737 |
| 5728 | B | 1033510 |
| 5729 | B | 1035372 |
| 5730 | B | 1032306 |
| 5731 | B | 1034209 |
| 5732 | B | 1037275 |
| 5733 | B | 1162 |
| 5734 | B | 1036130 |
| 5735 | B | 1038037 |
| 5736 | B | 1036727 |
| 5737 | B | 149 |
| 5738 | B | 225 |
| 5739 | B | 2104 |
| 5740 | B | 17209 |

TABLE 5-continued

| SEQ ID | Or. | position |
|---|---|---|
| 5741 | B | 19109 |
| 5742 | B | 32032 |
| 5743 | B | 33899 |
| 5744 | B | 57057 |
| 5745 | B | 58954 |
| 5746 | B | 57141 |
| 5747 | B | 59033 |
| 5748 | B | 65406 |
| 5749 | B | 67210 |
| 5750 | B | 73871 |
| 5751 | B | 75741 |
| 5752 | B | 78956 |
| 5753 | B | 80903 |
| 5754 | B | 80042 |
| 5755 | B | 81944 |
| 5756 | B | 82642 |
| 5757 | B | 84491 |
| 5758 | B | 87820 |
| 5759 | B | 89658 |
| 5760 | B | 110184 |
| 5761 | B | 112086 |
| 5762 | B | 111873 |
| 5763 | B | 113837 |
| 5764 | B | 112302 |
| 5765 | B | 114206 |
| 5766 | B | 113165 |
| 5767 | B | 115093 |
| 5768 | B | 114270 |
| 5769 | B | 116158 |
| 5770 | B | 121039 |
| 5771 | B | 122904 |
| 5772 | B | 125742 |
| 5773 | B | 127643 |
| 5774 | B | 132170 |
| 5775 | B | 134028 |
| 5776 | B | 144647 |
| 5777 | B | 146547 |
| 5778 | B | 150960 |
| 5779 | B | 152837 |
| 5780 | B | 164761 |
| 5781 | B | 166686 |
| 5782 | B | 166362 |
| 5783 | B | 168305 |
| 5784 | B | 168970 |
| 5785 | B | 170889 |
| 5786 | B | 171056 |
| 5787 | B | 173021 |
| 5788 | B | 177747 |
| 5789 | B | 179629 |
| 5790 | B | 188605 |
| 5791 | B | 190552 |
| 5792 | B | 189016 |
| 5793 | B | 190924 |
| 5794 | B | 190871 |
| 5795 | B | 192749 |
| 5796 | B | 197533 |
| 5797 | B | 199449 |
| 5798 | B | 211604 |
| 5799 | B | 213554 |
| 5800 | B | 235455 |
| 5801 | B | 237385 |
| 5802 | B | 237448 |
| 5803 | B | 239387 |
| 5804 | B | 250266 |
| 5805 | B | 252155 |
| 5806 | B | 253731 |
| 5807 | B | 255663 |
| 5808 | B | 255115 |
| 5809 | B | 256969 |
| 5810 | B | 272158 |
| 5811 | B | 274093 |
| 5812 | B | 276317 |
| 5813 | B | 278190 |
| 5814 | B | 278470 |
| 5815 | B | 280366 |
| 5816 | B | 283005 |
| 5817 | B | 284873 |

TABLE 5-continued

| SEQ ID | Or. | position |
|---|---|---|
| 5818 | B | 293718 |
| 5819 | B | 295643 |
| 5820 | B | 303690 |
| 5821 | B | 305624 |
| 5822 | B | 309538 |
| 5823 | B | 311476 |
| 5824 | B | 312791 |
| 5825 | B | 314685 |
| 5826 | B | 313073 |
| 5827 | B | 314977 |
| 5828 | B | 313506 |
| 5829 | B | 315343 |
| 5830 | B | 320823 |
| 5831 | B | 322730 |
| 5832 | B | 340723 |
| 5833 | B | 342638 |
| 5834 | B | 353562 |
| 5835 | B | 355444 |
| 5836 | B | 373944 |
| 5837 | B | 375838 |
| 5838 | B | 377997 |
| 5839 | B | 379877 |
| 5840 | B | 379877 |
| 5841 | B | 381778 |
| 5842 | B | 395318 |
| 5843 | B | 397228 |
| 5844 | B | 401846 |
| 5845 | B | 403782 |
| 5846 | B | 410759 |
| 5847 | B | 412677 |
| 5848 | B | 411878 |
| 5849 | B | 413779 |
| 5850 | B | 415199 |
| 5851 | B | 417099 |
| 5852 | B | 423479 |
| 5853 | B | 425332 |
| 5854 | B | 428421 |
| 5855 | B | 430332 |
| 5856 | B | 429678 |
| 5857 | B | 431571 |
| 5858 | B | 443036 |
| 5859 | B | 444947 |
| 5860 | B | 444280 |
| 5861 | B | 446161 |
| 5862 | B | 443964 |
| 5863 | B | 445811 |
| 5864 | B | 446392 |
| 5865 | B | 448276 |
| 5866 | B | 468498 |
| 5867 | B | 470382 |
| 5868 | B | 472328 |
| 5869 | B | 474285 |
| 5870 | B | 488594 |
| 5871 | B | 490459 |
| 5872 | B | 497914 |
| 5873 | B | 499837 |
| 5874 | B | 500718 |
| 5875 | B | 502596 |
| 5876 | B | 509811 |
| 5877 | B | 511702 |
| 5878 | B | 511485 |
| 5879 | B | 513385 |
| 5880 | B | 527090 |
| 5881 | B | 529014 |
| 5882 | B | 532083 |
| 5883 | B | 533999 |
| 5884 | B | 557487 |
| 5885 | B | 559357 |
| 5886 | B | 565191 |
| 5887 | B | 567099 |
| 5888 | B | 567452 |
| 5889 | B | 569355 |
| 5890 | B | 571110 |
| 5891 | B | 573047 |
| 5892 | B | 571557 |
| 5893 | B | 573461 |
| 5894 | B | 576288 |

TABLE 5-continued

| SEQ ID | Or. | position |
|---|---|---|
| 5895 | B | 578181 |
| 5896 | B | 590890 |
| 5897 | B | 592770 |
| 5898 | B | 598813 |
| 5899 | B | 600714 |
| 5900 | B | 607146 |
| 5901 | B | 609012 |
| 5902 | B | 608260 |
| 5903 | B | 610162 |
| 5904 | B | 610621 |
| 5905 | B | 612514 |
| 5906 | B | 633573 |
| 5907 | B | 635473 |
| 5908 | B | 637702 |
| 5909 | B | 639603 |
| 5910 | B | 650757 |
| 5911 | B | 652667 |
| 5912 | B | 652808 |
| 5913 | B | 654682 |
| 5914 | B | 655545 |
| 5915 | B | 657446 |
| 5916 | B | 661392 |
| 5917 | B | 663292 |
| 5918 | B | 677837 |
| 5919 | B | 679716 |
| 5920 | B | 679748 |
| 5921 | B | 681674 |
| 5922 | B | 732909 |
| 5923 | B | 734756 |
| 5924 | B | 742639 |
| 5925 | B | 744503 |
| 5926 | B | 759613 |
| 5927 | B | 761510 |
| 5928 | B | 760782 |
| 5929 | B | 762671 |
| 5930 | B | 771617 |
| 5931 | B | 773519 |
| 5932 | B | 772628 |
| 5933 | B | 774528 |
| 5934 | B | 788703 |
| 5935 | B | 790577 |
| 5936 | B | 816591 |
| 5937 | B | 818443 |
| 5938 | B | 847145 |
| 5939 | B | 849042 |
| 5940 | B | 868276 |
| 5941 | B | 870177 |
| 5942 | B | 875887 |
| 5943 | B | 877779 |
| 5944 | B | 877137 |
| 5945 | B | 879035 |
| 5946 | B | 884780 |
| 5947 | B | 886680 |
| 5948 | B | 892172 |
| 5949 | B | 894073 |
| 5950 | B | 900990 |
| 5951 | B | 902955 |
| 5952 | B | 902780 |
| 5953 | B | 904687 |
| 5954 | B | 908266 |
| 5955 | B | 910218 |
| 5956 | B | 912811 |
| 5957 | B | 914730 |
| 5958 | B | 935988 |
| 5959 | B | 937863 |
| 5960 | B | 947227 |
| 5961 | B | 949089 |
| 5962 | B | 953426 |
| 5963 | B | 955397 |
| 5964 | B | 966421 |
| 5965 | B | 968345 |
| 5966 | B | 969548 |
| 5967 | B | 971477 |
| 5968 | B | 971390 |
| 5969 | B | 973279 |
| 5970 | B | 972661 |
| 5971 | B | 974581 |

TABLE 5-continued

| SEQ ID | Or. | position |
|---|---|---|
| 5972 | B | 973730 |
| 5973 | B | 975665 |
| 5974 | B | 998885 |
| 5975 | B | 1000774 |
| 5976 | B | 1004572 |
| 5977 | B | 1006449 |
| 5978 | B | 1010507 |
| 5979 | B | 1012353 |
| 5980 | B | 1029707 |
| 5981 | B | 1031628 |

PUBLICATIONS CITED IN THE SPECIFICATION

Adames et al., 1985, Nature, 318:533–538.

Altschul et al., 1993, Nature Genetics, 3:266–272.

Altschul et al., 1997, Nucl. Acids Res., 25:3389–3402.

Altschul, S. F. et al., 1990, J. Mol. Biol., 215:403–410.

Ansubel et al., 1989, Current Protocols in Molecular Biology, Green Publishing Associates and Wiley Interscience, NY.

Arlinghaus, H. F. et al., 1997, Anal. Biochem., 69, 18, 3747–53.

Bai, M. Et al., 1993, J. Virol., 67:5198–5205.

Barany, F., 1911, Proc. Natl. Acad. Sci. USA, 88:189–193.

Beattie, K. et al., 1993, Clin. Chem., 39(4):719–721.

Bernoist and Chambon, 1981, Nature, 290:304–310.

Borman, S., 1996, Chem. Eng. News, 74(50):42–43.

Brinster et al., 1982, Nature, 296:39–42.

Buckholz, R. G., 1993, Curr. Op. Biotechnology, 4:538–542.

Burg, J. L. et al., 1996, Mol. and Cell. Probes, 10:257–271.

Casas-Ciria J. et al., 1996

Chatelier, R. C. et al., 1995, Anal. Biochem., 229, 1, 112–118.

Chee, M. et al., 1996, Science, 274:610–613.

Chu, B. C. F. et al., 1986, Nucleic Acids Research, 14:5591–5603.

Cole et al., 1985, in Monoclonal Antibodies and Cancer Therapy, Alan R. Liss, Inc., pp. 77–96.

Cote et al., 1983, PNAS USA, 80:2026–2030.

Cserzo, M., Wallin, E., Simon, I. von Heijne G and Elofsson, A., 1997, Prot. Eng., 10:673–676.

DeBoer et al., 1980, Scientific American, 242:74–94.

DeBoer et al., 1983, PNAS USA, 80:21–25.

Derisi, J. et al., 1996, Nature Genet., 14:457–460.

Duck, P. et al., 1990, Biotechniques, 9:142–147.

Edwards, C. P., and Aruffo, A., 1993, Curr. Op. Biotechnology 4:558–563.

Erlich, H. A., 1989, In PCR Technology. Principles and Applications for DNA Amplification. New York: Stockton Press.

Fanger and Drakeman, 1995, Drug News and Perspectives, 8:133–137.

Felgner, et al., 1987, Proc. Natl. Acad. Sci. USA, 84:7413.

Fodor, S. P. A. et al., 1991, Science, 251:767–771.

Fox, G. Et al., 1989, J. Gen. Virol., 70:625–637.

Fraley et al., 1980, J. Biol. Chem., 255:10431.

Gardner et al., 1981, Nucl. Acids Res. 9:2871.

Gonnet et al., Science, 256:1443–1445.

Grosschedl et al., 1984, Cell, 38:647–658.

Guateli, J. C. et al., 1990, Proc. Natl. Acad. Sci. USA, 87:1874–1878.

Hackstadt T., Trends Microbiol. 1996 5:288–293.

Hammer et al., 1987, Science, 235:53–58.

Hanahan, 1985, Nature, 315:115–122.

Hayashi, S. and Wu, H. C., 1992, in N. M. Hooper and A. J. Turner (ed.) Lipid Modification of Proteins: A Practical Approach. Oxford University Press, New York, pp. 261–285.

Heinkoff and Heinkoff, 1993, Proteins, 17:49–61.

Herrera-Estrella et al., 1983, Nature, 303:209–213.

Herrera-Estrella, 1984, Nature, 310:115–120.

Higgins et al., 1996, Meth. Enzymol., 266:383–402.

Houbenweyl, 1974, in Meuthode der Organischen Chemie, E. Wunsch Ed., Volume 15-I et 15-II, Thieme, Stuttgart.

Hsia, R. et al., 1997, Molecular Micorbiology, 25:351–359.

Hueck, C. J., 1998, Molec. Biology Rev., 62:379–433.

Huovinen, P. et al., 1989 Ann., Intem Med 110:612–616.

Huse et al., 1989, Science, 246:1275–1281.

Huygen, K. et al., 1996, Nature Medicine, 2(8):893–898.

Innis, M. A. et al. 1990, in PCR Protocols. A guide to Methods and Applications. San Diego: Academic Press.

Inoue et al., 1987, Nucl. Acids Res., 15:6131–6148.

Inoue et al., 1987, FEBS Lett. 215:327–330.

Kabat E. Et al., 1983, Sequences of Proteins of Immunological Interest, U.S. Dept. Of Health and Human Services.

Kaneda, et al., 1989, Science, 243:375.

Karlin and Altschul, 1990, Proc. Natl. Acad. Sci. USA, 87:2267–2268.

Kelsey et al., 1987, Genes and Devel., 1:161–171.

Kievitis, T. et al., 1991, J. Virol. Methods, 35:273–286.

Kohler, G. et al., 1975, Nature, 256(5517):495–497.

Kollias et al., 1986, Cell, 46:89–94.

Kozbor et al., 1983, Immunol. Today, 4:72.

Krumlauf et al., 1985, Mol. Cell. Biol., 5:1639–1648.

Krone, J. R. et al., 1997, Anal. Biochem., 244, 1, 124–132.

Kwoh, D. Y. et al., 1989, Proc. Natl. Acad. Sci. USA, 86:1173–1177.

Leder et al., 1986, Cell, 45:485–495.

Lee, C. A., 1997, Trends Microbiol., 5:148–156.

Leininger, E. et al., 1991, PNAS USA, 88:345–349.

Lipshutz, R. J. et al., 1995, Biotechniques, 19(3):442–447.

Livache, T. et al., 1994, Nucleic Acids Research, 22(15): 2915–2921.

Lockhart, D. J. et al., 1996, Nature Biotechnol., 14:1675–1680.

Longbottom et al., 1998, Infect Immunol., 66:1317–1324.

Luckow, V. A., 1993, Curr. Op. Biotechnology, 4:564–572.

Lukacova, M. Et al., 1994, Infect. Immunol. June, 62(6): 2270–2276.

Mason et al., 1986, Science, 234:1372–1378.

Matson, R. S. et al., 1994, Anal. Biochem., 217:306–310.
Matthews, J. A. et al., 1988, Anal. Biochem., 169:1–25.
Mérel, P., 1994, Biofutur, 139:58.
Merrifield, R. D., 1966, J. Am. Chem. Soc., 88(21):5051–5052.
Midoux, 1993, Nucleic Acids Research, 21:871–878.
Miele, E. A. et al., 1983, J. Mol. Biol., 171:281–295.
Mogram et al., 1985, Nature, 315:338–340.
Morrison et al., 1984, PNAS USA, 81:6851–6855.
Morrison, R. P. et al., 1995. Gene Knockout Mice Establish a Primary Protective Role for Major Histocompatibility Complex Class II-Restricted Responses in *Chlamydia trachomatis*. Infect. Immun. 63:4661–4668.
Nakai, K. and Kanehisa, M., 1991, Proteins, 11:95–110.
Nielsen, H. et al., 1997, Protein Engin., 10:1–6.
Neuberger et al., 1984, Nature, 312:604–608.
O'Donell-Maloney, M. J., 1996, Trends Biotechnol., 14:401–407.
Olins, P. O., and Lee, S. C., 1993, Recent advances in heterologous gene expression in *E. coli*. Curr. Op. Biotechnology 4:520–525.
Ornitz et al., 1986, Cold Spring Harbor Symp. Quant. Biol., 50: 399–409.
Pagano et al., 1967, J. Virol., 1:891.
Pearson and Lipman, 1988, PNAS USA, 85(8):2444–2448.
Peterson, E. et al., 1988. Protective Role of Magnesium in the Neutralization by Antibodies of *Chlamydia trachomatis* Infectivity.
Pierschbacher and Ruoslahti, 1987, J. Biol. Chem., 262: 17294–17298.
Pinkert et al., 1987, Genes and Devel., 1:268–276.
Pugsley, A. P., 1993, Microbiol. Rev., 57:50–108.
Raulston J E., Mol Microbiol 1995 15:607–616.
Rank, R. G. et al., 1988. Susceptibility to reinfection after a primary chlamydial genital infection. Infect. Immun. 56:2243–2249.
Readhead et al., 1987, Cell, 48:703–712.
Reeves, P. R. et al., 1996, in Bacterial Polysaccharide Synthesis and Gene Nomenclature, Elsevier Science Ltd., pp. 10071–10078.
Relman, D. et al., 1990, Cell, 61:1375–1382.
Roivainen, M. Et al., 1994, Virology, 203:357–365.
Rolfs, A. et al., 1991, In PCR Topics. Usage of Polymerase Chain reaction in Genetic and Infectious Disease. Berlin: Springer-Verlag.
Sambrook, J. et al., 1989, In Molecular cloning: A Laboratory Manual. Cold Spring Harbor, N.Y.: Cold Spring Harbor Laboratory Press.
Sanchez-Pescador, R., 1988, J. Clin. Microbiol., 26(10): 1934–1938.
Salzberg et al., 1998, Nucl. Acids Res., 26:544–548.
Sani, 1985, Nature, 314:283–286.
Sarver et al., 1990, Science, 247:1222–1225.
Schachter, J. 1980. Chlamydiae, p. 357–365. In E. H. Lennette (ed.), Manual of clinical microbiology, 3rd ed. American Society for Microbiology, Washington, D.C.
Schnaitman, C. A. and Klena, J. D., 1993, Microbiol. Rev., 57:655–682.
Schneewind, O. Et al., 1995, Science, 268:103–106.
Schwartz and Dayhoff, eds., 1978, Matrices for Detecting Distance Relationships: Atlas of Protein Sequence and Structure, Washington: National Biomedical Research Foundation.
Segev D., 1992, in ? Non-radioactive Labeling and Detection of Biomolecules ?. Kessler C. Springer Verlag, Berlin, New-York: 197–205.
Sheldon, E. L., 1993, Clin. Chem., 39(4):718–719.
Shiver, J. W., 1995, in Vaccines, eds Chanock, R. M. Brown, F. Ginsberg, H. S. & Norrby, E., pp. 95–98, Cold Spring Harbor Laboratory Press, Cold Spring Harbor, N.Y.
Shoemaker, D. D. et al., 1996, Nature Genet., 14:450–456.
Sosnowsky et al., 1997, Proc. Natl. Acad. Sci. USA, 94, 1119–1123.
Struyve, M. et al., 1991, J. Mol. Biol., 218:141–148.
Sundelof, et al., 1993, Scand. J. Infec. Dis., 25:259–261.
Sutcliffe, I. C. and Russell, R. R. B., 1995, J. Bacteriol. 177:1123–1128.
Swift et al., 1984, Cell, 38:639–646.
Takeda et al., 1985, Nature, 314:452–454.
Tascon, R. E et al., 1996, Nature Medicine, 2(8):888–892.
Thompson et al., 1994, Nucl. Acids Res., 22(2):4673–4680.
Urdea, M. S., 1988, Nucleic Acids Research, 11:4937–4957.
Villa-Kamaroff et al., 1978, PNAS USA, 75:3727–3731.
Wagner et al., 1981, PNAS USA, 78:1441–1445.
Walker, G. T. et al., 1992, Nucleic Acids Research, 20:1691–1696.
Walker, G. T. et al., 1992, Proc. Natl. Acad. Sci. USA, 89:392–396.
White, B. A. et al., 1997, Methods in Molecular Biology, 67, Humana Press, Towota.
Yamamoto et al., 1980, Cell, 22:787–797.
Yershov, G. et al., 1996, Proc. Natl. Acad. Sci. USA, 93:4913–4918.

---

SEQUENCE LISTING (5982 sequences)

SEQ ID NO: 1 - DNA, 1038608 bp, Chlamydia trachomatis
  misc_feature (1)...(1038608): n = A,T,C or G
gaagcaaaaccctgaaactgaggggagaacagcagcaaacaccgcagtagctgacagccatttcatagaagacaaacctattgaatatgtacgaactcgataggcgttagataaatcagaaaagtaaattaggcaaggtattccttgcctaatttactaggaagatacagaggtttttaaaaatagttcacctccaaggttatattagaagccaacatagcctccgcaggataagctattggagaggttcttcccttcacggttgatagtatatgccgtgatgtataaggaacatgctttatagcgaagaatcaattgatttgccaatgtgtgtgcagaggttggaactgaacagccattggtagtccaagcaaaatcattcatagccaggtgagcaagagtggatgggttttctcgtttaatatctcgagagtaaccgatggatcccttacctagtagagcaaaagagctattccctaagcagaattcataaccaatcccctatgggatggcgatgtttagaagttttgtcttggaaaaacttcttgggttatagcctgtttcagtaaaagctctttgcaagatatttgtggcttcgatgttggcgaatgagaatacgcgcatagtttgatcatattctaggaatgtataagaggcccctaatgttcctcgcataccgaatgtatcccatttcccataggtgtgatcttttttggagcatatgcggaccatcgcgttgtgatctaaggctgcacataatgtanaattgacagtaaggggtccccagacatgggttaaaccgacattctgaacaattccttctgaagtgatgtgttctggtaagtctgcaacgaacgaatctccgaacatatgtgagcctcctccagagagtgtcagggagggagttaagcgtatgatagaggttcctgtagctcctaaacgagatataaagctttcttcttctgaggagtgggtagacatttctgctccagttcctccaattaaaactccgaagtatgaagtaggaataagagatcgattattacatagatgatcgcctaagttatgagaggctgtctgtaaaagtaaaaatgtgctccataaggaattaggaacggcacgccccactcgattggattcaaggacatattctcctgttgggagccaagaagctcttaatattttttgtttagtattgtttatagtatttggctgccagctaaaatgccaggctccttggaatcctgattgtttgttcgtaactagagaatcagtagtaaatttggagatatctacagttttatcagaggtgagcaagatttccatttggtatggtgatgctgcagtatcgcgattttcgtagaataatccttcaggatcatggatagatggggatccggataatcgtaaaggagcgttgccggcacggatctctgcttgaagattagaaggagagatatctactccaaagcttaaaccattaatttctaggggttctttgctggatatgttgccatggaagaacgagttcatcgtgtatagagccaaggaggatcctggagataaactgatacgtcctccggtctgtttgaagctttggacaatcagatgggctccattttcgatagatagggtgccattatatagatgaacgggttggttaaaaatcgatgttctatttgcaacatcttccctagcatcatctaaaagattcgcacccgagaaaacgatcatacccttaggtgagaagaagggagtttcatactcaggagcattgatttgtataggggaagatgatgctgacaatgccatgacaggatcaaagaaatgaatagaatggtttctgttcgctgcaagttggattttatagggagcttctttgattaagatagaattgtgtcgatctagggaagcttttttggtgatatgaagcatggtattgccgctaaatgcaatattaccactatgagcaatcaaggttagagaaggttttttcccttctagaagaattgctcctcctccaagatctccggcagcattatcggaaaaagtgatggtattatgagcagtaattgagcattgagaagaggtgatggctccaccgccttctttagcggtatttttttcaaagcgaatagtatcttgattctgttctaagttcacatattgcgcgtaaatcgctccgcctttcttattcgcatgattttgagagaatagaatgggggatgtttgttgattcgctttgaaattacttgtgtatatagctcccccgttagctattgttgtgttctctttaaaggcaagaggtcctgcatttcctaagaactcgacaaggccattcttattgtagatagcacctccatgcacagcgctattgccttcgaaagtaatttgttggttattaagaaaaagaattctggatcctgcgaagtcaccgctaattgctcctccacgaccactatgtttcattgatgaagaagttacagcttggttattggtaaagatgatagctccacgttgatctacaaaggatacgcttcctttcatatctccttggagctggataacgccaccattccctttggtgatattattgcggaaggcaatgtggtggttgtttttaaaagagatgtcctctttcgcagtaaaaattcctcctgtgctttcagatccaaaagcaacaagttttcgtaaatcagtaaattcaatagaggattcagaaaagactccggctccaaaaccattgatattaatgtgtttaaaatgaatggacgcagaagaattttttcctaagaaggaaattttccctgctagattccgaaaggctccccctgatgaaactttatttagtaacgagaaatcactgagtatgagtttgcgattgatgatgtaattagtgccttcaggacaggaagagatcatggtaaaggtatctcgatctttaccttgtttatgtccagaaatagctaattccatttctgcaaacgaataaggagcatagacgattagagctcctagtagaaacttgggaataagagtaagataaggatgatgtactaagaagtttgtatttggagattgagaaagttgtctttgatcgtagtgagcatggatttctataactcgattcataagttcctttgttataaacatcttaagacattgttttgaacgggaactataaacagaaagcgcttttctagcgatccaagattttttataagtctttgataatctattaggaagctgtttcgaatatgagagaaagacactctttcatagaggatgcagattcattgattgcttgatacacatctctgcaagagtctttttgtttttcttgagcttgagatgttttcagaatgtttagagcagcagcaacatcttcatattgaaaatcttttttcccacctatgaattcaggaaaaatcgttctgcctagaatgatattagggagcgagtaggctggaaggataatattaaagatatacttagctaaaaaagtatccaaaggtcggagctggcaagtgacgatcgtaggagttagattgagagccgtttctaggacgatagttccacatttggcgagggcaaaatcacattctctcattaattcataacgaaactgggaaggaacaatatgactgtgcaaacaccgattctgttgaagcacttcgaggataagatggtcatattccggatttgcagacgatacaagtaaatggtgtgtggatgcaagagaggatgcttgaaaggcctgcacttgaatggttagattacgcaggatatcgctgcgacggctaccaggaaacgctgcaatgaaaggtttatcggtaggaagatggagctgatctttccaatttagattgggagaaaagcttttaattgtttcagaaagaggatgccctaaatagactgtacgcagagctgaatctttgaataagttttgttcaaaaggaagtattagtaaaagcaggtctagatatttttccaaaactgttttccgtgaaggtctccaagcccatatgctagggcatacatagtgaacaatctttcctttatatcctcgagagcgtaatttttttattaataagaaatgaaaatcagggaaatcaatgcaaatcactgtgcgcggatttgttttcagaatatttctatagagaagctgatagcggtaccataatttaggtagtgctaaaagtacttcccagaatccgctaacctgaaatttctccatagtgaaaagtgcatgaaaattctgtgcacgcatttgcggtccccccacgccaaagcaatgaatatcagggtattttgcgtgcatttcttttaataaattccctcccaaagtatctccactatgttcgcccgcagaaataaagcagctattgctaaaaggtttgcggaaagcttctcgtgaagcgatacgtagatttgctaaagaagggaataacccgcatccataacataacacgtttacgagatcccccgttcttaggaaatagagaaggcagatagatcctcctagtaggcttgctttccaaaaaggagcgggcagggcggattggtttttgtattcgagatagaaccactggatgaaaaatctcaatgagaagatcgtcaatccgatacatcctatcagctgccatgacaaactcgcttctggtagattcaaatggaggatatttggggatgccatccacgtcatatgatggaggtaacgcgttccaatagcaaaagataccgtgatcgctgttgctactgagactagtagagaagctattttcgaaacaggaaggggatttagagaggcgatattcaggttccggaaataaataatcagattaaacgaatgcaacaaagcaataggatactgactttgaataaatccgtggcaaatcatgaaaacggcgccggtaccggacagataccaaaaaatcttgggaacgacagaataccctttctttctagttaaaaaccattgaacacaaaaagctgtgccaaagaagaggttggcgaatagtcctagagggtataaccagagtgtaattttttggggaaacataacaactcattgtagtaatcgataggggagaagaattttcccaatttcaaataggaatggtcattccgatgctaattcataatgtttaagccactctccataggtagcctctacttttagatacactttactgcggatttctagtaagtaaagagcttctcggaagtaggcatggcgtaacaatcttctattgaagaaagattttttttctttcttcatagcagacaatggggtcagccggtactgcatttgcaatagcagagttgtcaagatgaaatttttcttggaacaactagtaaatgagtcggcaaaaaattcagtcaaaaagtttcgaatatagtcaaagatactttggatagtcatcgttgggtattgactatatttgtaccgcacattgaagttaacaatagggaataataggatcgctagcagaaagtgtctttctgaacagaacgagcgtttctgaattttagtgtctaatgctgttaagcaagcgaaagtctgatcttgcagagtcttacttaagctaaatgccttagccatgtaagggaataaaatctctaggacgcgatgttcggaagctagctggaaaaaaatggtagactccccagaactcaaaactttgatgatttcttcaaagactcgaggttgagagcttttcacaagttcgtgacgagattcttgaagagcttctagagttttaggatctactgtaaaagcataacgagataaaatttttaataggcgcagcatgcgcacaggatcttgtttgaaacgaaggaaaggatctccaatagttctgagatagcgattttttaaatcctcaacaccgcctgtgtagtcgatgataatttctgcgctagggtcataaaaaaggccgttaatcgtgaagtctctgcgtaatacgtcttcttcggcagatccccaaagattatcttttgtaattaaggagtcttcttcgttgctaccagatctaaaggtagcgacctctatgatttggtttgggaaacggatgtgagccaaacgaaatcgtttgcctacaagaatacaatttttgaataacgttttgacttcttcaggtttagcagaggttgagatatcaaaatcttttggttctgtcttcaacaacaggtctcggatacagcctccgacaatgtaagcttcgtacccagcttttttcaaagttcttacaacggaaagcgcgtgagtggagaaactttgcagatcaatattgtggtctgatggataaaatatcgtaggagtaagattagaatgagaatttttgctgagcaaatctaagcctctaggcgaaagaagttcttggttgcaagccatcattatatgacattgaaagttaaaaagtctggaggaattttgtccttgagcaagaaggcttttagagttctcttcaggaaagctcttcctataatagaaaaaattacgtttacaagggcaaaatcacctatatgtttctaaaaattttcaagggtttagaggaccatatataaggcacgtctttttgatcatcaacagctttatgactctctctccttttatgaagagagagtggactcagaaacctcgagagtttccgcctcttttttggggaaaatgagctcttttcgcattaagaatacccccaataaattgaggcatagcaatagagctcccgaaacagacataacaagtaatgctgtatcctgtggaagaaaacagaaagcgggcagagctataattccatagacggtatagaatttagatcctttgtttccgcagatgaaattcgcacactttttccctacaaggaaatatgaaataatggtggtgtatcctgtagcaaacagaaacgcgggaaggaatacacgaatgtaagggaagtaggaggaaagagcctgttctacaatttctgatccctcgagtcctgctcgatgccacactccagaagcaagaacgataagaagacttagcgtacatacgaggttgtccacaatcactccgacgatactaagctgcgcttgtgtctgaggatttgttgcagatgtttcactttggataatggaatcaaacccaataccaatatctcctgaataagctgctctagatagtccttgacgaatagtggaagccactgtgcatcctgcaaatcctccgatcgctccatgacctgtaaaggccgaccggaaaatactagagaatagcgcgggaagagtatggatttcttgaatcaaaatataaaaagccattccgcagtagaccaacatgaagaagggtaaaactagggaacagatttttcctatccgctgcaagcctccttgcacagcatacataaccaggaagaggagagaagcaatggccatcaatttagggacatcccagcaagaggccagtgtattggcaataattgaaaattggtagatctctaccccataaatacagaggagaacagcaacgataacggaaacaatgcgggttctataggctttatcaaggaagaacatagggccgccatgatacacattattggcatcagactgacggaatttaatacctagatagacttcggagtatttaactatagaccctaggattccagctatccaaacccaaaagagagctccaggtccaccaacactagcagctgtgactatcccaacaacgttgccgatgccgatattccctcctgcggaagcaaagaatacttttaacggatgaacacctttcttttggttttctttttttgacgaggcttcttttgaaaaatggtagaatagcttgaaaaacgcaggaagttgagtaaattgtgcaaatttagatttgcatgtgaacaaaactccgagcaagagaatcaaaacaaatgctatgtatgaccaaataaagtcatcgaaagcggtcaaaaaagacagaaacgcgctcataaaatatatgattaaaactaaaattccttgaaaattaccctatattatcccttttttcctttttgtttggtagagagatccttgaaagaaagaattttttgttaaaagcattttttactttctttagtgaagtataggtgaccaataagaaggagggttcctatagagataaacgcatctgctaaattgaaggaaggaaagcgccaggagtaatagctaagaaaaaggaagtcgacaaccttaccgtggagtaagatatcacccacattccctagagctccagcgaggatcaaggttaaagcaattcgtgttcttctatgtaaagacttatatttaattctcaagaataaggctaggcctaggattacgcaaacgcggaaaataagaagagggattttgtattgggcaaagagtccaaaggctgctccttcattgaaggagggaataatgagaaaagaaaaatgtccccacacgtagctataaagaaaagctgaggagtgaggggagagctggcagctcttgagtaacacaactagttttgagacccaatcaatagaggctaggagaaggagagtaaggaaggttgggagagaacgggtcggcattgtaactagtttccagaaagaaggcctttttcgaatttttcttgtgatttcacagtcatcgtagcgtaagggattgccattaatcttgccaacggaatttcttctccacttacatcacaaatgccgtaagaggcttcttcaattttttctaaagcacgatcaatttgtctaagaagtttatactctttagtagtaacttccaggctgatagttcgatcaaacgtatctgtgccttgatctgcttggtgctgagaatagcctgttgcctcattaggttttttgacctcttgagcattcccttctagagtatgagacaacttagccttcatttctaaaagacgtgttttaaaattggctatttcttcgtccgttaggggcatacaattctccttttcatgtttgtttttcaccatctggtgttgcagataataagacttccattagctctcctacatctttaaatcttctgtaaacacaggcgaacctaatgtacgcaatcatatctgctttttttagatatttcattactagttcgcctatttctttggtagagatttctcgattttgttttccaagaagatcttgtttgatattagaggcgattgcttgtacttgttcttgtccaattcttgtatggctggaagctgcttttaatccattgacgagctttgattcttggaagttttcataacgaccgtctcgctttaatacctgtacagttaattctactgtttcaaaggttgtaaatctttggctgcaacgtaagcattcgcgacggcgtttaatcgcgtttgactctggtgcgtttcgagagtcgataactttaagctctccatggttacaaaatgggcatagcatgggagattcctcctaaaattcaaatattagatccttgtttactacgataggcccttcagaaatgaaagaaagaggtagcttgcgggatctagtaacacaattcttgattgtgattttgtggtgattttttttcaaaagtcgcctaatatctgcaggacgctcaagataccacggtttttattttaatggataaaatcctgtgtcttgtgttgaaaagaacctcttcttagaaaggttttctctacgggcggtctcggagtataattattttttgattataagcaaccgctgtttgccttgatcagatccggagagggctttttcgtgtatctagtttttcaagattgctaaaaagtattgttgtcacgacctagcaaaggtatttaattgtctatgttttcaggcattattcaagaagtcgcacgggtagatcttattcaccatctcggggattccatggagattggagtttttgctcgcaagttgatcgatgtggttccggggagtagcttctccgtcgatggcatatgtttgactctggtcaaacgacagtacgaattactcttttttgatgtgactgaagaaaccatggcttggactaccatcaaagattatacggtgggaaccatggtaaatttagaacgctcggttcgattaggagatgaaataggaggacattttgtctctgggcatgtctgtgggataggcactattattgccatagagaaatcctatatgttttttaaggctccagctaatttagtgccttatattttagagaaaggcttcattgctattgatggcatcagtttgacaattgcacgagttaaaggggacatcttttcagttagtttgattccggagactcgagcgcgcacctcattgggttataaacaggtgggtgctcacgtgaatatggagcctgatatgatgacaaaaatgcaggtggacacaattatgcgtttccatgccgaaaaagagatcagcaaatgatggattacgagttgttagatagtggggacggtaagaaactagagcgatttaaggatgtttgcttaattcgttcttctgccacggctatttggccaaagagctctccctccttatgggggcagtattctgctgagtttgttcgtatgggagaacaagggcaatggcggtatcgcaacagaaatcttaaagaatggtggataaccatcgattctgtttcgtgtttattgaagctgactccttttggtcatgtaggtattttccccgagcatgctgggttctggaaagatttacaaccttctgtagccaagccttcatgtagagttttgaatctctttgcttatactggagcttcttctattttctgtgctcaacaaggagcaacagtttatcatgtggatgcttctaaagcagctgttaagtgggcccaaaaaaacgtggaagggaacgcttttcaagataaaagggttttttggattatagaagatgtgttttccttcttgaagaaggaaattcgtcgaggaaagacttatgatgtcattcttttggatccacctacctatgggcgaggtcctgatggagagacattcaaaatagatcgcgattttttccctttattagagttgtgttcacagctcctctctagttctttctcgcatatgctgattacttcacatacaccgggacatactcccgagtttttgcattgtttagctagaagagcgcttcctatgcttcctctccaagggtggcgtttaggagaaaatttttgtggtgaggggaatcaacggttgccttcaggggtgtttgcgcaatggagtttatagggaaaaataatgcccgtgttaagagtgctcttgctttaaagcgccagcgggcacgtaatggcacatattttttattagaagggtttcgagagattcatcgagccctaatttctggataccgttgttcgcatgtattttgcggagaactaattgccgataaggagatagctcttgatcgcgagcttacttcgcttggtattgaaaagttgtattgttctaaggatattttggaaaaactgtcgtttaaagagaatcccgagaattttattgctgtttttgaaaagaaagagctgtcttgccaagagtttttaggattgcagcgaaagaatcaggctcctttttatttgattgttgagcaagcagaaaaacctggaaatataggagctttgctaaggatcgcagatggagcaggggtggatggagtcattctttgtgatcctgtagtcgatttatacaatcccaatgtaattcgttcctctttaggtacagtattcactatgcctgtttggcaagcttctttgaaagaggtcttggatttggttcatcaacaagaatggcaggttttcacaacaactccatcagcacaaactttttattttgatcaagatttttgccaaccgacggttgtggtgtttggctcagaaaaagatggtgtcgcctgattggttgaatggaagtttttgtaacatagctttacctatgttagggaaagcagattcattaaacctttcttcttctgttgcagctgttgcttatgaggtcgttcgacaaagaagtataagaaatcttttatgattcaagttttgaaacttgatttttaatgttttatatgcgatccttcaggatgccctcgtttggaaggctacttgggtaaagaggacgaagagtctgtctcagccctttagggttgtcatagtttttgcaggttgttcgtttaggaagaacttgagtagggcgcccatgagattcagtttcttttctggtattcgagaccttttccgtcatctcatcatatctgcgacttctggagccttgtctgatcgtttaggctggctttgggcagtcatagctagagtgttttctggctctgtttggctgcgacataagattgcgaaatctcctcatcaagtacaagcaacagtggtgagtgtagggaatatcgttgttggcgggacaggaaagactcctttggtgttatggctagcccaagcactgcatgaaagagggctttcttgtgcggtgctttcgagaggatacaaagggaaatatagtaagaaaaaagcgtttactattgtgaatccagcgcttcacaccgcttcttgtgttggagatgaacctttgctcttagccaagcatttgccgtcaggggcggtacggatacaaaaggaccgaaaaacccttgcggagaagagtgctggggattttgatgttttgtcgttggacgacggatttcaatacaatcgccttcataaagatgtagagattgtattagtgaatggttcggatccttttggaggaggctcttttttcccaaaaggaagacttcgagacttcccagaaagattggcgaaggcggattacgtcatgattaatggtagatgttcgccttccgatcaacgtgagttggatcgattgcaccccgaanagaagatcgtgatcgagcctcagatttcggaaattgtttggatgaatcaatctgtaaacatgcctcgagatcattgggaaggtctaggtgtgggggtattttgtgggttagggtttcctaaaggattcttagctatgttaagagatgcagggattcatgttttaggtacgtatctattacctgaccatgtgggcataacaaagcaagagttagaacttttttgtaagaaaatcattttgcgccaaggagttggtatcctgtgtacagaaaaggatagcgtaaaaataggagcgcttgctgaagaaatatcattgccggttggagaagnncgcatgcggttttcttgcgtttgcaatgaaagacgaatggnngccatgttggatgcaatagaatccatccagaagaataagagggtaactacatgaaattatggatganaatttttataggcctaattatcggggttgtttccggcttaattctggaagacaaagcagtttttgtgaaaccttttggggatatctttttaaatctactcagcatggtagtatatcccttagtcttttgctctatggttttggggatcgcttcgattagcgatatgaagaaatnagggcgtataggcttaagaagttttgggtttgtatctagcgacaacttccgttgctattggtattgggttagcttttgctctgtttttcagtcctggaaaggggtgtgatctccaaggttttaatgcagtggatcttgcttcgtccggatcatctggagggatgaattttttagctacattcgctcaggtgtttccttcaaatcctttacgttcttttgtagaagggaatatcctacagatcatcatctttgctttgtttacaggcattgctatgcgcttagctggagaagctgctcgccctgtggaacgttttgttcacgggtgtaatgagattatgctgcgcatggtaaatatgattatgtcttttgctccttatggagttgcagcaagtatggcttggatatctggcaatcatggtctgaccgtcctacttcaattaggcaagtttcttgttgtctattatttagcctgtatatgtcatgctatattgatattcgggggcttagttcgattagggtgcaggagctcatttagcaagtttttgtcgtcgatgatggatgccatttcttgtgctgtatcgactgctagtagttctgcaacactgcctgttactatgcgctgcgtttcaaaaaatctcggcgtttcttcagaagtttcaggttttgtgctccccttaggtgcgactgtcaacatgaacggtacggcaattnttcaagggatggccgcagtttttattgctnaggnatataattgtcctctttctttaactagtttacttcttttagttgtgactgcgacattctctgctgtaggaagtgcaggagtccctggaggaggaatgattacgttagggtctgtgctcacttctgtgggactccctatccaagggacgcagtcttagctgggtcgatcgtttgagagatatcataggcactcctatgaatattctaggggatgcagttgttactttatatattgcagatggagaaggtgagttctcctcttctaatgagggtgaagaggatatccttcctcaacatggttagagatcttttaacgaagagggttttctctcttcgttttctttaaggtttaagcgtcttttctgtggtttcaaaaaatgtttagtgtaacatagggagtgcttaaccgccttcaggtgagtgtacagattttcatgttattaaaccctcaaaaggcattttttatctgtaaaagccagttgatcatcttcttctcatattgagttaacagaatactaaagccttcgagttcagaaataaggagattcatgttcgagtttcgatttccaaaaataggggagaccgcatctggaggtattgttgtccgatggttgaaacaggtcggagatcctgttcaaaaagatgagccattgattgaggtctcaacagataagatagctacagagttagctccttctcaagctggcattttggaggagtgcctggttcaggaaggggaagagttttccctggaganattctagcgcgtttgcgagaaaccgctgcagcgaatactcctgtaaaaagccctgtggagaatcctgttagagaagagaatcattctgtagatagagagcagaaatggctctcgcccgcagtattaggatttgcccaaagagaagggttagatcttcaagaattacaaaagatctcggggacaggagaggggggacggattactcgtaaggatgtagaacgctatctttccgacaagagagaacctagggatccgatctgttctaaagaggaaaatagaattcctttgtcacctttacgtcgggctatcgcttcttctttacgacagtcttcagaagaggtgccgcatgcttctctggttgttgatgtagatgttacagatttaatgaatctcatctctgcggagcgagagagatttactgctgctcatggagtgaaactcacgatcaccagcttcattatacagtgcttagctaagtctttagagcagttcccactgcttaatggttctttagacggggatacgattgtcctcaagaaggctataaatgtaggagttgctgtaaatttgaataaagaaggagtagttgttcctgttattcataattgtcaggataggggtcttgtaagtattgctaaggttcttgcggatctttcttcaagggcgcgatctaataaattagattcctcagaaacgaaagggggaagcgtcactgtaaccaactttggtatgactggagctcttattggcatgccgataattcgttatccggaagtagcgattttggggatcggaacaattcaaaaacgagtggttgtacgtgatgatgactcgttagccattaggaaaatgatgtatgtcactttaactttcgaccatcgagtattggatggaatttacggtggagagtttttaacagctttgaaaaatcgcttagagtctgttacgatgagctagaagacatttttttaatatagcggtgaaagtaatgtacgtaccaggcattgcagagaacctttgtttagatatttttcataagcaaaaacaggttatttctcagtatttcgctagctttcattatgattgcgttcatcagctcacagaaaaacttctttgtcatcagggatcagtatttttttctgggataggaaagagtggttgcatcgcccgtaagttagtggcgacgatgcaatcttttggggagaaagcctttttcctttcaggagatcttctccatggagatttaggggttgtttctccaggagatatcgtttgtctattttcaaatagtggtgaaactcgagagattttagaatggattccgcatttgaagaatagacccatttttcttgttggtatcactgctgcaccgtgctcgagtttagccgctttttctgattttgttgttgtactgccaaagttagaagagttagatccttttgatcttaatgcctacaacctcaaccacatgccaattacttttttctgatcttctagcaatgacactgttacgttgtcggaaaatttccttgtcggattatgggagcaaccatcccagtggacagataggcttgaaagcgaatgggaaagtcnaaggattatttgtacccaagaactgaagtgcctttctgctctccattaactactgttgcagagtctcttcctatactttcttcgtatggatatgggtgtgtctgtgtagtaaatgagcttttcgagttattagggatattcacagatggagatttacgtagaggattgtctgaatacggaggagatattttagcttacccgttacaacagatcatgacacgtaaccctaaagttatttctgaggattcggatgtactattgagcttagaaatgatggaatctggaaatcctgtgaccgtacttcctgtagttgatgctcaacaacaacgtttcattgttgggctactacacatgcatgcgttagcacgtgcaggattattataataaaaaaagctcggaagagcgagtaagccggattctgtcgacaagcacgaacggaagttcttgcttgcgggcaaccattcatctagggagcacattactgtactcctcaagcgattatcaaaaagcctgtgcctttcgttagaaaggttgtttgcagaaacaaataactttttctcttgcttcagatggggtttacaagtctgctaggtttccctagcagctcttactcctaaagtaagatttttcagcctgtctataaattatacaatttatagcggagtgttttctgttgcactttccgtaccttacggcccctggaatttctccagcatcttttcttataaagtccggactttcctctggtactcatcttttttaaaaagctggtttcagcggttgccttactcttccgattagttcgttatactgcagtacgacgacgacgacgttttgtagttgcgccttctgctgatggagcttgcaactcttgccagtaaagaattcttgagcagtgttcacaaaatacaagatgatcttgtttacgtaccaaattctcatgttgcggggtaagagctatatgacagccactgcaaacacgattttcgatagggacaacaactcggtctttcttgttgttgagcaagcgctcgtagacgctaaataattctggatctgtcgtttctttcagctgtgttctctgacttagtaaagaacgaccttcttcattaatttttcgaatattctctcgaatttcttcttcgatagcactgctactattttccgtagaagagagactttctttcagagagataagaagatcttcgctaccagcttgcttatccataagatcgctaagttggtgctccaaagtgcgacgctctttattagctgcggtcatctcttgggttagagcattaaactcatccattttttttacagcagcttgctgattttctaatttattgatctgatcagaaatttcttgaatacgtttttctccgcctttgatctgatctttcagcttctccatttcttgttctttttcttccaccttgcgacggatatccgtttttaaagcttgaattttagcgagctcgttctgatgttcttttttgacccgcattagacggatcattttaatatcgagctcttggatagccaaaatactttggagggcgtcatgcatggaaatctttccttaccttgatatgagcttgtagtgccggccagtctcctccaactcgggaaaatctgaggaacgccttcaaaaacttcctaaaaagggagttttgaaaaaagacgcggacgagtctgcctagacgaaacggcaagtttaccgatttttctgcaagaagtaaagcacgttttgtttaagaaaatctttttcaatgggagaaagtcgctcagacaaaaaattcatgtaaggaataatttgaaggatctaatttttcccactgcccttcttcgttttggtagctccttttttctttttagcagaactctttttcttttctttagtcgtgacagattctgtttttttctttttagaggtacgctttgctttagctttagttgtggcttcaaccaacgtccactcgatagactgtgtgagcaaggtgacagaagccagttgcacagaaataacagctccaggacgcaaatgttcaggaagttcttctaatcctatttttgtttgaaggacgtacgcttgaggtagtttagccgcaggaatgaaaccttcatgacaaaattctgggaggacaaaagagatcccttccggggatgccgtaataatgaaagctttataaagagttgcaggctgctcttctatgaattttttcaagaagcgagccttcttaatatttacaaaagctccctcagctttcgctgcaatgcgttcttgggatgagcaggctcgaacaatttgttcaagatgctcttcttctacagagagagaatggaaaagcagtcggtgaacgatcaaatccacgtatcggcggatcgggctagtaaagtgtgtgtagtagtctaagcacagaccgtaatggcctttgttttccgtagaataggaagccgtcttcatactgcgtacaaactgagaatgaaggattggctccaaaggatggcctgcagtcgtttcctgcaataaatattggtaatctggttcttgcgccggggtttgtgtaatggtgaagcccatagcctttgctgtctcttgaaacacaaggagactttcttcattaggaggttcatgtgtgcggaatggcatggttattccctgatgggaaatgtgataggctatcacttcattcgctttcagcataaactcttcaatgagtttatgagcagctgtttgtttgttttcgataagggctacaggctcttgtaaattatcaagagacatcgtgaacgaaggaagaacgagacgcgtgcatccacgttgttctcggatgtcagaaaaaatacggctcaattcagccatctttaaaatggttttagaaatagggtgagtctgttttttctcgataatttcatctacctcatcgtatgtcatacggtatttactacgaatgacgctacgcaaaattcggtagtcagaaaggaatccctctttagagaaagtcataaatacggatacagctaagcgatccacattaggttttaagctgcacagattgtcagaaagggctgaaggcagcatagggatgacttttccagggaagtagatcgagttgcaccgtttagcagcttctctatccaaagcggaatttggagtcacgtagtgggagacgtccgcaatatgaacacctagaatatagtttccctcatgatcataagttagtgagactgcgtcgtcaaagtccttagcagaggaagagtctatggtgaaacataacaaatctcggagatctttcctcgagtgtaacgcttgtgttacgtgcttttgtaagaactgactagcttcctgtaccactgcatcggggaactcttctgtaatagagaattcggctttaataacaggaaaatctgtcttagcattagagatattgcctataaattccagcatagccaagggaggtggttctttactgggataattctccttccacacaggagtttttagtaacaaccgatctcccagtttgtaagtccttttaggtaagagctcggcttttaaaggatgttcagggcctatggtattcacacaaaccatagctagagttggattgataagagagacaatagtccctactaagactgttttccctcgagaaagaactttatgaatgaccccttttcttttttctcctccacgaagagaaaaggggagagccacgagaacatgatctccatccaaagcaccttttaagtcgctagctgagatgaaaatatcaaaaggatataactccggttgatctggggatacaaatccaaagccctttctagaatggacgaataaggtaccaggaaccagaacctgctttctattttttagaaatttctttttgtttttagcttttcccacaagctaaactccattactgtcgtactgccggtacattcttacttctcaaacccccaaggaatgtttttgcatcttgaagtctggggttagtagggcagccggtttttgatgatgcaacatctcttagaaatagtgtttatgccataacagtcaagatacgtactatctagcatacatgaacaaagggattaattactcttaagaaagaagagaggagaaggattttttaaaaaaaagctgcaagagcccctttttcaagaggctcttgcttaaggaagatgaataaagcatcttactcaggtttatcaacaatttcaacatcagcatcttcaatgttgtctgtagaagaggcgcttcctcctgctggaggtcgtgtgctgaaactatgttttttcagatcttcggagttaatgtttggccctccttgagcattcgctgcagaagatgctgctgcggatgcggattgagcctgcatagcttctccgattttttgcatacgagtactcaactcatcagaagctgctttgatagctgttgtggaagcatcttctttgattgcttggcgtactttctcaatatgctcttcaatttctttaacaagttctgcaggaattttgtcgtggtaatctttcacagctttttcggctctaaagatcattccatcggcttcatttttcacatcagaagcttcttttcgttgtttgtcttcctctttatgaagctctgcatcgcggatcatttgttgaatttcatcttcttttaatccagagcttgcttcaatacggattttttgttcgcgtccactagcagcatctttagcagaaacgtgtaaaattccgttggcatcaatatcgaangttacctcaatttgtggatggccgcgangancaggaggaatgtctgttagatcaaatcttccaatttccttattgtctttcgccataggccgttcaccttgaagaacgacgatagtcactgctggctgattgtcagcggctgtagagaagatttgcttcttctgagtagggattgtagtgtttctctctaccaaaggagtcatgaccccacctagagtctcaattcctaaagagaggggaatcacatccaacaacagaacgtctttcacttctccgccgaggacaccaccctgaatagcagctccaatcgctacaacttcatctggattgacgcctttattaggctctttaccaaagatctcttttacaactgcttgtaccgcaggcattctggacattccgccaactagaagaacatcatcaatgtcagaagcggacaatttagcatcttttaaagcctgagcacaaggttgtttggttcgctcaatgagagaggaagctaggtgttcgaattgagcgcgagttagagttaaagccaaatgtttaggtccattagcgtcgatagtgatgaatggctgattgatttcagtagacgatacaccagacaattctatttttgctttttcagcagcatctttcaatctttgcaaagccatgttatctttgcttagatcaatgccttcttgttttttgaattcatcaagcatccagttgangatgactccgtcgaagtcgtctcctcccaagtgagtatccccgttggttgagagaacttcaaaaacttccgtcaccgatttccaagatagaaatatcgaaagttcctcctcctaagtcgaagacggcgatttttntatctccttccttatcaataccataagcaagagcggccgctgttggatcaggaataatgcgtttaacatctaatcctgcgatacgtccagcatcttttgtagaagctctttgagaatcgttaaagtaagctggtacggtaatgactgcttccgttactgtttctccgagataagcctcagcagtttccttcatcttcatgaggatctgagcgccgatttcttctggagtgtacagtttttgttccacatcaaagaccgcatctacctttcgagttaggagcaactttgtaggggactgttttaatttcagattcgacttcagagaattttctaccgatgaatcgcttagtagaagccaatgttttttcaggattggttactgcctgacgttttgcaggaattccaacaagagtttcgccacctttaaaagcaacgatagaaggagtagtacgagttccttcagaagaggcaataactttaggttggccaccttccataacagagacgcaagagttggtcgtccctaggtcgataccaataattttgttagactttcttttttcgctcatattgaacacctaatttctaggataattattctttttcttcgttactgtctgagtttcctttagcaggaagttttgctactttcactttggctacgcgaataggacgatctcctatcttataacctttagtaaattcctccaagatagtcccttctggaattgttgtggtttcttcgatttctacagcttcatgcaggtacggattaaatagttctcctttcgaggaatattcaaccacacctttctcttcgaagatttgcttaaattgttgaaggatcatttggaatcctatagcccaattttttacttcttcagaggtttgagaagcgaatcccaaagccttctccatactttcgataggaggaaggaaatccataaagagcattttctacagcatactgcatcatttctgtgcgttctttctgtagtcgttttcttgagttttctgcttcagcgagagccatcagatatcgatcattctgttcttgcagctcagcctttaaattggcgttttcttgctggagcacttggagttcattgtcaggtgaaggctcgctagtctgaatttcttccgacgaggtatttggggtttctgtcatgatagctccttagcaggtaataattttatagaagagctccgagtcaactctgctggtctttgtgagcatctagggtcggtcgggcaaggtcttctgaatgacaatttaaacttgtaaaaactttgagttagaatgacttttagtcgttctgtgaataaggacagtgtgccgaatacctgttgataaggcaggttcataggacctagtacaccgaaagcacctaaaggagtacggtccatgtaataaggaatagtaattactgcacacgaaggatcggtattcccaacgatatcagtaagctctcgaccaataaatgcggtaggagtttccttatgcaggtaagtatttaaaagttgacacatgtgtttacggttttcaaagaaagcgagaccttgagcgagcgtttcaggatctttgaaagtttcgtatttgagtaatctggataggcctgtttggtacagatcttcctcgctaaaatggcagtaacgagtaaggtaacggaccacaacttcattatacaagaccatccctaaatcttcttctttttgagaaaggagactatcggaaggttgtttgcgtaagtaattttgtagaaaaccctcaattctttttaaagagttctcaggtagttgttcaggtagccaaaggacatctgtaaaaacttgcccaaactcagttgagagtacaaagactacgcgttgatcatctatagctacgagttgaatattaataacggaatcgctttcaaaacgaggtgaagagaagcagacagggagttgcagaatatcggagagcacctctgaggctttttgcagatcctttacgatatttttgctgtattccggaagctctgtcagtttttgttggattgctaagatttcttcttgctcaagaaaaggcgcgttatgatccgcataataacgaaaagctagatctgtggggatcctccctccggagatatgattttttcgtaaaaatccattcgtttcaagctgagcaaagtaatttcgtatcgttgccgaactcagatcggaacaataagtttcctcaagaagtttcgagcctactggttggccactctctaggtagagcttagttgccataagtagaacatacgaaatctttgaatcttttttcgatgctcgcagttgggacatttctattctattttccataagtcggtgtcattataagaaaaccgtctccaccggtcaagaattttagcgctcgcaactaaagagtgctagttttgttctcggagtggagggatctttcttgtatgacaaggaagatttttagagcaccaatccaataggttttcaggagaaacattacatttttctcctgagcgtgattcgatttctaataagcctgtactttggaaagacttcccgatgatcaatttgtacgggatacctagtaaatcgctgtcttttaacttaaacccaaggcgttcattgcgatcatctagtagaggctcaaagccttcagtattcaggctttgataaagttgtaaggcggtggcttctccttccgtatcaccaccgttatagagaatggtgatggagaaaggagctacagctaaaggccaaaccagtcctttgttatcagcgagctgttctatgcatgcagcaagggttctccctactccaataccatatgtccccatccagcaaagctgtttatctccatttttatcctggaaccctacggagaagctctccgtatagcgggttcccagattgaagatatgagcgacttcgacgccttggaaaatttcatagggagctcctccattttgaggacaaaggtctccagcttctgctaaaagaaagtctccgaaagctggaagagggatatcgcgtccccagttcacatgcttgcagtgcacgtctttttggttgtttgcgcagatgaagttagtcattgggcgcgttgtttcgtctgcataacaggggataggacagtatagaggtccgataaatcctttttcaacatgaagatgcttaaggatctcttcctcagaagccagctcgcagtcatcaacttgtaggaaagatgcaactttggttaagttgatctgacgatcccctcggatacaaatcgcaaagaatttctccgagtctttttggcgagttttaacaactaaagttttcagtattttatgtttaggggtgttaaaaaagacttctaagtcttcaattgttcgaatgttaggagtcgcaacttcttctacaggtagaaggtttgaatcgtaaacataggatggagggattgcttgtgctgcttctacattcgctccgtaagacccactcacacagatcgtgtcttctcctaaagaacagagaacatggaattcctcagatttccccttaccaattttccccccatctgcagcaacaattacatatttgagatttaatcgatcaaagatgcgctggtaagctagacgtagctttgcatactgttcttccatttgttctggagagtcagaaaaagtatagctatcttccattaagaactctttggcacgcataagcccaaagcgaggtcggatttcatctcggaatttggttccgatttggtataggtggatagggagctgttctcgtcctgttagccactgagccacgaattcagagacaacctcttcgtgggtaggggctaaacacattgccttattttctctatccttaagcacatagagtaatttttccgataagaaggccttccaacgaccggttttttcccatagttctgctggttgcaggagagggagacagacctcttgtcctccaatagcattgagttcttcacgaatgatttcggtcatttttaggataactcgttggaagagaggtgtgtatgagtaaatccctttagatgttttgaaaagataccctgctttctgaagaagctcgtaggaaagaacggaggcttctttatttgcatttttggaagttctgtaaaacagaagggacgttctcatagggaaggaagtgctttatattgtttcgtgtggaanagcatcttagcataggagtgtttctagatcaatctctgtgatttttttgttcttattggattttaactagttcagattctttgtttcttaataacttgatgtttcttttgtttgtttcttaaaattaatttaagcgtttttgcaaattttgtttttaaatctctatgtcttctatacaaggaacatcgggttcttctcctgagaggcttcccaattctagggaagacgaggggatgaatcccgaagggtcacaccctctggtcagactatttctttccctgctgtagggaagagtacctctgcagaagatattcagcagcttgcacttccgattattcagtcggatgcaatggcatcttctccaagtgtgggaggagcagttggcgaggttgaagtcgctgagatcatcgcggatgtaatggagaagaacgacgcgaacgtgcagaaactggatgaagacatggaagctctactgcaagcgatttcttctagtgaagagcagctagagtctcctggggtaagaaataagagcgctctgaaaggaacgaatcgttctaattctcatcgagaagagatagctagaaaccagagactccgctccctttctgttcgtcatgggcttgcgcataaccgacattcattaagaagattagctagaggaatacgtcatcacgcaggactagtaaccgcgtcttttgcaacactacataaaacgcttcgtgcagttcctcaagaagatctcaagtccattttaggtaaggatagcgatacggttctagctcgcttacataagttaggattagaggtcaatgagaaaggggagtggagacttcgagccaacggagaggtcggctctattaatcaatctatctccaacttagctcgttctgcggaacgtttacatgatgacggacctttgagcattaatgaccaagcttctgaagaggaggtaacggcatgctgttctgtaggaagaagagcctgtcagtttttgcaagagcatttaatgggtgctttgcgagccatttactaccagatcttgcgtttctttcattggatatcgaggagggtagaggttgagtctgaggacacagactattacatgcgtccaggcacattcattaacccttacgcgtcgtatttaagttctagtccttctgtggaagaccctcgttctctacgggaccgcttgcgggatgggggagctctgtccggagaggatactctattctctatgcctcaagatgagagtttagattcggaatctgtttccgatgatgatagaggattttaatagtaggattaagggatttgtaaagtcactaatccagtattatctgcagagtggaaagagataaattggtgagccggagccatattaaatggaagtcctaagaaccggataatttcctcattgaaagtaattttggaaaggatcggctctgcgctaatctggttcaaatgctcttcattgtttttcttgctgagcaaataacgaacgatacaggctatttgtttgcctgatagtttataatcaacgctacatgctgcacaagcaccttccataacaagggaagagtcatctgtgatcagaggaatattttcttttaagatgcttttaatgagcgtcgttcccattttttctgataaggaagaaagagggaaaaagactgcggaaggacgattttctgcaataaactgaatgcgagacgacatgttggctgcagaaataggaagttctgtcactttaatgcctgacgcgcggagtttatttgtaatttcttcctgtaaggaagaagggaaaggttcgtggggttgtagataaaccaacgaattcgcgttgttggttaccgcatgaatcgcgaaacaacattggtttgtgtctacgctatcattaaccccgtatatattaacctgctcttttgggaatcggagagcttctcctgcagggacaacagcataaatgatcggtttttgtgtttcgatttgactcattactttagttgcaatggggcctaaagtaatgatcatgacaacattagggtctttatgaagggtgcgagcgatttttcttgctttgactacattatcctcagcattaaatagagagatagtgggcatgttcccaaagctggtcagttctttttgacaactctctatgcattcactaagagaattatgggaaaaggaagagaagatagcaatgctaggcgttattggttctgaacgaaaggaaacaacaatgacggaaataaaagaacaaactagggaactacaaaaaagatagccacaaaattttcgcaaaagcatacaaaccttatgattgcagagcaggagccatttgtaaacgttcgcaggctgctaatatgtcttcacgtttccctaaggaagagaagcgtacaaatcccgaaccactacggccaaatccaattcctggcgtaattgcgatatggtactctcgtaagaaaaagtcaaaaagatctctatcagagatgttcgcttgagtgggtttgacccatagataaggggcgtgttccccaccgaatacttcaaatccagttgccaatagcgcttttctgagtaggtcgctattttctcgataatagtggatcgcttcaagttgagggagaatggacaatcctgcaacgccagcttcttgagcggggatagaagccccattaaaagtggttgaaaggaagcgttcccagtcttgaatcacaaaatggccgtctgcataagtcaattcttgagggatgacggtccaacctaaacgaatgcctgcaaatcctagaggtttggagaacgaattgatttctattgcacaaaaccgtgcatcaggaatttcaaatatacttttagggagagaaggatcggaaatgaaggtgctataagctgcatcaaataaaatgagaatctcgtgttctattgcataatgaacgatcgcacgtagttggtctttatttaaaacagtccctgttgggttattaggagaacatagacataaaatatcgatgtgagtgtcctctggaaattctgggaagaatgcattttcttgcaagcaagggagagcgataatttcctttgcccctgttaagcgagcgatatcgagatatgcaggataagaaggatcctgaatagccactgtttgattgggaccaaaaaaggatagtaaacggaagagatctgcttttgctccatccgaaatgaaaatttcttttgcatcaacacagccgcgatagaaatcttccgataatttttgtcttaatgcaggtagtccaaagtctggtccatatccgcgacaggttgtaggagagctcaaacgggcaatagagctggcaaaagcctcagcgacactagcatttagtggttgggtggtatctccaatagataaattaataactgtatgttggggattttctaaacgaaattgggcgactctcttctgtaaatctgcgaataaataattttttgttaatgatacgaagtgagggtttcttttcataaaccacctaaagtccatgaaacacgggagagtcaaaatggtggacggtaatataaagatgagactctcatctgtccagcgtaatttttagagagcactgagaaaagctagaagccataacttaatcgaaagccataataatcgcattcttctcggacaaattgtccttcgtgggagaaaccttggtggtattccaatacagcgcgcacttttctccctacatcctggaatttggaccactccatgcctactatataagtttggtctatagagaagtcatgctcttcccaaaagcgaaaatgcatagcaaagacgggttgggcatgaaggttgtcttcccgtaatccgaaaggacgtagttcgatacctccttcaaagtaaagaggatcttcagggaatgttgaatctcgactaatgatatacccaatacctccataaacacggatctgtggagtgtaacgaaaagaagcaaagaaatcgacggcttcatcgcttcgattataacgttttttaggaggtaactggttggcaagaataaattcgtcgccaagatgagaagaaagatgccatagtctgaagcggtagctccatttgttcactgcaaagttgcacaaagcggcgacaaaaaagtcagagttgaccatgcaagcttctggatgatccaggtcgaaaacagagaatacagctccttggagaccaatatccatgtctccatggaatcgggagacatcaaataatcgtaagaagataaaatctccaccgaagtagcagagccaacacgttttcctacgacttcgtcgttaaaacggatacctgcactattagttgcttgtctaggatctgctacaagaggcgagaataggatggtattctgtggtaaccaaatagcttcttttccacagacctttgtacagaaagaacgttgttctggaagagaagtctttccatgagggccttgatgatgacaggtttgataggatgcttggcagatttctacggagtgaatgaatggaaggtctttaattaggttgataatggcgttgcgcgtaacatcatctgtaggaagagaaaataagtaagcagtttggttttcaacgatgacctggcagcagctatctaagaaatgcatatcaatgagagcctgtacataaccagagtgataacaagcatcatcagcatgaatgatgttttcagggagttgatccgtgtaggtgacttctttccaattattctggcagtcgggacaagaattcggttctttagcaaacgctgcctgtaacaaagtaaaatagattgcgcaaaagaaataaccgaaacgtagaggtttcatcatgttagtgtgggttatgagacagccgcgttataactcggaagcagagaaaaaacaagatttttaggagaagagcgctcgagtgtcggcttctttcggatttgactaagaattttaggaggcaatgaaatccagaatgagtatgcttgttggttagttaattgtgtgaggaaacgtaaaaacggtgcgttttcttttaaaactcctgagtaaggagaaggagaatattttgttagaaggcttttgggttttagaggttagggtcactacaaaggcgcgagagaatagagtcgtatgtttggaagatggtatattaagagttcgggtaactgaagttccagaaaaaggtaaagccaatgatgctgttgtggcattacttgcaaattttttatctattcctaaaagcgatgttactctaatagcgggagaggcctctcgtaggaaaaaggttttattgcctagatctataaaggccttcttacttgagcaatttccctcagaatcttcctccactacaggaaaaaaatcctaagggaattgttgttttagacgatcactaatccatctggagctggaggatagtcgtatcctatagggagttctccagctaggaattgttcgaatacggcaattccagcttccggagaagtgatacaatataggcagttgctgatccattcggatccacggatggttcctgctttgaggttgatctcgtaggcgtgggccactttttctttccagtattcaataggtccaattaggaaaatgggagtcggtggtttagctcctgttttgagatagacaagttctaggtagagttcgaaatcggttcctacaccgccaactacaaggataggaaggtctgcataaaagtgttcttgcctttctataagttgaggtaggcggtatgtcattttagcatctaagaattcattggtaggttggtcaatttgtgctggagaagcttctaaatcaagaacggttccacaagataggattcctagttctttagctacacgatttcctgtggccataactccagtgccgcctccggtgatgactgcaagtggggtaggctttgagaatccaggaatgccaagagtatgtgctgcttgctgtaagcccgctaggagggtatggagctgagcagagaaattattctcaaggagacgagagccataaatagcaataaaataagctgatcgaaactcttcaacacgatttttgatcacgaacataccgctattcttatcgcgtcgttttgtatattgcaacacgcggccgctttcttcatctgcccagaaaacatcaatatctgcttgctgcagatctaatagcaaacctctgtcattatgagagaaatagtttccatgtgtataagagggaacttgaaagtagatttgtttgagatagtggcgcacatggtaggaaatcaacattccttttaagctagctgaagggaaataacgagtgagtaaggctccttcgctattgatcaggcccatttccattgcttctaagaaaggatagcaaggttgagcatgagtgtactcgtttttatctgcttgctcactatattgataggcagctgcggatcctgtgagccaagagtctgtgtgcagggaagagatttcactgccttttgataaataggtggcagctttgacaggttctttgggcgctgtttcgaatatttttttgatttcgctttctgattgtaaggtggtttgtaataaatcccgattacagaagtaagaatgttctttatagggttcgatagtgaaaaattctaaaggaattctttctatctgtgcagaagggttcccaaaaaattcaaagatatccccggattctcgagtggttggttccaaaatattggcagaagtgtgggagagaccttgagggaggagttgatttaccacgcgagcaaatacagtgcggatgtgcagcggttctgttttgatcagaagaatatggtttccgcaagggacatgttgcccttccacaatctgttggtacagagctaaaaagtgacgaaatgctgagtttgggattactaagtgatttttgaataagaggaaggagtccaataaatatccgaatcataacgaacaactcccggcagggaaggaagggagacgacaaggcgatcatctaccacatcaaaagaaatcaagtgttctaattttttcccaaaacagagcaaaggatggccagctttatctgtatttttcagcatgctttcgaggtaatctggagatcggaccagtctgcgatcgtctgcagcaaatagttttgctacacgatctcctggttggagaagggctagcatagattcagcaatggggccatgaccggtaaattgagcatgtatatgtgctcgatgttgatttttgctcaattcgcagtgaagaagggaggcatctattcctaattgagctagagagctctttaaattaaggtgtatgcaatgagagggtaattggaatccaaggaaataagaggggatattttgaatctcgatttctccttcgtatacgccagtaccaactaactgaagggaagaacataggtagccgtctggagagacggcatcatgatgagaatgaaagagcgtcattggaatcctcgtgtgtgaagaaccagcttataggaaaaatttttaaaaagagagtttaaagaacgctatatgctgcttaatgcgagctttgtaaaggatttatttttaaatgtgatgtaggtaaagaagatctagggcttcgaacaggaaaataccttcagcggaacgcttgatattaatcctaaactgcaagtaggatggaggattttcagcttttggatatggtactaccggccgaggtttgtttgttgttctattgtcgaggggatcacggaggataatgagaatgcaaattccaagaagtgttggcacacatgatggttcttttcacgcagatgaagtgacggcttgcgctttattgatcatgtttgatcttgttgatgagaacaaaatcgttcgtaccagagatccccaaaagttggcgcaatgtgagtacgtctgtgatgtaggaggccgctactctacagagcataagcgtttcgatcaccaccaagtttcttacacaggatcttggagtagcgcagggatggttctggattatttgcatggtctgggatttctttctcacgatgagtacgagtatctgaataacacgttagtacatggtgtagatgagcaagataacggacgtttcttttctaaagaaggcttctgttctttctctgatattatcaaaatctacaatcctttggaagaaggaggaaatacagacaaaaaaattttctttgctttacggtttgcaatcgatttactaactcgtttgcgagagaagttctgttatgatcgtgtgtgtcgtgatattgtgaaacaagtcatggaaaaggaaagtgtttgtttgcgatttgatcgtccgttagcatggcaggagaattttttctctttgggaggagaaagtcatccggcagcttttgtcagtttcccttgctcggatcaatggattttgcgaggcattccacctactttggatcgccggatggaagtccggattcctttccctgaggagtgggcaggattgcttggagatcagttggttcaagctacgggaattcctggtgctattttttgtcacaaaggactatttctttctgtatgggatagtcaagagagttgtgaagaagcactgaatttagtgttaaaacagcagagattagtatgactaccatttttgaacgcattatagaaggagctgtggaatgcgataaggtttttgaggatgaaaactttatcgtgattaaagataagttccctcaagctccagtacatttgctcattattcccaagaagcatattgagaagttacaggatatacaaggcgacgattttctcttgcttgcagaagctgggaagattattcagttgatggctcgaaatttcgggatagaaaatgggtatcgcgttgttgtcaacaatggcttagaaggggggcagagcgtattccacctacacattcatcttcttggtggaggcttattaggctccatagcatagtatatctgctcgttatgtgttgtgtggatggatctaattccatccaacaacgaatgcgtttttgtgagtatcgtaccgcagcgcaagaggctaagacctcattatcttccgattgttccttactagaagctcgcttggctttacgagccttagccaaacatcatgaatattctgcttggagagaggccttcctccgttctcaagaacgctttccttcattggaagcagatcgtgatattcatgaggatcttgcagcttctcttctacaaaaaaatattagacattcttcacttaccgttcgagtaattactattttagctgtagggatggcgagagactatcggttagtgcctattgttttgcaggctttgtctgatgatagcgataccgtacgtgagattgctgtacaagtagctgttatgtatggttctagttgcttactgcgcgccgtgggcgatttagcgaaaaatgatttcttctattcaagtacgcatcactgcttatcgtgctgcagccgtgttggagatacaagatcttgtgccctcatttacgagttgtagtccaaaatacacaaattagatggaacggaaagaagagaagcttggagatctttatgtgttcttactcggcctcatagtggtgtattaactggcatagatcaagctttaatgacctgtgagatgttaaaggaatatcctgaaaagtgtacggaagaacagattcgtacattattggctgcagatcatccagaagtgcaggtagctactttacagatcattctgagaggaggtagagtattccggtcatcttctataatggaatcggttcaaaagttagcttgtaattcactttctgctcgtgttcagatgcaagctgcagccattctctatttagagggagatcctttcggagaagataagcttacagaaggtttatcagctacttccagcatcctttgtgaagctgcctcagaagcggtctgctcattagggattcatggagttcatttagctggacgttttttatcaaaagtacaaggaatgcgttctcgagtgaatcttgctttcgcgcttttggtaagtcgagagaaggtagaagaagctggagatgttgttgcttcttttatgcatagaatagagccctgtcaagctattgaacagtttttatgtgaagatcagaagatttttgtagcttcatctcctctgcaggtagaaatcatgaaaagggatttggcgaagaagatcattcgtttattagttgcagctcagtacagcaaagcaaaaatggttgtcgctcagtatttagcagggcagcaggtgggatggagtttctgttctgaagtcttttgggaagaaggggatagcgaggattttgttgaaccattacaagaagagagttttgcgtttgccttagagaaagctctttcttttttgcaacgcgaaggaggagaagctgggttgcatgcagtgatcagtttatatccacatagtcgctggcaagacaagttgactatcttggaagcaattgcttattcagaaaatagaatcgctacatgttttttaagagagcgttgtctgcaggaagcggcctctttacaatcggcagctgcaggagctgtattcgccttattcaaatagggatcaatagctagtggccgcgctggtttttcaagattttttgtatgcgcgcagaaagtttacacgcagtttttttcacaactacccttggagcacaccatgaacttgggcgtatggaatacagatcaatggaatggttttcataacaagttggagggaattccgtaagtagcgtgtaacgttccgtcccagcctgaacagggacgttgtgggaagaacggatgatgtttttagaaagagcttgccagcgcagagtatctttttgagagatccgagtgcacaaganagctcctaaatagaaggctattgccacgccaaataggatcaagggaataaaggtggggattggcgctgcgactatgaactgtaggatagctccagtaatagcaaggagagatgctatcaaagtgctgcatacagtcagtacgtctaggcaatgaacacgagcgcagaggttcagcattttctggtgagtttcttctaacagaggggataaaaaggggatcagacctcttaaagaagtaattggaccaccagagtgcagacctttaacaggatggtttttacagcgtaaaacagacagtttggattctgagtgagctgtgggtttgttaggtacaacaatagcaatatccacgttggtaggtgatacaacgccatcacacagtgtacagtagaagtaactgttactgtatgcgggaatattgttgtatccgggataacaagggatagatccgaacattgcttttaagagcctcgcaatcattttgcggtatagcgaaaaaattttaacaaaagtttttctttgtcttcaatgaatttaatggttttaaattaaattgttttcatttgaatttaattttattttttaagatctatttgttttagttttataatagaaactattgtgttttgtgagaaaatatgctaaaacaaaaatgtagattattctttatacaaggcgttatgtgtttaacttgtagtttgctttgttattgtaggaaactactcaaaggaagagatgaatatgctgatgaggcgctatttcaagcttttcttacgacgctgatagatgtaatttctgatattaaacagttgtctaacggatcagaatagcatcattaaacgttctcttctcttcaagagaagagggcgtttttttcattgaaaaatctttctatttcttttctcttccctgtgtgtatgatttgctgttcatgagttaagagaagaaacaaggaaaacaaatctaatgggaaaaaaacgggtcccgctacctcatgtatttaattcgaataggagtcccgttattcgtttatccgaaaccgtgtctataggtggagggactcctatcattattgctggtccatgtaccttggaaagccaagaacatgcaattactttagggctacaggttaaaagtgctggagcgcatatttttcgagggtctattcgtaagccaagaacgaacccgcattcttttcaaggttggcctcccgatcacgtagtgtggcatagccgagcaaaagctgttcatggattattgacggagacagaagttttagatgttcgtgatgtggaaattacagcagagcatgtagatcttttacgagtaggggctcgcaatatgcaaaattttgtcttgctagatgaagtaggacaaagtcatcgtccggttattttaaaaagaaatccttcagctacaatttcagaatggttgtctgctgcagaatatttgttacagcatgctagttgtcctggagttattctttgtgagagagggattcgtacttttgaaacaactactcgatatacattggatctgaatactgtcgcatggattaagaaggaaacttctttacctgtgatcgtggatccttctcacgcatcaggaagacgagatttagtgttaccattagctcgtgctgcaatagctttaggagcagatggactgatgattgaagtccatgagcatcctgaactagctttatgtgatggatcacaacatattcttccttgtgaactcgaagagttagggctttgggttcaagagattggctccttagaaacaggagcagtttttgtatagattcttattttttttaagaatcatgctgggtatagtccctgtcgttagaccattgagtcggagtgagtatgtgcataaaaagaaaaaaaacatggatagcttttttagcagttgtctgtagtttttgtttgacgggttgtttaaaagaagggggagactccaatagtgaaaaatttattgtagggactaatgcaacctaccctccttttgagtttgttgataagcgaggagaggttgtaggcttcgatatagacttggctagagagattagtaacaagctggggaaaacgcttgacgttcgggagttttcctttgatgcactcattctaaacctaaaacagcatcggattgatgcggtcataacagggatgtccattactccttctagattgaaggaaattcttatgattccctactatggggaggaaataaaacacttggttttagtgtttaaaggagagaataagcatccattgccactcactcaatatcgttctgtagctgttcaaacaggaacctatcaagaggcctatttacagtctctttctgaagttcatattcgctcttttgatagcactctagaagtactcatggaagtcatgcatggtaaatctcccgtcgctgttttagagccatctatcgctcaagttgtcttgaaagattccccggctctttctacagcaaccatagatcttcctgaagatcagtgggttttaggatacgggattggcgttgcttcagatcgaccagctttagccttggaaatcgaggcagctgtgcaagagatccgaaaagaaggagtgctagcagagttggaacagaagtggggtttgaacaactaattttagaaaacgattaagaggccttattatggaagaaacatcttgttcggggaagattgtttttttaggcacaggagatccggaaggaatccctgtgcccttctgttcttgtgaggtatgttcgcaaggcagaatatgtcgtctgcgttcctccgtgtgggttcagagtcagggaaaaaactttatcattgatacaggtccagatcttagaacacagctattgcgataccgtgttcctcgtttggatggtgtatttcttactcatcctcattatgatcatattggagggatcgatgatctccgttcttggtatatcacgcatctagaatcagttccgattattctttcatcatttacatatgactatctatgtaaaactaaggagcatcttgttcagaaagagactcctaataacagtttagcggcttctttgcgctatactattttaaatgagaaatgcggagaacaagagttcttaggtattccgtttacatacgtttcctattttcaaaagaattgtcaggtaacgggctatcgttttggggatttagcttatttaacggatatgtctcattacgatgagcagattgtagattatctacaaggagtgaacacgatcattgtgtcagcttccctaggagttttgcctaaagcttttggatcacggacgccttcgcatttaaccttagaacaagcggatcttctaatggaaaaggtgggagcttctcgtctagtgattacacatgtgagtcactatcttcacaaagttttggaaaaggatgttacacgagagtgtgcatacgatggcatggagcttttatggacataaggaagaaaagaaatgaagaaagataatcgagatgggaagaaagagcggcaaagtgcaataggttggaggtttttgcttcctagagaggaacaagatcctgcgcaagctttagctgtttgttgttatacaaatcgtgcagagcaggatcgtgtttctgagtatgttgaggagctcatttctcttgcgaattcctgtgatcttagtgtgcttgagacttgtacatggcttttaagagctccttcttcttcattttatttaaatgaagggaaattagaggaaatcgaaagaattttagaagaatttcctactattgggactttgctaattgatgaagagatatctccctcccagcaaaggaacttagaaaaacgattacgtgttgttgtattagatcgtacagaattaattttagaaatttttgcgagtcgagctctcactgctgaagctggattacaggtagagctcgcgcaagcgcgttatttattaccacgactcaaacgtatgtgggggcatctttctagacagaaatcaggaggtagtggtggaggttttgtcaagggagagggagagaagcagattgaattagaccgaagaattgttcgggagcggatacataaactatctagagatctaaaaaatgtagaacgtcaacgggaagagcgtcgtaaagcgaaaaaacgtaatcagattcctacctttgcattgattggttatacaaattcaggaaaaagtactctgttaaacttactgacatcagcagatacctatgcagagaataagctgtttgcgacattagatcctaaaactcgacgctgtgttttgccttgtggtcagcgagtgttattgacggacacagtaggctttattcgcaaacttccgcatactttggttgcggcatttaaaagtactctagaagctgcattacaagaggatattttattacatgtagtagatgcttctcatccacttgcattggaacatgttgagattacaaaggctnttttgcaggagttaggaatcactcagcctcaagtaattacagtattgaataaaatggataaggttgctgatggagtaactgcttctcgattgcggctgatgtcacctaaccccgtatgtgtctctgctaaaacaggagaaggtattcgagagttatttacgctccatggaggacatggtacaagaggagtatcctcaagcgactttacatcttccttacaaggaatacggattgtttacagaattgtgtgatgccggcttagtcatctcacattattatgaaaacgatttactaatagttaaggcctttctaccgaacaatttacagaaaagatattcggagtacattgtagagtaatagatgaaaagatcgattgttctacaaaaatggaatcgcgaaagatcacgaaagatagtacaagtnnaaagaaagaaggtctctcgtatcacatttcctcaaaaggagaatcatgatgggtaaaggttttttagattgtgagtcattagttgctttgcaagagatggctttgcatccgattgatttgactgcatcaggatgcttatctgaagagcgtattcagaaaaactctttatctgtagaaggatttacctatagttatgctacggaacgtgtagatgatcgctgcttagaggctttacaaggacttactgaagagagggaattgatcaaacagatggagtgtatgcaacaaggcgccatcatgaatcgtatagaaggttttcagagcgaatctcgccctgtattgcatacggcaacacgcgcttgggttcgagatcaagatcttcatgaagaagctgctgcgatagcaagacactctaaggaggaagctcttcgtcttgcagagtttctgtatatagctcgtgctaaattttctacgcttgtacagataggtattgggggctcggagttgggccctaaagctatgtattttgctatgcaaggctcttgcccatctgataagagaatcttttttgtctccaatattgatccggataatgctgcagaagtattacgggagatagatttggagcaaacactggttgttgtggtttctaagtcaggaacaactttagagcctgcagcaaatgaagaactgttcagacaggcttatcaaaataaaggtttatctattgcagagcattttgtagcggtaacttctcaaggnagccctatggatgataagagtcgttatctagaagtattccatctttgggatagtattggcggaagattttcagctacatccatggtaggaggagttgtattaggttttgctttcggttacgaagcttttatagagtttttcaaggagcagctgctatcgatgctcatgcgctgactccaaaaatgagagagaatcttcctcttctatctgcgatgcttggagtttggaatcgtaatctgttagggtatcctacaacagcagtgattccttattcgacaggantgaaatattttacagcgcatttacaacagtgtggaatggaatccaatggaaaaagtatttcgagagaagggaaggagattagttttaggacttcacccattatttggggcgatgtggggacaaactgtcagcattcttttttccaaagtcttcatcaaggaacagatattgttcccgtagagttcattggatttttgcataaccaacgagggctagattgtgtattatcaggaagctcatcatctcaaaagctctttgcaaaccttgttgctcaatctttagctttagctcagggtagagataatgcgaacccgaataagaggtttaaagggaacagtccttcttcgatattggtagcgcaacagctttctcctcgtattgctggtagtttattggctttttatgagcataaatttgcatttcaagggttttgctggggaatcaattcttttgaccaagaaggggtttcattagggaaagaattggcaacgcaaattataggcatcatgtcggggaatgctcctgtagagtttcccgaagctcgaggtgtgttaagactttttaacgttttaacataaagtgctttctacggagacggccaggcaaagtttttttgtttgcagagtttttattttaaatatgttataatctgtctatcacttctctcttaaaatcgtttttttaggggctgtatgttctttattcgcgcacggtttattggttttttagatgtccacggttatttggctgctaaaaagggacaacaagttatgcggtcgggatcaagtatatgggtaggatcacacgggcctattttttataaagttttctaagttcttatcagttaaagtcggctcatctattgaaaaatagatgagcttttttttgccaaaagcttttactaaggaatctaggtacttgattcttttatcatccaaacgtatgttgggaccaaaattagttagttgcaaacgtagtgttgagagtatgtgcgttttgtaaaagtaaagagagggtggcttatggtttctcaaacagtgagtgtagcagtaacaggaggaacagggcaaatagcctatagctttctattttctctggctcatggagatgtttttggccttgattgtggcatcgatctgcgtatctacgatattcctggaacagaaagggctttatctggtgtgcgcatggagctagatgatggtgctttccctctattacagcgtgtgcaggtaacgacatcattgcatgatgcttttgatggcattgatgcggcattccttatagggtcagttcctagaggcccaggaatggagagaagagatcttctaaagaaaaatggggagattgttgctacgcaaggaaaagctttgaacacaacagccaagcgggatgcaaagatttttgttgttgggaaccctgtgaataccaattgctggatagcaatgaatcatgctcccagattattgagaaagaactttcatgcgatgctacgattggaccagaatcgtatgcatagcatgttatcgcatagagcagaagtacctttatcggctgtatcacaagttgtggtttggggaaatcactccgccaaacaagtgcctgattttacgcaagctctgattaatgaccgtcctatcgcagagacgatagcggatcgtgattggttagagaatattatggtgccttctgtacagagtcgtggtagtgcagtaattgaagcacgagggaagtcttcggcagcttctgcagcacgagctttagcagaggctgctcgatcaatatatcagccaaaagaaggagaatggttttcttccggagtgtgttcggaccacaatccctatggattaccggaagatttaatctttggtttcccttgtcgaatgctagcaacgggagaatatgaagtgattccagggcttccttgggatgcctttatccgtgggaaaatgcaaatatctcttgatgagattcttcaggaaaaagctagcgtatctttgtaaggaaaaaaggctcctctcttttttaagaagagaggggagagttaggctgctccctctggagtgtagagaaactccttagctatatatgccgtggaatcccgtaatagagcctgggcgagcatatctcctaaaagcccatggtatagaagacctttggatcccaaacctcctaaataccacaatttttcttgtacgcgactgatcatgggtaaatgggtggggctcgatgagcgcataccagcgtaataattaaggacttgagcgtctttaagcccagggaaaagagctaggatcggaggcatgatttcctgataggcaacttgagcatctggagtggcatctggttggttgtgctcgaaagttgctcccaatatacaagtatttcttgttgtatcagcaaccatatatttagggccattgatgctgaatggtggcatagggatctcagctggccaagcaatttctacgagctgaccttttactttagataggggaaggtgtttaagctcagggagaatatctgcgttcgctccaggagttacaataatgtgatcataaaactcagcgattgctgaaatgtcatcgatcagctcatcgtaatattgtgttccaaggctagcacaggcattccataaaccgctgatatatttatcattatcaatggttaccccatgtttaatgtaaagggctccgagtccatcggcaatgaccattccaggaactgtaatttcacaccgagctttatcccaccactccgtttncatcggggaactcctgtgctctttgcatgaaaatagtggcctgttcctgagaggctgcaggacggaggatcccattggatgtcacgatgggctcccctatagaaaggctcgctttggtaatgagagaatcggttgtggtgatccctagatttgctagcggaggcttgatagcttttttccctgtaaagccatgaagaaggccagaagataggcctgaggctccagatccaataggggttgggtcaaagagatcaacgctaattcgtccttgtgtataaaggagaagatgccaagtcacagataatcctgcgtatcccgctcccaaaaccgctatgtgcataaaaataccttaaaagctgaaaaaaagattttttagaagtttgattcggctttactattgaggataagagaagaggattttaaagaatagaaagaactgattctctttgaaaaagaaccagttccttttgaaaagataagaaaattaaacgacgggcacttaaagctctctctacaaatggattttattagcagagaataaaaatatagcgagtagagccgcaagagccatgatcgtcattttcaggatttctttacgattcaagaaagttttttcttgtttatgtctgattcctgaatctacgtaaaatggaatccctaaagcaagtaggatagcgaccataaatagatgttgcaatcctccagcatagatcagccatagagagtacagtgagcccaatagaccggtgatcatcgcaatgcgagctttgatagcggcctgtttgggatacttcttacttagactaaatttcacaaggaaaagggaactagttagataagcaggaagaaccataacgccagtgatttctaacattgtattccatgcattagaagagaaaatatactagtagcatggtaatctgcattaacccacttgtcatgaatagggaaaaagaaggggcgtgtttgctattctcgatggcaaaacattctgggaatgttccattcttagctgcagcgtaaggaatttcagaagcaaggattgtccaggataaccagctggttaagacggctattaatagtcctgtattcataaggacttctccccatttccctaccagaatgttcagtaccccagcagtagaaggatcggctatttttgctagttgatactgaaatagggaaccaaaaggaagcagtgaaagcaggacatatatgagtaggcatcctgaaaatcctaagatagtggctttcccaacagaggagggattagcagctctgccagaaattactacagctccttcgattcctataaaggcccaaagagtgactaacatcgtgctctttagttgagatccgatagatcctagtgtatgttgcggagcagtcccccaaaagtcagttttaaagatcgaaaacttaaagaatcgagctgtgatgagaataaataggagcaaagggattaacgtgcagactacgccaataatgttaacaaagctagcctggcggatacctcgtaagacaatgtaattgaatatccaaatcaatagtgatcctaataagatggccggaattgtgtttcctccagcaaagtatggtgggaagaaatagttaagggcatccatggtaattacggcatagccgacattcccgaaaatttggcaaagccaatatccccaagctattgtaaatccgacataaggaccaaatccttctctactgtaagtatagataccagcttttaagtcagggcggataatagaaagtgttttaaaggtgtttgctataaaaaatattccgattccggaaagcatccacgctaacatgaccgcccccgcacttgcagaggccgccatattttgaggaagactaaaaatacctcctccgatcatgtagctgatcacgattccagtaagagctaaggttcctaaaatgctagtaggagaccgtttctttaataacataaaagcctccttttcttattggataacagcaggcgctgcattttcgaaatttaagaaaccgagagctgttaagcaaaaaccaaatttctttctgatgttgatgtagttatggaaatattggaactcactatgcttacttacggatcgaagatctaattcatgctgaagggatttttttaaccacattttagcgtgagattctgcgatttcatcatcgatttaagttgggaaaaactctacgtattctgctgcccagcccccgatgagctctccatttttatctttcccccaacaaatgcctactcctgtagctattgcttgtgtgccatctgtgactgtagcacctcttcctgccatgatgacttctaatacagcaccatgtttgaagaattttgtacattgatccacaggaaggatatttccgaataattctttaggcaaaacagaggtgtaggggacgatattgaagttttcgatttttgcttgtaataaggctgaatcataacagaatgtttcgaaaggttgaggcggcatgccatcatcggactcgccaacgcctcctgtgtgaaaagccaatgtaggataacgagttccgtaaggcatagggcctccttttttgttggtaaatggttaaccacaaggatgcaagcgtttttgtgctaatctacagattagatagctaaattagctcgcacgctataaacacgggcagattgtttgtttggacgaagagctgggtagaggtagagttggaagtctggagcgaaagaaagataggggccgcaaccgatagttgcaaacccttcgattacagtttcgtattttcttttagcatttggagaagcagagaggtgtacattattgaatgcgcaagcaattccaaataaatcttgtgggttacggttaaataaatttgcagagaccataccgcatgaatacgtgcggttaatcgggaacacatgtcctgtaacaccgctgtatcttccaaacacatacagtttagaagatatgtattgactcgcattgactgaccatcccattgtttgttccatctgttctggaacttgtctagtcacataaagaagcacggagtactggccagatcctaagcaacagcggggagcccaggaagcaaaaccgtgaaaattgtatctattttttgtaaggttactccatttgatagaggatccggagatattataagcgtcttgaaatcctatttgaagacttgtgcttgcggtaggagcgacttgtaggtaagctccaagacttccagaggaataagttgctgttggattttgtgataatgcgtaactaatgaatccaagttgttgatcgttattgtataatgttccgtctattgcatagagtgagtactgaccaattgtcagactcacccgttcatttgggaagttttgggagaaagtaaactgagagaaaatgttctgacgagagggataatcattgatactccctgcgagcatcatagcatcgccagcagtcgcagcattctctctccaatagtggacaagggtataggatatttgaaagacccctttcccatatgaggaatcatagatagtaacggccgcagatggattaaagcagttttgccagcaaggaggagtggcttcggtaacagtttggtgtgcgctatacccaaagtctcggatagaaagcttaggggcatgagagacccgaggattgaaccattgagggagaatagaccaatccagtgcaatttgggttcctgcagaattttttagcgcttgcttgagatttctaacagaaactccgtgtaagcaaaggcgttccgaaataaagtcatagatgggggataaaaggcctctttgttctgatagagggattaattccttactaagggaaggagtattgcacgcctcttgttcggtaggtttgggagagatgaggtcttttttatggttttgtctgtgcagtttatctgtgtagcggtgatagtgatggtgtgcagcctgcatggtggtcgtaaaagaaagggagagcagagcagtcagtaaaaccgaacggaaggacacaacaacctctaataaagcttttccacccgtgtagtggaaaaaagatttttttgccagagtttaatttcttctcaaaaagggaattacttatctagcctgtgacgagataagagtgctgcggcttcgttgctaatgagcttttggcggtataggtattgtattctggcaatatctggaagataaattgggggatgatatttagaggcagtataaacaatccctagataagggatgtttttttgtttacagacttctccaatacgtaagacattgtatttctcattgtcaatgtagatgactttctctggtaaagagggttgggcgtctaggaaatgttgtaatccaggtcctttatgaatttcagatccaaaaagaacgccttttgtgaaacagatgtttgatgggagactggtatagggaagattcgctttctcaaaagagaggttaatcttagcaagttgttctaatgtcacatcttgcgcgcatactttgcgctctgaataggcaaagacgattttgttttgattctgaactttggtaattaatagaggaatagcagtttctatctgtttaatagagccttgacgttgaatagatagccaatcaggatatagagtgtcccaagcttcttgctcggatgttcctaatgcccgcattccttgtatggagcgttcaaacaagctgaatggctgacagcttcagctccctcaaacaaaacgtcatcgatatcaaagatcagccagtaatttgcatcatcatacaagatgtttgaagcaatctcatgaatagttttcacagtaataatgcgctgcgaagcttcggagattaaaggagatagcaatagaaaaagaataaaacaaagacgcatagagcctccaaagacgaagaagcagcatagaaaaaaaatgtttatggtgcgatggaaaaaagagaagctaagacagcagctctacgaataaaggttttttccaaatgcttgaaagagagcgttgggaaccataaacgaaattgtaagagagcttgctgcgtgaacatctcatgaccataaataatggagcttccctgagatcgagcatactgagtgaacgcactatgtttaggaattgtattaatatcgacaacacagggagcaactgctttaggaatggtacaagaaggagaaggaggaaggcaattgatgataagggagactctgtgtagagggagttcctccagcgagaatgcttttgcctggcaacgagaagctagatcctcagcatgcgctttagtgcggttaaaaataagaagttcacagtttgctctgctcaatcgagttgctatggattgagctgctccacctgctcctataatagcaactcgttggttatttaaaggaatttggtgctgcatcaatacagaaaacaacccttcgccatcggtatcatgtccttcaatttctccttggcgaatgactagcgtattacaggatccggaagctttcacagatggagcttgtttatcaagaaacggtagaacagcagttttcaatggggaagtcacgctgactcctaaaaagggttgcgtgcgaatggtagagaagaatttagggagctcttgaggggttaaagggagtttaatatatgggcaagctactccgagttgggaaaagaaaggattatgggttaaatgcccgatacttcgtgaagtgtctcctataagagcgcagatgggggattgagcagaaaggcttgcgaaattgtagaaatagtggtgtttgagagaaaattgccctggagctacgggggaagatcctgtacttcttgcgtaggtaaatggattttgtaagatcggggagagtattcgtgaagggcgccccattcctcctagacaaactacagttgtattttcaggaagagagcgtttttggtgacagatatctaggagatctgtcgttgaggaagaggaaacagcgaatttatagtagtcagctgctgaagatcgcatatgtgcatagagttgtataatgtcggtatgctcactagtatgtaaggaacgaatgatcttaatttgaggatggagttgtcgaatgcgtatcatatcctcttctggaaaatctttttccaagtctagatagtttggatttagctcagctagcgattgcattttatctatccagtctgcttgtgagcatgattcaggttttttccatgcaagaatggaaataggagctagttccatgagtttcttgagttctaaacaagatacagaaagaagatctacccgcatttcaaagcaatgacattcttttaaagagcgtagtatctgcttcttagcttccaggaaagaaggtccactaattgttgtgcatagcatagaattcttcctccaggacttttgtaagaatgtgtttagatatagtttggcaaaatcgtccatcaaaagaagctgctagtccgatctcttctatcatgacaaatggtggtaagggagtattttgttttttcttatcgtaggtgagagcggagaggatttgatcgcaattatgtggaggtatttgcgctctcatataaagatcttttagagaaacagggagctgatatcttaaaaggtcttgtatcaaagaatgtagtatagctggagagcgagcaactcccaaggatagagatagctttgtttctaggaccattcccacgcttatggcacagctatggggaattttccctataaatagcatttccagagcatgccctagcgtatgcccaaagtttagtatttggcgttttgcatagtctctgacatcttgttgtactacagaagctttgcagagacagttctttttgataagaagagacagcttgtcttctttttttaaagcattaggatcttgaagcagaggtaggatggcagaatctgcgatataagcatgtttgatgcattcagctattccatgatggagttcttgctgaggaagaaaagagagttttctagggcagatccatacagctttagggagataaaaagagccgatgcgattttttatatgatttaagttaatgccatttttccctccaatgctagcatcaatcatagcaactaaagtggtgggaatagcaatgaaaggcatccctcgacaatgtgtggcagctacaaagcctgctatatctaaaattacgcctccacctactccaattaaagttgcttgtctaggtacattgagatctgtcagttgttggtgcaaagatagaaaagtatcgcccgtcttggtttcttctccttcaggaatggtaagtgtttctacggaaaatcctagtgagcgagccaagtctaatagaggaggtaggataagagtgttgagcttagtattggttataaaaatgagagggaagtcggtagacaacgaagcaaacagcttagggttttgtaaagaatcaactaggtgaatagggtgaggagagtcggtaacgagttcgatcataattgggtacaacgatgttggagaagcaggtctactagagttaaatcaagcatagcctcaacaacggcaacagctcgaatggctacacaaggatcgtggcgtccttgattaggggtgcggtatgcgatcggtgtgccatcttttaaaacggaggagcaaggtttttttatagatgaagtaggtttgaaggctacacggccttcaagaggctgcccaatactaatcccccctaaagctcctccacagcgattactttgaagagacaccccactttcatcagcaataaatgcatctagataggcggagcctgtcatttgtgatgaagagaaaccggctcctatttcaaatcctttagccgcagggatgctcatcatgcctgcagctaaaagagctggaagctttccaaacacaggttcgcctaggcctataggtaaaggagaagtgataaaagagactacacctccaaaagagtcgtcaggattaagcagaaggagattctgaatttcttcttgaggaaggagtgtgtagaaaggagaggtatgaacctgttgtattagcgagtcggaaagtttgggataatttttactctctaaggtgccgaatccagaaaggaatgcgagtgtttcgattccttgagataaaaggatctttttagcaatcacaccagcagcaactcgagacgcggtctctctagcagaggcgcgtcctcctccacggttgtctgcaaatccgtatttcccttcataggcaaattgtgcgtgccccggtcggtaacagtgttgtagatgttcataagaagagctggatacatccttgttttcaataagaagagagattggagttcctgttgttttgttttggtagactccagataaaatagtgactaggtccggttcttgacgaggagaagtatgaagttgccctggtctccttctagccatagcgggaagaaaatcttctggtgataaggagagacctgcaggacacccatcaattacgacgcctatagcagggccatgggattctccccaagtagtgatagagaatatggagccatattgattatgcataggagctctcttttgtgctcaaaaaacgcaaacaaaagctttgacaatctctcattcacagcttcagaggaagtctctgctcgtaaagagaaggcattttgatcgtgagggatcgtagtttgtctaatcgttgagacaaagcatcttctaatgatggagcatgtgcaagtctttcaggaatagatctatgttgtaggcgttgacatagtgtagcgatggggagttcgagtaagactaagagagcattgtttctccccaaaatatgggcgtaagatggttcaataagaggggtacagcctcctaaagctacgatgctaggaatgacaggtacactagttagggcaaggaattcttctctgcaaaaaccttcttctccatagcgttggtagatagttttaggagaatctccatggaaacgatctgaaagaaggtgatctgtatcaaaaaaaggcagcgatagaaattgcgataaatgttgaccaaacgaggttttacctacagaaggaagaccgcaaaggaaaatctgcttggtagtgtcgaacgttggcatgtagtgtctgcgctgcaatcacgaaatgtggaaaactcttatttatacactgtgtgttacagaggagggtttgtccggacgaggcatgaactccagctacagcgagagccatagcaatacggtgatcattatgagaatcaacaaccgcaccatgtaaccgcgagggctctatatatagaccgtcacgagtagggtggacagaaccacccattttttgcaattcatgggcaatggcttcaatgcgattgctttctttgtcctttgctcccaacgcattatacaagcgcgatggattttttgcaaagcagcagaggacagcaaggatgggtaatgcatctatgaatggatccatatcaatttcacctccggagaaagaagaggggtgcatttcgatatgatgtttttcaataagaatatgggctccaagttgttttaataaagagaagagaagcttgtccccttgagaatcttgagaaggaagattacggagaatagttggtttagaagaagaagagagtagaccaaaggaagctaaaaaagcagcagaactatagtctccaggcacagaataagaaaaactttctaatgattgtcctccggggaaagttaaagaatcttggtctcttaagaaagagatgtttaaagagtgtagccaatctaaggtcagatcaaaccaaggacgttctttaagattttcgatagaaaaagaaaggggatatggagctaaagctgcagtgattgctaatgctgatgcgtattgggaatcttgtccagagatagtaacatggccaggggataatggaccatggatggtaaagggaatagaagaagatgttttttggcgaatgtgcgcaccaagctgttttaagcttgatagaagaggcgctataggacgtcgtttgagtgtgtgggatcctgtgatcaaagtgggggtgggggataaagtagaaagggcggttaggaatcgaagggcgataccagaattccccatatggaaatagggtgggtgacagtgatggggatcgggattcccctggatatgtaaggagtctcctattcttctaacgtgagctcccattttctcacaggctgtaagcatagtttgggaatcgggagagaagagacagttttctatgatagaggtccctttggataaggaggcaaaaaggatcgcgcgtagagaatgtgattttgacggaggaacagcaatttctccgtaaggaattgagggagaaataagaagggcttggttcgaagagaccatatgtctattttctaaaaaggttaaaaatgaatagctaatgtagtcttcggaagagttttttgcatgatatttaagatcatacgagggaaataagttctatttttttgttatgaaaaggattttattttgttgttataattaatcttgttgaaagattttatggttttttatggtttctagggttcctggaagtagtgatcctgttgatgtaaatgctcttagtaacctttctcctgtacaaaatcagaactcaggagtttctgtatcagcgatttatctccctaatgaaacagtttctaaatcagggaaaacgctaaaatattcgacagagctcattgcaggtattgtttgtattaggggttgcattagcaattgtggctatcgccctaacgatactagctcctggagttccgcaatcgattgttttagcgattgctttttcaggaatttctgtcggtggagttaccacgttaagaagtcttattaatggaattaagaccgtagttgctccgagaatgacattcagacagagggcaaagagcgcactctccttggtgcaggattaacgggagctggtcttgtgctgaaacttggatcttcttatattcctgggggatatggtagcgctctcgggaaacttggggatgtttcttataataaagggagaggagctctttttgcagggttcgctcactatctctatgtgcgctttttccagtcaaaaaaagctgcatcgggtgaagctcttactccagaagagatgctcatagaaggagcaaagatacggaagctagcgaatggattagttctattaggagttggttttgcgtgtttagggattgctttagctgttgttggaactcttgctgtaactggaggggccgcaacagctcttatagtgttggctcctcctttaatcagtttagggatttctttagtgatctcgaatatgctgcacacaactctagggcaatggagagcttttgctagagctcaacaagatcaagatttacttgttgatactaaactaaaaaacatttctcaagcagacttcagttatcgggtagataacaatatagaggtggtagtcgatcctagagagtctaatcttccttctattgaacgtttgcctcaaggagaaatagatgcagcattgtctttaacgaagaaacaacagcggatcctgattttatcaggattattattgctagcaggggttacttgtactttattggctggatttgggggattgcctgctgtacaagtgttgctcctattttctataggaagagctgtattattgtcagctgttccaatggttgtttctggaatggttcatgtcgctcatcaactaaaagctagattacagattagtttagctcgtagaagagaagctcgtttgaaagcgcgcatgataagggaaatggataatagacgatggggtgaaagccgtgcaagcttgctttccaagaaggagcaagaggaaacttggaagttagttgggaaaccggtgatttttcaaacagagcaagctattcgtgagtatgtgaatggagcaactaaggaagaaagattccaatctattttagttgctaccataatccttctagctggtttgggagttctctctttaactctaattcctggattagctcctatatctggaggtattttagctataggaggagtccttttaggaattagtattaccatgtatcttcagcgatttattcagtggctgtatgaacagctgattaaacttcgtgactatattcagaaccgacaaagtgtgatcgttcagggagcttctgcatgtgattttgatgcagaagacatcatagttgatcttgttgcagatcttttgaggtcgatggggatccttttgtagaatcgtaacaaaaatattcaggtgcacatctaaagttctttctctaaataaattaggaaaaagagcaagtttgcgaatttgctttgcttttcctgntggagctatttactcactnatactatactgctgcagtgatttcttttagccatttgctaagaggatcctataggttccacaatggtggatgagagttgctgatagtattatgaaaaaaagcataggccttgtcggagatactggaaggatgggtgtcttattgactcaggctttactttgtcgtcctcactgttttttgggaaaggggttttcaagaagatctcagacctcgctagaagaggttgttacagagaatgatattcttattgatttctcgtctcctgaagtgacgtcgctgcttttagactttttgttaaaaacacctaggcctgtgattattggaactacaggatttactaatgatagcggtgtaaaaacaaagttatcagcattatcagaatatgttcctgttgttgtttgtgcaaacacgagtttgggggcgtatgtacaaaagcgattagcagcttttgctgcaaaactttttagcacttcttatgatgttcgtattttagagacacatcaccgtgctaaagcagatgccatttctggtacagcgatttctttggctgaagctatccgttctgcgaaggcagagagctgtgaggaagagccagagccttttatcgaaatgcatggttctcgtttagggaatgtttgtggcgagcatgaagtatcttttgtaggggaagatgagcgttttgtaattcggcacgaagtcttttctcgacgtgttttttctgatggagtgttgctaatcttggagaagattatgggagaaggcttgccaaaaggatattacacctcagatgttttgtatgagagtttgtttcaagaaaaggtgtttggttaaaagctaagaatgacgatgcgcattgcgattttaggtgctacaggccttgttggacaaaagcttattgctttgttacaaaatcataaacagtgggaaattgctgaattaggagcttcttctgagaagcatgcgttgcgttacgaatctgcttgtttatggcaagagccattaatggagatgccagagtctgttcgtgatttatctattcgctccgttgaagagatagaatcaaatattgttgtatcttgtcttccttcgtctgtcgctttttcagcagaaactacttgtttatcttcgggaaagatagtgttttctaatgccaccgcctatcgtatgcataaagcggttcctattttaattcctgagataaacagtgatcatttgtctctgttagaagaacagccttttttaggtaagattattaccaattctaattgttgtgtttcaggcattgctctggctcttaagccactgctgttgtttaatatcgagcatgtgcatgttatcactttacaatcagctagtggggctggatatcctggagtttcctctttagatttaattggaaacactgtgccttatatcttaggagaggaagagaagatactccgagagactgtaaaaattttaggacagccaggttttcctgcagagttttctataactgcgtctgtacatcgtgttcctgttgcacatgggcatgtcatctctgtacacgttatgtttgatcaagaggtcgatttagaagagataacttcttgttatgagaaggattcggctacctatgttctttatgattctccttggcatcctcaggttcgaaaggatctagctcatgatgatatgcgattacatatagggcccatttcttacggcggtaatacgcgaactattaagatgtgtatcttattgcacaatttggttcgaggagctgcaggagctttgatagcgaatatgaatcttttccgagatagaggaggattcgttcatcaagagaggctgacgtatgcttagacaaaaaacagctcctcttgtgtgtaaattcggtggaacaagtgtgggcacagcccaaagtattcgacgagtttgcgagattatacaagaagaaagaccttcttttgttgttgttagcgcagtagctggtgttacggattggttagaagagttttgtcggcttcctaaagggaagagagcggcattgactgaaaagattcgagaaagacatgaatcaatagcaaaggaattaggtatagaggtttctctagctatcttttgggagatcttggaacattttgaagatgtagaagagcttctttctgaagatcaagccaggattttggctataggtgaggatttatcttcgactttgatttgtagctactgctgtacctatgtgttaccgcttaagcggttagaagctcgtcaagtaattctcaccgactcgcaatttttgcgggcggttccagatttagctttgatgcaaactgcttggggtgagttggcattacaagaagatgctatttaccttatgcaaggcttccttggagcaacgtcttcagggaaaactacagttcttggtcgaggggggagtgacttttctgcctctctgataggagaactgtgtaaagcaagagagttgcgtatttatacagatgtttgtggcgtgcatacagccgacccaaaaatcttgaaagatacacaactcatagattctttaacctttgaagagatgcaggagttagcaagttctggtgctaaggtattgcaccaagatatgttaaagccttgtgttcgagcgaaggtgcctatttttgtgacttcaacatttaatgtaaccaaagaagggacttggatttgcgcttcattaaatgagagtacagagggtcctgtgatcaaagcactctcattgaagtcgaatcaagctctttggtttgtagaatacaattctcctctagtgagactagaggatgttttgggttgtgtacgaagcttgggatttgttccaggagttgtcatggctcaaagtttaggagtgtatttcactatagattgggaagagtatcctcaggctataacaaaggctcttgaagcttttggtacagtaagttgtgaggggcctttatctttagttgcattagtgggagcgaagctagcttcatggagtatgtctagagtctttgaggctctacacagaactccagttttatgttggagtcaaacggatacggttattaatttaattattaataaggattttggggtcgctgtaaccgagttgttgcacgattgcctatttaaataggagtattttatgagtgtcttgggggcctgtattacaccttttaaggctgatttgtctatagatttcgctgctttagagagtgtcgttcgttcgcaagagcacgccggtaacggcattattttatttggtagcacaggagaggggttgtctctaacgtatgaagagaagctttctattctttcgtttgtttctacgcttaacttgaatgtgccgatatttgtaggagtgacggcaacgtctgttcaggaaactatgtcttggattgattttgcacagcaatggcctatagatgggttccttgttccaactcctctttatacgagacctgggcttaatggacaaaaagcttggtttgatagggttttgagtgtaagtagaaagcctatcattctttataacaatcctattcgtaccggcgtgtctttgtatccagaggtcgtgaaatcttttgtatcacatcctttgtgcataggagttaaggattctggagggtctgctcaggcttgtgagctttttgctgagtcaggattgagagtgttttgtggtgacgacaatctgtggccagatatgcgattatctggagcatctggagtgatttctgtactagctaacgtttggccagaattagctcgagattatgttgctctaggtcgtcctattgaagcttggaagaaagtttgttcttggctcaacttatctacgaatcctttagggatcaaagctctaatggcagctcagaaaatgattgagtgtgatgcggtgcgtccacctctttctatacgagatttgcagagaagagatgagttagcagacattctagcttgtagggctactttgcaaacagagcttctcagcgtatgccggcagtgatatagtgaggatcatcactaaataataagtttgattttggcagataggaaaagcctatctgtcttctaaaatgagatgaactgtgccctttattacgtctttttacagaggtaataaagggtttttgtgtctatattcaatagggagatttcactacatttatgagaaaagcattcttgtttggttccatcggttgcttatgcttgctagttacactggaaagtagcggagagggcctttataggggatctaatggaaggatgacattcatttcagcagttgaatcagccaacagtcaactggagttagagagaaagaaagaacagcgtgttattgagattctaaaagaaatatgcaaagaaattggggtatatgagtctttattcgatgaagtaacagattctttggaattttgtgaattattaaaaaaaatccttgctgaaaaagattcagaggattttttagaggacgtttctactcaagattctttgtctagtaatgaacagcctatctctgagcaaacgataggagatcgtgtggaagagagcgcaatgattagtgagtgcatgataaaagacgttctcaatgctttacagcaatcgacagagtcttttcagcgcaaagaagaagaggcaagttttttggagagaaaagatttagaattacgggaaagagagttggcttttaaagaagaacgattatcttgggagcgagaaaaagccgagaaagaatgggcttggaaaaaggagcaatatattcgcgatcttgtgaagagagagcagaaataggaaagcaaagaaaaatttttgcatgcattaaaaaatcctttcatttagactggagaaagtttttctgggtaaatctccatggagatcgtttccagaaagcttcgcgccatatttatattatggtgcggctgcttttttccttctgtagctatccttatctaggcaaaacttcagaggaagttgaaggatgtctgtagttggtttaaaggccggataccttagtatcgattcggtgaatttgtggaagggatatggttgctaagagcattactaaagaatactcagaaactctcataagtaatccttttgtgaaggttattgccgggtccttgttcttagcttgtttagctaagatcagtataagtctcccttttaccccagttcctattacatatcagactctgggggtattttgtttagggcttgttatgactccacagatggctgttacgacagtagtggcctatttgttagaggggttgttcttccctgtcttttgtagtcctatgtgtgggatagcagtgttttgtggacctactgctggatatctattttcttttgtacctgcagtagcgctcatttcttggttgtatggtaagtntggaagatccgaagcaaaatcgtgggatgtcgcgatgattttgttcgttggcggaggggttagcctctgtttaggagctttatggcttgcctgttttctgaagagtattggagtttcaaactctcttgatctagtcggagcttttaaaataggagttttaccttttcttattggtaaaattgtgaagatcgctcttgtagttcaaggacgatctgtacgaagattatttatcagaaaataagattttccgaagagagcccttctgtccaaggccctctaagggtagaagagcaagctgcattagcagtgctcttcgaggcttctagcttcggcttgcatcaccagatgatctataagagcgatcctcaggagagagtggtggagagataggagatacgaggtcatcttctaatcctgcgaatggactctcaaaggacagaagggcgtcttcgacaccttcttctataaagatgacgccagactggcgttctagtgaggagacttcgctttgtagttttcggatagttagagtctggtagacggagattgcaatagcacataatagagaagagatcactagggtaatcgctgcaataagcaggctccatcctaacataggattcgatgccagaaacgctattcctaatccaagcacaataatagaggaaattctcataattaaaagagcgatttggcttactatgacaggccaaggtcttccctgtttagtgttgtatattgcatttttagcagaagcggaagatgaatgtggggaaacatccggagaagattgtgatgacgctgaagaaggcggtacagcaatcggtgtagccataaaagatctctgggttgagtgggttttattgttgtttctttgttgtaatcagctcggtaccggagttttcactcagtagtgcatgcttggttgatgaggaaatccataatcctaaagcaagggctaaaacggcatgaagagctaatataccagctactaagacataggcaagacttccaggggaagcaagcaaggctattgcgagaataatgccgaccgctagaagagaacatgccaaaatcatggagatcttgatacaagaggctccagatcggtggtttggtatttttgaatcagaagtcgtagaaggagaaacaggagcgtactccaaaactgaaggtttctgtactacaggcatatgtttctactatcaaactaaaaaatttgtaaattctttaggaagagagggattagaagaagtctcttcctccaaacccctccattttaccaaaaaagcgtatttaccacgcctaataaaggtaaaaggttacagataagatagttaggaaaattcggaagagaagggattcgaacccccggtccccgttgagggacttctgatttcgaatcagatgcattcgaccactctgccactcttccgtaaagagactcggcaataaaaggacgtatggtaacgcttattatagtttaagatcaagaattccctatttagttattagaaaatgaagggaaaagggattttgggttgtttataaccattttttattaggttttgtcgagtaaaatatttaggaaagtatagtttttgattttaaaattaaaagtataccttttgttttttttattttttatcatgacgacggaccagcctttcacaaataaacttattaccgaaaaatccccataccttcttctttatgctcatactcctgtggactggtacccttggtcggcagaagcattccaaaaggcttctgcagaggataaaccgatttttttgtctatagggtgcactcactctaagtggtgccaagtcatgcttaaggaaaattatgaaaaccctgaagttgcagcgattttaaacaagtattttgtttgtattaaggtagataaggaagaattgcctcatctggcaaatctatatttcgaattatctcagatgctttccgtatccggagaggtacaagattctccaacatggcctctgaatgttttcctcacccccaatctcttgcctttctttagcttgggatatgctagctttgcagggaaaatgagagcctcgtcctttgtccagatgttggaaaagctacatatcatgtgggaagatcgagaggatagagaggtatttgttcaacaggcagaaagagttcttgaagtagccgcttttctagaagggtgttcttgtaaaaaagagagtttagaagaagaatgcttaaagagggtgacagaagctatttatcgcgacgtggatgcgcaatttggaggtgtgaagtcatttcctaagacattgcctgggttgcttagtttatttcttttgcgggtaggagcagagtatcaagatagtcgggctatttttttcgtgaatagatctctacaatctgtggcaaatgggggcatctttgatcatttagcgggaggttttttccgttacactatagatgatcgttggttgattccgtgctttgaaaagcgagcttttgacaatgctcttatgatgcttgtttatactgaagccggcgtatatatgagaaatccggagttcgtcattgtagcgaaacgggttcttaattatttaattaaagagctaacggatcctaaatcaggatctttttatctttctgaatacggtcaacagtgggcaggaaccgatattgatagccagtacacgtggtccggggaagagattcgctctctgttaggagagcaagcagagatgttttgcgagtactatgatgtgtctagggaaggaatttgtaacggacggaatatcttacacgtttctccttacatgaatagaaaagagattgaagagcgttatcattgttctttggaagaatttcagaagaaattagaagcttcacgagaaaaattatgtgtctatagggaagggaaaactcaagcttccaaagatgatcagtctttcactttccaaaatggttggggaatcttttctctgataaaaacagggattcttctaggagaaccagaatgttttgtggtggcagagagatgtggagagtttattgcgaacaatctgtataagaatggccgtttattgcgtcgatggagacagggagagtccaaatactctgcaggattagaggattatgctgccatgattatgggagctttagctctatttgaaataggatctggggctaagtggttggtgctagctgaagagctggcgaaggaagtattggtgtctttccgagccgatacagggggattttattccacggatggaagggattcttctttgttgataaagaaagcttgttttgtagatggggacgctatatcgagcaatgctttgctttgccaaggcttgttgaaattgcatatcatttcaggtaaacgacattatctaacgttcgcagaagacattttacaatgcgttcaaggaaagtgggcaaaacataaattttcctctctgggaagtttgcttgcagctcaagagtattttttccaaacaacatcagaagatttttatttctttagggaatgaaggggatagagcacaggtattagattgttttaaagggatttttcttccccatacttccttggtttggttgactgccaaagatcgtgagattctaagtgcatatcttccagagggagagaaacgattgattccttcaaaagaggggcttccaacaaaaatttatctcttggataaggattgtggtagagtttttacttctttagagcatttctatgagtttatgtctcaactcagctaaacgcgtgttttgctcttagttacccctcttttcgatatttaagtgaaaaaattcccaaaaaatacatttttgtttcctttggcttgaggatataacgcttttttgttaaaagtgttctgacggctgggtccctcctcccctatagcttttacctaggacgagggtaggttcttttttagaatataagctgctttgtttgggtgtttgccacatctctagggaggcggtaagatccaaagaaaaaggggaggaggaacaacccaaaattcttaaggtttttctacctaaaaactacaaatcaaggatgcgagtagtgaaacgtgctgttatagcttgctatctagggatcacgattttttctggaatcgcttttggctatgagggagctttctcgtctggttcctttgagcaaaatccttctggagtagccatccataatcgggtgttatttaaggtagacgaagacactgtcgtcacgactttagatgtgattcgcaagttgaatattcttttttactcgacttgcccgcagttggtagattctgtatctgcaagatctcaatattattctgctatgtggcctgtggttctggaaacggtaattaacgagtttctcatggctgcagatgctaaggctaagaagatttttatagaccctacctcagtgaatcaagagatagaagcgatgttcggtcgtgatttgtctcctttcgcgaagttttttgatatgactccggaagacgtttttaacgttgtgcatcggatcttagtagctcagcgcgtagaagggatgatggtacgttcacgtgtgatgttaaaagtaactccggggatggtgcgagagtattatcaaaagcttgctgacgaggctgcccagatcacacaatggacgtatcgggtattgactattaaggctggtttggagtttttagcacacaaaattgcagggaaagttcaagagcgtctaaatgaaggctcttcttgggataaagagcgattgactgcgctggtcctttctcaaggggggcagttgatgtgctcagaagaattcttccgcgaggatgctcagttgtccgttgcgcaccgacaatctttagaagagatcaattttcctgaagagcgatgtggaaaggttctcgaacatgcgtctgggttgaaactttttgtattgtttaatcgtgctacaaaaactttagatccccttgataagatggaagctcagttgaagcaacagcttatgatggagtttgcggcggaagaagaggctaactataaaaataagttacatgctcggtacggatttgatccagctacaataactaaacttcttgcagaagatgctccccagctattttctttattataaaaaaggcggggaagggtggcacggagttctatagaacagttaacttcttttctgagatcagtgaatgggcgagcaaagaaggctttgtctcagaattttttggtagacggcaacatcttaagaaaaattcttacaacagcagaagtgcagccaggtgattgggttcttgaaattggtccaggtttcggagcattatctgaagttctactttctcaaggggccaatgtaattgctctggaaaaagaccctatgtttgaagagtctctgtcccagttgccaatggatattgagattacggatgcttgtaaataccctctgacatccctagaggataaggttggaaagggaaaggacgtatagtagcgaatcttccctaccatatcactacccctttattaaccaagttttttctagaatgcccatatcgctggaaaacggttacggtaatgatccaagatgaggtggctcgacggattaccgccaaacctggagataaggactacggctcgttaacggtctttttaagctttttcgccgatgtgcaatatgcttttaaagttagcccgaattgtttttatcccaagccaagtgtgcactcggctgttgtccatatgcgagttcacgagcagtttgcattggctgattctgaaatagaagagttctttacattgactcgagcggcatttggtcaaagacgcaagctgttagccaattctttgaaaaatctgtatccaaaagataaggtccttcaggttttggagcagttaggtttttcagagaagaccagacccgagaccatttttttagaagagtatttgaaaattttccacttattaaaagatatttagaaggttttcgctattcagcgaaaggaagacttctctttccaaatatcttcttttccatcacaaagtctgctctaggtgtcttggatttcatagcactcttctcnntgtttgtatgaatgaaactttttcttcactttggacgatactagtcagtgaacgacttcacggaagaataacctgtaatttatgtcagaagacgctagggaattttttagatcataggtttatcggaacggcctatctttttgagactttgtatagggatctgtgggattatgattagagatcttgagtattacgatagcccgattttacgtaaagttgcggctcctgtaactgaaatcacggatgagctgcggcaactcgtactcgatatgagtgagacaatggctttttataagggagtagggttagctgctccacaggtaggacaaagtatttctttgttcattatgggagtagaaagagaattagaagatggggaactcgttttctgtgattttcctagggtattcattaatcctgtaattactcaaaaatctgagcagttggtttatggaaatgaagggtgtttatccatcccaggattaagaggagaggtagctagacccgataagattacagtatcagcgaaaaacttagatgggcagcagttttctttagctttagaaggctttttagcaagaattgtaatgcatgaaactgatcatcttccatggcgtcttgtatattgatagaatgtcagacaaggacaaaacaaaacagttcaagaataacttagaaaagttcgtcgaaaatacagcattttacgaggtttatagttcataggaacttgctataagtgctcttcgaagctggtgactttaaagttttgttcgcttcgcttatacttacgccatgctatggcataggaatggcgtgtttaggggtgctagtttttttgtatgctcccccagtaattttttaggaggatagggtggttgctctgttttacatttttttgttcttattccttttgttatgcttaattctgtgtggacttgttcttgttcaagagagtaagagcacgggattagggtcttctttcggtgtcgattccggagattctgtatttggagtatccaccccagaaattttgaaaaaggtaaccgcttggttagctggagctttttgtttaggatgtttaatcttatcatttgccacaagctatttagggaagggagagaatagagagcctcttcctcagcagtatgttgaagatttaattcaagatgttgaagaataagttttctagtagaaagaggcttcgataagaaaaaaaaccaaactggttggacaaactagtttggtnntntttgttatccaaaaggatggcggtgtttctgttttcgtttatctaattttagataaaagaagcagcgcttatcagcttcacgtttttcgtagacagagaatagctgccagtgctcaaagattttatgacccagaatcatctggtattctaaataggatggagagtctggacgatgccatccataacgaagattaagattataattccaatgaggatgtggacgaacaaaaagtttgccagtaatcaaatttcttcgatcggaaagaggagaggctagtaatgtgtctaaagatcggcttacatcgagtgtgtagttatctttagcgcacttaataaagccatacttacttctatgtaaaaattctaaagtaagaccgagattatcattcaaaatccattcccagattacattgagatgatcccatcggctttttttccaaatccattccgcatctaaggataaagtattttggagtgtaagaggaagagagaaccagcaagcagttttagggaaagtgtccttagcgtgaggttcatcaaagatataggtcgtccatagtttcagatgcgaaggagtggaaagagtggaatgtttgtttaagacttttgactccaatcctacatgtagaaggttgatagagtgaaaagcatctttaatcgagaaaatatgaggctcatcagaggataatacaggacgagtggtttttaaaaaggagcaaaaaggctctacaatatgtcttgcatgccgatattctttttgtaaagcaacgcgataatcaaaagatagcgatccagataattgacaatgggctgcatttggggagagcatgcgggtatagtagatagcagttccagatagcgaaggggttaacgttcctataggaagaacaagcccacagtagactttgtgagcggatgagaacctccatgatgagaagttagagcctggaatattactactgaaatgaaaatccaaaaaaccagcttctaagcgattctctaggaaaatgcgagagcgcctgatacgtactggtcggtgatgaagaattgcttgaggcaattcttgtttaacattttgaaaggagttgactttgacagaggaagtcattttcccaaataaattgttatcgcgccatgataggctaacttctgtagggcctgtattttttaaagagaagttatttgggaagatatccgcaactgtttcccagctatcacttaaatggaattcaccagcaagatgggctcgttctttggaaaaagtgaagtctccatgtaatcgatagcgatcttttgctcctgatgaatcaatagctaatcgatgtgcgtaatagcttttaatatttatggcattgcttggattttcctgagaggaaaagcgcatgttatagccgagacctattccatgtttaaaaaaactatccaagaacaaagtcgtagaacaatgctttttagatataggggaataactaacacctaaataggatcccagaaatcctccactcccacctcgaaaagtaatcggaggcttaggaatctccataggcataatggagatttgaggaagcaataacacaggcgtattacagatagaaagacgtgagggtcccatagataatacgctgtctgaagagtattttaaataatctccggataaacaaatatgtttctgaggaccttcagaagtcgagatataccctttatgaatgataatagaagatggtgagatcgttatagtggatcctccaatgaaccatgggtataacgaacagcggccattggtgagtaaacaagaatctgtgtcttcatagtactcaagataatcacagattaaaattttcccgcgataattgaccataacgttgccatgagcaacgattttgatcccacaatccgtgcgattttcaacataggctttattggcttgaagacgtagatcatcatggatatgtaataccccatcctcaacatccataattcctgtaatgcctttaaaatggctcagataagaaatttttttttgaacagcttgttgatgagaaagaccttctgacggcaaagtgtgcgcgagaagcactccaataaaaagtgggaaaaatcgtttcactccagatcactccactattctcattaacaatcctgataagatcgggatatttttgtaatgggtttttttcattagggaaagaaaaacgcggatatcttcatccgttttggaagaaactaaggtttccaaaatagctagcataagttgtgtgcgggtctcaggggatacttggtagcgtaaataagaagagcttggagagggaagcggattttcagcatctgtgaataaaatggtatcctctattaattgttcagcatatcggtatagcacagcttttttctcaggatctttggtcattgtatataaagctagattagcgtangnngaatgatagggtctccaggagttaatgcagctttcgagactaaagaaagtgcctgaggatgagctgttaccgataaaaaagcaatagctttagctgctagtatagttttttgtgaggcgaggatgcgctctaggtaaggaagataggcgtcattgggtaattttagtaacgctgagaggatggtatcttccgctacccgatacatagccaacgttctcattttgtcttcttggctcatgagaggaaaagtggtgcattctttccagaactgtatagcttttcctgtcgagtgagtaggtaaaaatatgcgatggagaactttactttctaagatttctgttagatagtggaggacttgaggatctgtacacccttgatgaacaagtgctaaagcagtattcagtctaatttcttcttgtgttgcgttataaaagattggaagaagaagctcttcacccttctcttgcgagaggaaacgtgcggtatacagggctcgaagaagtttttgttggcaaaggttggttaggatcggtagagcttcttcttctttctctaagaataataatgtctgagctgcagcgagtactacttcaggattggatctagagcttagagctttaattctaggatagctaccagagtcttccagtttgcctaacgcatacaaagcgccttcttgatctaaaggagaggcacttgtaagtaaagagcgtagtgttggaagaaatcttttttgtttgtactctccaattaaataggcaacatagtttcttgtcaggttattgggagaagagagcaaacgatgaatataagcatcagcttcttctgtttcgagttgtaagaaaatagttgccgctaggttttgaatttcttctggtaacttgtagataaaagaataaaggtaatcacttaccttgctatttttcatacaggcaagacgataagcagcttctaagcggatgacaggatgagaagctgttaatcccttgaataaaagtttgtcagaagttttgcttaattggctggttgcagcatttaaaatgagtagttgctcatagagatcttgcgtttctatagcctcagacagtaactctaaagcttctgatgaaccagatagccctgctccaataattgcacttttacgtatgtgggtgtcctcagagagaaagctttgttgtaaatacgattctgctattacgcgtaatacggagaaatcgtgttgttgataagttactgaagcttcgagataggcttctagagcttgagggactgatttttggcaagaaaacaagattctctgagaaactgaggaaggaaaatcacagctggctgagagtgtaaaagagaggaaaccaatgaaggctagacgagatagtcccataagctgatgttaaactccatgagcaactggttcagcgtctttataggcaatccttgtatattatatacacaaccttctatttgtttgatgattaacccaccaccatcttgtacgcagtatcctccgcatcgcttcagagaggaaaaagatcggacataggttttaagatgctgcggggggatgtcaatgaaagagacttgagtattttctgatgccgacagcactttttcattttgcataagaacaagcgtagtgatgacggagtgagaagagccgctaagagtacgcaacatctccacagcatgttcttcagattcaggtttattgaaaacctctcctttataaacaacaacggtatcggcagtgataattaaagcatctgaaaacccttgagagcgcacaacgttagctttgttccaagctagttcctttgtatacttgaaaggatctccagaataaacaatactgcgttcgtcaaaatctggagatacacaaataaagggaatacgaaagctctctaaaacagcttttcttctttctgacgaagatcctaaaactaaccgagcttccacgtgactccaattatttcctgcttacaatgagcgatttattttttctggctagctaaatactcggacatcgggccatcgaaaaaggaaatagttcccttgtcaaagatcagcagtttagtcgcgcactcatctattagtgttctgtcatgggaaacaaaaatagctgtccctgggtagtcattaatggcccaagctaaagcggaaacagactcaagatctaagtggttgttcgcttcatcaagaatgagcatattgtgattctctagcatcattccggccattagtaaccgagccgtttctcctccggacaaagctttaacttgtttgaaggcgtcatctcctccaaagagcattttcccaagaacgcttcgaacctcttgatctgtaatccctgttttacgtctgcgtaaccattcgaatagtgtttcttcgccacaatccttcaggatatcagcgtggttttgagggaaatatgaaaaggctacattatgccccaacttgacttgaccttgggaaggttgttctactcctgccaacaacttcattaaagttgttttccccaacccattgtttccaatcacgccaattttatccccttgataaatctctaaagagaaggggttgaacaacaaaggatctgcatcatatgttttgctaataccttctatagaaaagactacttttccagatgttttatctgacacagggaaacggatataaggtctttgaatattagatttttttagctcttgaggttgcagcttcttaatttctctcagacgggattgcacttgacttgcccgcgatccggcaccaaatttggctacaaactctcgcaactgcgcaatttttttctcttttgatttgatgtcagctttctcttgctctctagaggctgttttcatttcaaccatggcatcatagttgcctggatagataatgatagtatcgtaatcgatatcagcgatatgtgttgtgatggtatttaagaaatggcggtcgtggctaactacaataaccgtgccgttatagtctttaagaaaactacctaaccaattgatagaatgtaagtctaagtggttagtcggttcatctaaaagcaaagcttcaggatggccaaacagagcctggcataggaggacgcggaattgtaagtctaaaggaatagtagccattttctgagagaaaaattcttctggaatgccaatacctagaagcaactcttcagcttcagactctgcacgataaccatcttcttcgccgatgatctcttcaatttcaccgagttccattcctatagcatcggtaaattcttccgcgtataaggcatctcgacgttgcatagcctcccataagcgagagtttcccatgatcacacaatctaaaacgatcacgtcaccgaagctatcgatattttgacgcaaaataccaatcttcttgggcaaggaaatagttcctcgagaaggttctaccaagcctgtaataatttttaatagagtggatttcccagctccattagggcctgttaagccgtaacgattccctgggttgaatacgacagacacatcgtcgaataagactcgtgtccctaatgttttaccgattttatcaagaacaatactcatggacaaaaggataacaaagaccttcttagagtacaagaagtttgccggtgtagttactcctctaagttgtgagggtgagtttcatcgtggatctgtttttttaatttcatggaaacatgagtataaatggttgtcgtctcaagagaagtatggcctaacaggagttgaatggtttttaaatccatcccgcgctctaaccagtgagtggcaatagtatgacggattgtgtgaggagtaatagatccggataatcctgttttaaggagatattgttggaattttctatctatagagcgagtagatagacgttttccaaatcgatttaaaaaacaagcttgatgatcctgttctacagaggctctatctgggtggtttaaatagtcttgtaaccactggacggctacctttgtcataggaacgattcgttcttttttccctttccctcggatatgtaaaaggtgtgattggaaatcgatatcagcacgattcagagcggtaatctcgctgattcttagacctgaactatagaagagttcgagtaaacagcgatctcggaatcctgtaactttatctaattctggagcagccattagggcaaggacttgttcgtaggtgagtggggaaggaagttcttggggaaggcgaggccctcgaatcatttccgctggattctctggtattaactggttttttacgcaaaatctagcaaaacttttaatagcagatagtcgacggcgtacggtgcgctttgaatgatgcgtttggatttgttctagaagataaagacggatgttgtctttggtaaacagagagaaagagagaggaggatagtcgtaggtattgtcgtggagagagagggggggagttggagatagatcgctttttttttctaaaaaacattttagagagctgagatccatacagtaatttcttaatgtatgaagggaggaggctttcatgttttttaggtaatctaaaaatgcataaaaggatgtaatcattcccaaacctgctgtacttatgagctaagaagctttcgggttgtttccaacagtatatgcgctaactagggtttttagggaactcgtagctacagaattcctctgcagcaaatacattgggaaaaatttctccagcctcttggacaaattcttctgtcgtattgtagcgtgcagaaaaatgtgtgagaattagttgttgcacttctgcgcgctttgcttgttccgcagcttgtttggcagtcatgtgataatgacttttagcgagatgggaatgttcttccaaataggtactttcgcataataagatacgagcatttcttgctaagtcgacaatagcttggcaaggaagggaatccgcaacaacagcaatgctgtctcctttacgcgtatagctgacatcgtccaaatggacgatagtgtcattaacctttacccggcccttattgatgagctcttgcatgatagggcctttcaagcctgctgctttaattttttcagggataaattttgttgtatcaggctctgtaatgcgccaccctagggtgtcaacaagatggtctagttggcgagattctattcgaaaattaccaaaatcttctacgataccttcacgatcgataggatgctctataactttaattgtttcgtgatagatagtgctatagcgaagtctatcgaaatattttttccctgaagcagggtaatagcagtgtataggatgtgaaactctatctagattaaggcgcatgagcatggaacctaaacctaagcaatggtctccatgaaaatgactaatgaaaatacgagaaactaccgtgggggcaatattagcgtaaatgaattgacgttgagttccttctcctgggtcaaataaaagcccttccccattccaacggagtagatatgctccgtgattacggtgacgagtcggttgttgacttgaacagcctagaatagttaatccacgataactcattcaatatcctctttaaggaagagatctctcaaggtaaaatcatttatgccctaacaagcgacttcctcttgcttgcaaggtaagaggttttggaatgtagggatgtgcaaagatataaataagacgagaatgaaaataatttcttatgtctctccacagtttcagagaaaaattataacttccactaagcctaaacacaagaaaaagctcgttatgagtgaaaagaagctcgtcggtgataacaggtaggagtttctagttaaaaagttttataaataagagaggataagaagctttcacaagaaggagagcttgtacgaaagatctccttttatcagatagctaatgagctgcttttccaaggccaatcgatttgaaggagcgcattaatgttggtaatggggagctagttgtaatcgagaccttgggttctcttagagcaattattttttcaatatccgggagcaatggaaacaaaacaagtaggcaggaacctacggctaaagagattaaacaaatgcctgcgcctaatagggggaagctaagggaaaggaatactccagagataattcctacaacagatagggataacagaacaagataagctatattgatgatgcgttcagtttgttgataaataggttttttaagtggagatgggggagctttagggaagaagaaagactgaataatagacggaagttgcataatagcctcctggattgtctcgaaggcggattatactaaactttgatttgttgagaataagagagaaggttctctgagccttacagctcagagaacacgatttaaaccccagggaaagcaatcttgaatacatcgtcataatgggtgacgaagtgtaccttgagacctttcttaaggtatgcggggagctcgtcgtaatctcgacggttatcttcagggaagattaaaatattcaatttcgatcttcttgctgcgataagtttttcccggatacctccaattcctaaaactctgcctgttaaggtgagctctccagtcatgccgaggttattaagcacaggaacatccaaaagtaaagaaagcaaggacgttaccatagtaattcctgcagagggaccgtcttttggagtggctccctctgggatatggatatggacttgcgatttttcaaagaatggttgtcctggagcataacgttctagagcactatgaagataggtccaagctatttgtgaagactctttcatcacatccccagcttgacctgttagatgcatatccgctttacctgatgaagaagggacttgaacactttctatgtacaaggttgctcctcctaaggaagtccatgctaggcctgtggcaactcctaccggagtcttttcatagaaacgatcgctagaaaagactggtttgccaagataatcttgtagattttttggcgtgattgtaaaccgcgacttcttggaaggatttttctcttggttttgaacaattttaagagctacttttcgtaagactttcttaatgttttcattcagtgtacgaactccagcttctctagcatagttgttgatcatgtgcttgatagcttctggttggaaagtcacattctgtgcagaaagtcccatctctttccttgcgcgaggtacgaggtatttagtggctatctgtaatttttcttccagaatgtaaccagataaacgcaacacttccattcggtccagtagagggtctgggatggaatctaatacgtttgcggttagaatgaagagcacgttagataaatctacgcggacatccaaataatgatctaaaaagtctttgttttgttcgggatctaacacctcaagaagggccgaagctggatctccgtgataactagagccaattttatcgacttcatcaatcatgatcacaggattcataatctgactttgtttcaaagcttgcacaagtttccctggcatagctccgatataggtccgtctatgtcctttgatttctgcttcatcacgcattcctcctacagagaaccggaagaatttacggtgtaacacttttgcaatacttcggccgatacttgttttccctactcctggaggccccactaggcaaataatacttcccttcataccgtttgctagtttgcctacactaatcaattcaagaatgcgttgttttatatcttctaaaccgtaatggtctttatttaagatagattctgctttcttcaaatcgtggtattccttggtttggatgccccaaggtacaatagttaaccaatcgagatagttgcggcagactgcatattcagctgaagaagtctccaaggtttgtaatttatccatttcatcttggataacgtccatggcgtattgaggaacgtctcgtttattgaagcgttccataaacttctcaagatcaacagcgtgatcgtctttctctagccctaactctttctttattgttttaagttgttcttttaggaaaaattctttctgactttttgtgatggtcgcttcaattttttgattgatactactttgcagacggcttagatctaactcttttttgagtaagaccaatgctttgtctatgcgatcatgcatgtctgtggtttctaaaatttcctgaagttcctctcgtgttgctgtagttaaagcaacggagaaatctgcgagtttccctggctcagtgaaatcagagtggccaaggaaaatttgtagctcttctttgaacagagggtttagttttagaagatctttgataatcgatacgatgctaattgagtaagcttttagctcttcagtcagctctttgttctctttgtgataggagactttggcttttagatacttatcttgaattggcttaacgatgcgaatacggtcttctatactcaataacacttgagcctaccgccttcaataggcattatgcgtaaaatgcgcgcggatacgcccactcgatgaagctgattaaaaccaacttttagagtgttggcatcttctttttttgttaagacaagaccgatgtgtttctgggatgattttgctaatagtgtaagtacttcataatgggggcctgcctctataaggagaggggctgccatgccagggaaaaaaggacgcttattcaaagggagaataaaaagttctgaagggggcgtatgatcatctactttctcttctgcctctgcggattcgtcgagaagtttttcgacctctgaagcatttggatctagattttgagagtctgtattattcgtcgagttcacaattgtccttgggcaactagttcaaaatccttggaagagcaagggttgtgtgcacatgtttaatattacttcttcttaccgatatactacaaaatcgcaacaattagtgcatctaacacgagaaagtatagcagggtttttatcaattgcagcaaagagaagttgaatagaaaaactgttatttatcgaattataaatgagtttttttagtaaagtcggttttgatttggcgacaggaattaatttttgaattaaaacggttttaacggttataatcctttgtctaaatcaatctaggagtttaggctgtgtacaaatattttattgtagacacttccggttctcagccgtttttggcctatgtcgattgtcgagatgttttagaagtatggtctttgcctacagggccagatcaaggagttgtgttaaatttcattttcaacagcctggatttgcctttccaaggtattggagtctctgttggtcccgggggattttctgcaactagagtgggagttgcttttgctcaagggctctctctggctaaaaatgtccctttagttggctatagctctttagaaggatatctttctttgggtcaagaagaggaggctttgcttttgcctctagggaaaaagggtggggttgtagctttaaactcagagctttctcttgatggttttctgcttacagatactacttctactccgggaattttattgtcttattctgaagctctagagtattgtttagataagggatgttgtcatgtgatctctccggatccaacgtatttcgtagaactattttcttcgcgtatttcggtaaggaaggtggttccttgtatcgatcgaatccgtaagtacgttgtttcgcagtttgttctgtctcaaaatcttccgttgtgtttagattaccggagcatctcttcctttttttagagtgttttccttttgggacaacaacttttcaagagttttgtttacttatttggcaatttttataattcaaagaaggttatacaacctaagtatctcttgaagcctaaataaaagtggtgttacaatccccggtctcttgtgcgttcgagctaggcgcgcgttattaaataaaaaccaattacgtattaaggttattcatgcccagtgttaaagtcagagttggagagcctatagatcgagctctaagaattttaaagaaaaaaatcgacaaagaaggaattttgaaaacttctaagtctcatagattctacgacaaaccttctgtaaaaaaacgagcaaaatccaaggcggcacaaaatatcgtggtcgttagaaaaaatctttgttagtggtgtttcgtcatggattactacacgatattgggtgtagcgaagactgctactcctgaagaaataaagaaagcttaccgtaagctcgctgtaaagtaccatccagataagaatcctggggatgctgaagcggaggacgctttaaagaagtttctgaagcctatgaagtattaggtgatgcgcagaagcgagagtcatatgatcgttacggcaaagacggtccatttgctggtgctggaggattcggcggtgctggcatggggaatatggaagacgctttgcgaacatttatgggagcttttggcggcgatttcggtggtaatggaggcggtttctttgaagggctttttggaggacttggagaagctttcggaatgcgtggaggctcagaaagttctcgacaaggagctagtaagaaggtgcatattacgctgtccttcgaggaggcggcaaaaggtgttgaaaaagaacttcttgtttcaggctataaatcttgtgatgcttgttctggtagtggagccaatactgctaaaggtgtaaaagtttgtgatcgatgcaagggctctggtcaggtagtgcaaagtcgaggctttttctccatggcttctacttgccctgattgtagtggtgaaggtcgggttatcacagatccttgttcagtttgtcgtgggcagggacgtatcaaggataaacgtagcgtccatgttaatatcccagctggagtcgattctgggatgagattaaagatggaaggctatggagatgctggccaaaatggagcgcctgcaggggatctgtatgtttttattgatgtagagcctcatcctgttttcgagcgccatggggatgatttagttttagagcttcctattggatttgttgatgcggctttagggatcaagaaggaaatccccacactcttaaaggaaggtacttgccgtttgagtatcccagaagggattcagagcggaacagttcttaaagttagagggcagggattccccaatgtgcatgggaaatccagaggagatcttttagtaagagtatctgtggagactccccagcacctatctaatgaacaaaaagatttattgagacagtttgctgctacggagaaggctgaaaatttccctaagaaacggagtttcttagacaaaatcaaaggttttttttctgactttgctgtatagaaagaaggatctttttagctgagagggagctgctgtgagacactccgtataccaattagactctgctgttgagaatgtattcaggttggcatggactttgagattctcagagcggaagatgttgttgttatctcgccagagtggttccggtggctcttttcaattatcttgcgctggtcatgagcttgcaggtgttgtggctgcaaaaagcttgattccgggaaaggactgggcatttccttattaccgggatcaaggattccctttaggattgggatgcgatctttctgaaatcttcgcttcttttttggctcggactacacagaatcattctgctggtagaatgatgccttaccattattcccataaaaagcttcgtatatgctgtcagtctagtgttgttggtacacagtttttgcaggctgcggggcgtgcctggggtgttaagaattctgggaagagtgaagttgtatatgtatcgggcggtgatggatctacttctcaaggagagttccacgagatgctgaattttgcatctctgcatcaactccctctagtgatagccatacaaaataatcagtgggccatttccgttccttttgctgaccaatgtggcgcagatctggtagctttaggtaatagttattcaggcctggctacttatgaggttgacggtggagatgtatctgtgttgacacagacttttgagcgggctgtttctgatgcaagacaccgacatattccggctcttgttattgtcaatgtcgttcggttagagtctcatagtaattcagataatcaggccaagtatcgttcagaagaagatttatcgtgttgccaagcgcaagatcctctggtgcgtttagaaaagtctctgcttgatgattttggggttgcgcatgaggtgattgagcaaataaaggctgagcttcaagaaactgttaatcaggcttgtgagcttgctgagtctgctcctttcccttgcaaaggagcaaccaaacacgaagtatttgctccctacaatatttccttaatagattatgaaaatgcattagaaactgcctccttacagaaattagagcctagagttatgcgtgacgctatcacagaggctttagttgaagagatgcagagagatcctggagtagttgtttttggtgaggatgtcgcaggaaataagggaggcgttttcggcgttacaaggactctgacagagcaattcggagaaaaccgatgttttaatacgcctttagcagaggccactattatcggagctgctgtaggaatggcttttgatggtttctataagccggttgcagagattcaatttgcagactatatttggccaggtatcaaccagctgttttctgaagcagcgagtatctactatcgctctgccggagaatgggaaatgcccattgtaataagaactccttgcggagggtatattcaaggcggaccatatcattcccagaatatagaagcttttcttgctcattgtcctggattaaaggtggtctatccttccaatgctgcggatgctaaagctttattaaaagctgctattcgagatcctaatccggtggtatttttagagcataaagctttgtatcaacggcgtttatttagtacgacgcctgtattttcttctgattatgttcttcctttcggacaagcacgtattgtgcatccaggtacagacttaactattgtttcttggggaatgtctctagtaatgagcgtagaggtggccagagatctattagaattagggatttctgttgaagttattgatttgcgaacgattgttccttgtgattttgctactgtatgtgagtcagttaaaaaaacagggaagttattagttgttcatgaagcttcagagttttgtgggtttggtagtgaactggttgctttggtagcagagagagcttacagatatcttgacgctcctatcaagcggataggagcgttgcatgctcctgttccttactctaaggtattggaaaatgaggtgctacctcaaaaagaaaaaatcttccaagaggcaaaactactggcagagttttagactatacaagtgacatttccaacaaaaagcgctcctagtgataaacaggagcgcttttttttagaacagatttagagaataatcgagtgatctacagctgtatttacagccttcccgacagaggatagagcccctatgtaaacaagaataatagagacaagtgttatccactctaaagtcgggggagctgatgtaagcgagataaggacgtttggagcatgtagccaaggaagatcaaggatccaggagatgtaggattcagagaggtgtgataggagaggattaaggaatgataagggaatcataaggaagatgggcataacgagtgtagggtagaacaggttatagataagtccatctaaagggagaattttgaacattcgaatcattgggaaaacgataaaaagctgggcagcaagagagattgatagggttgtgaatacaaaccgaagagggaagagaaaccaacgagtgccgaataatgattcccagggagagtaaaagaaacgtaatagcggtacaaagaaaataaaatgcctaaagtcgctaaaaaactgagtattagcgctggggatgatatagggaaaaagagcgagcaaaaaataaaactaatacctagtcgattcaggctagagcagtgtcctatagaaaaaggagccaggcagaatagaatactagagaaccaggtcctaaatacagagggagaggttgggaatacgaaattgagaagagagagtagaaagaggacccagagacctcgttttttgggggaaagcgttcctaataaaaagaagaaggtattggcaaatagtgagaaatgccatcctgatacagaaaaaagatgggacaatcctttgcttttgaatagctctttatgtttgtaagagaggggagtgccaaggattaaactggatgagaatcgaccaatatctttgtctgaaaataggttgaggatcctctgatgaagaaagaatcggaaattttctttgagaataggaagagaatagttcgaagaatttctcagaaaaatagaggattgcgtgggtgtatttataagttttgatgagcgaaaagtaatagggcatgaagatttagatacgcagccttctaagtgatacacggtatgctcactaagtggaatagtagaaatgatggagcaagggaggttttgataggattgtttatcttccgtttctaaggaaagagctgttccagaatagcggtgagtgagtttttttttaattaagaaatatccggatgcagatccttttgtcacttgtattttagagttagcaacagagcgtgatgcgtttgatggagatattaaaggagagaatagtagagggactccaaaacaaatactcaaggaaaagagcgttttcaaacagcgtttgggaataaaaggatgtagcgctacaatcaagagtgcgcagcagataggagcttgatgagcaagcatgcctgctaaccagtaggcgctcccaatgaaaataggatgttgtttttggaagacagagcaggaactaaatagccttatccgtaagcagataggcgatgtaatgaggttaggaatgcagtggtataaagatagcgtaacatcagcttgttctaaacaaccggtagaagtgctttctctcgagcagatgcgcagaacgctttcttgggaagaagtgtttgctaaagttccacggttgcccagaggatggtttgagttggtaggtctgtctcaagcagatcgtatcgagctatttcgagatttttggttttctgcattgggtgttgagaatactgatttccctggtatttgtcatttttttcctctttgagccatttggacgttcggataacgcgaaatagtttatccgctccttatgatgtgcaaatggtgtatagttataaaggaatagtatatttaggcgcgcctccttttgaaactgtaggagttgtttttcctaagttaggagatgagacgtatcgtcattttttttctatccataatggattttctcgagaaggggagattggtatttttccttatcgttatttggctcaagcgcaatatcttcttagagaagacttattaagtagagggaaaatttctttggaagataattgtagttctttgggtatatttccattttatgctcagtacgatatagcggacagtcgttgttttatcatcgatgctaagattcgtcagtattttccttcgtataacgtgcgtttagataatcaaagcttatttcctcatgggaaaattgccatttcagaaatgctttctgatagtcattatcatacgtttttactctggctggaacagtatcttttatctcaaaaaccttagaaggctagttttagaaaaaaaagtacgcttttcttctctttagctttgaaaagaagctctaagggtttattatcgtatttttttgattggatttagcttatcatcattttgtttttacacgtacagggaagaatactatgagtggggggaatgattcagttcttcataggcctgtagaagctcctcttatggaagatggggaactctcagcagtttttacgatacggaatccttctgggatacacgtgcgtccggctggtactattgttaaactcttcgaaggcgaagaatgcgaagcgactctgacctatttagggaaaaccgtgaacgctaggagcgtcatgagtattcttatgttaggagcttcttataatggcgaggttgctgttcatataaaaggcccctctgcttctcgagtaatgcagaaactctccgaggtttttaattctggattcggagagttgtaatgagcgttacgggtcaagataataaggagttgcaacaggagtttgttattgtaggggagcctatagtccctggaatagggctagggaaagctttattgttgggcaaatcttctttgcggatacgagagctaactcttcctcaagaagaagtggaacatgagatcagtcgctactacaaggctttgaagagatctcgttcagatctagctgctttagaaaaagaagcaaagggaaagcagggatatcaagagatagcttccattttgcaggcacatctagaaattataaaagaccctcttctcacggaagaggtggttaaaacaattagaaaagatcgaaagaatgcggagtttgttttttcttctgtcatgggagagatagagaaatctctatgtgctgtacagaagacgactgctaccacagtagatcgagttcaggatatccatgatatttctaatcgagtgattggccatctttgttgtcagcataagagttctttaggggagtttgatcagaatcttattgtcttttcggaagagcttactccctcggaagccgcaaatgctaatcccgagtacatcaggggctttgtatctttagagggcgcaaaaacttcgcataccgcgattgtatctttggctaaaaatattccttatgttgccaattttactacagagttatgggatactattaacgagtttagtgggacattagttctcattaatggggataagggagagattacgtttaatcctcagctaagtacgatacaaacttattatcgtaagcaagcgtctgtttctgtcactgttccagtgcaggtgcagacagggaaaaatctgcctcttatctctctctcagcacagatagtaagtacagaagaattgcccatgattgaaagggagtctccaggaacaagtgttgggctcttccgttcagaatttatggctttttctttgggacgcttaccctgtgttgaagaacaagctgatcaatatgctcaattagttcagtttcagtgttcagatattcatgtattgcgtttgtttgattttggagaggataaagagtgtccttgtatttcctcttctcatcggtcagtacggtggttattagaacaagaaaaagtattgaaggagcagttgcaggctattgctattgtttctagaataggacgacttaaggtattgattcctggggtgatagatgcttcagaaattgctttagtaaagcggctttttcaagaagaaattcggctattgaaagggatcagtgaaaatatcttatggggaagcatgatagagatcccttctgcagtttggatgatagaggaaattttacaagagagttcttttgtagctttaggtactaatgatcttgctcagtatactttaggcacttctagagagcgttccttacttggagagcggagtagagtgccgcatccttctgttattagaatgattcatcatgttgtagagcaggctaaacagaagaatgttcccgtatctgtatgtggagagatggcaggagatcctgctcttctgcctatgtttttaggactaggggtaaaggagttatcagctgtcatcccagcaataaattctttgaaaatgcgattattagatttgaactcaagggagtgctctcgtttaacgaagcagttattgcgggcgaaaacatacgaagaggttcatcaactcctgtatgtgtaacggaaaaaattagaacggcattcccatttgcatagcggacatttcactatccaaagctgctttagctgctttaaatctgcgcggaataagtctgccactacttcaggatcttcaggatctagacaatctggtttaattcgaacatcaaccaggtcacattttccgttgatagttacagataccaagccatttccagcctctccagaaaaacgtttctgttcaagagaggcctccatttccatgaattggcgttccattaatttggcttcttttttctttttagcgtaaccgctacccatgttttggctccttagttaaaactccagaaaattctacaacagcaaattgtaacagcgtgtcgatggctgcggattcagaaggggaaatcttatcgagagaagggggtggtgtttcctgatggatagtttctttcttagtttgtgatgaggcagcggttaacaggcttccttgggagagttttgctacagctgttggttgtggtgatgattttgtttcctcagtattgcttgatttgatttgtggtgggcaagattctagttctgaggcagtagggatagggcgtatttgagttggtgcaggttgtcgtatctgtgagacaagctgagagaatgtagggcgagagtaaattcgtagaagacgaataatcaccgtttctagaaaagttttttcaaataacgcgagattaatatgccgtgcagattctcctagaaaatcgagtatttctaatagaatttcggaggagtatttagtcgctacagaatggaattgtttagaatattgctttaagaggaaactacggaaaagcaaagttacatcttgaagaaaatgggctggagcaacccccatttgcatagcatcggaaacaggcgttacgcttgttcgtaattttgggtagtaatggcttctgcaagttgatataggctatcctcggaaagaataccgagagctttagctgtgctgtctggatctaaagattcaggaaagagacctactacgtaatcataaagcgactcggcatcgcgaagacttccttgagcagctttagcaatggggagaagagcttctcgtgaagtttctgtaccttcttgttttgcgatagttgctagcttatcgatgatggtctcttcagaaatgcgttttaagagcattttctgacagcgactggatattgtattaggaatttttgcaatttccgttgtggcaaggaaaaatttcacatgcgcaggaggctcttccaacgtctttagtagagaattgaaagcctctttagttagcatatgtacttcatcaataatatagatcttgtagcgagattttgaagggacaaagaggactgtttcgttaatttgccggatatcttcgattcctcgatgagaagcaccatcgatttcgataacatccatagacgttccaagagagatctctttgcaaatagcgcattgattacaaggctcttgatcttgtgtaggattttgacaatttaatgctttagcaaatacacgggctaacgttgttttgcctgtcccacgaataccagaaaatatgtaggcgtgtctgcgcgattcagacgcagggaattcttgagtatagacacgactatatcctggccaagaatctcggaaaaattgttcgggcggtaccttcttgaagaaacttgataagaggtcataactaaagaatcatgctatactattcttgatgaagaaaactatgaatgggtttcactaatctctttgctgattagtttacgcattttcccctgtattaatctactctaacttcgtaaaagagagagtatattttttatagctgtctcataatttaacggcatctagctaatccaaggaataggcaagcgtatctcaaattttatttaaagtgaggctttaagtgaaagatagattgggattaggtcctgcaaagagaatgtgattatctgttttacgtcccatttgtatccaaaaatcagcttgctgagagaaggcggggtggttttctatgatcactactgtatgtcctaaagacaccaaggtgttgagttggacgagcagagcggattgttgttgattgtcaagagaggtagctatctcatctagtaagaataaagtaggatgtttaggaggaaggaatagatgtttagttaattttatggcaattttttcacttagagacagagaggccatattttgtcccaatgataagtagccaagaccatttgtaattaaggtgtgtaaaggtttctggattttttttaagaaagaaaaagtttcagctacttcatttaaagaggcttgtaataactggccgaaatgtttcccttcatacacaacttcttgtatgagtggttgtacacggaatcctccacatgttggacaaggacgtttttccatagcataaaaggctcgatctatccattgatatcctagtccccaacaatccgaacattgcccttgtttggtatttggactaaacatagaaactgagatgtttaaagcttttgcttgagtcagagaagcgtagaaatttcttaatgaaggagcgatatcaaaataagtgctgatatcggatcgagaagatgcaatttggggataggaatctagaaaaataatttctgagaatacagaaggatccttttcaagaatagcgcagcatgttcgtaaatgctatttagtaaggttgttttgccagatcctgatacaccagaaatagtcgagagtcgttgtaaagggaaagcaaggttctcaatttggatcatagaagtggatactgagacagaaagttgtggtgtttcttcggaagagcgtgtgttgcaaagtaccggttgagattgtttaagagcgctggttgataagagatagcctccgttaggaccaggttcaggacccaggtgaagcaggtaatcagcatgttccgcaagagagccttctctatccgtcactattactgtattatggttggtcacgagttttttaataacagcaagcaaacaaggagcatcttccgggtgaatccctgctaagggatcttctaaaagatagataacatcagtgagacctgatgaaaaagcttttgccaatagaagcctataatgctctccgtcactcaaagactgttgttcttgtccgaggataacatagcctaacccaactcgatctagaaggccaatctactaaggatatcttgaacaagagagggttcctcttctacagaaagtaagagctttttaagaaaagcgacattggattggtaaatttctgatagggaaatgctgtgaatacggatgcaatgcttgtaggtgtatacgccaagaccctgacattggttacacggagttttggagataaggtcgggagggaaatcttcttcggattccattaacattgcttttgtgcaaagagcattcaatcccagatgttgttgtgttcctaggcaaagagattcaaaagaaagaacatctatttcttggaatagagcaatggaagggatccctagttcattcagaagaggatagatcggtgaaggatcctggttaggaaataggcttgtgaataaggaaattggggtatgctgtgcgaaacgtttcttatgaggaagaatagaacaagtggataggaagccttttccatgacagagagggcataagtagctctcatggttcaagatagagggtgtttctatattagggaataggttcccagaagcatcttgtaatccttggcggtatgttttagataagcttgttccagcatattcgatatgcagacagacagaagaagctttactaaaggctaaagtaagagaagccaaaagagaaggcagatttttttctaaaattttgacatggtggatgactagagctgggttctctaaagaagtagggaaaggcccatctaaatcatagaactgttcattagcataaagttttaaaaacccttcctgaagcatctcttgcgtataagagaaaaactcttcctctttagggaaaggaacagtaatcgttacatagcctttcgtgtaatgcgtgagcaattcttcagcaatcgtttcaggagaaatagttcttagtgcatcaccagaaatcggagaataaggatggccgattcgtgtgaaaaggctttctagcatttctgagatttctaatgcagaagccacagaatgattggaatttctcgaggcgctcgttttttctatcgcgataacaggggatagtcctgttactttatcaacagcaggaagaggagttttttttatgagagcttgtcggatatagggagggaatagctctgcgtaagcgatgtttcctgctgcatgcagaatatcaaatacaagggaatgtttcccggaagcggatggacctgtcacagcagtaagcgcatatcgaggtatggagagatcgatatgttttaaattatactggtgagcgtttgcaatagtaatggcggcgggtacaggaggtttgggactcggatcaggtagataagggagttcttgaggagaagataggaaaggacggagagctatagctgttggagtatgtttatggattagctcttctggagagcaagaagctatgagataaccgcctttatttcctccttcaggaccaagttccagtatatagtctgcaactttcaccacatgcatgttatgctcgatgatgatcaccgagtgcccttgatgaataagggattgcacaacataaataagttgtttgacatcgtgggtgtggaggcctgttgtgggttcatcaagaacatagagagtagggtgtttaactggagccaataactcatatgcaagcttgagtctctggatttctcctccagataagctatagagaggtcttcctagaggaaggtattgtagtcccagagtgcataaggtttcgattttttgatgaatactaggctcatctaaaaagaagtttttagcttcataggccgtcatttcaagaatgtcggcaatcgttttatttttatagcggacttctaatacttgagggaggaatcgtttccctaaacaggaaggacaggttatggaatcgcggttatcagtcgttgttatagatcctaggcctccacattctgcacaggctcctagaggcgtgttgaagctaaagtggcttttagtgagtcctaaggttttacagcgaggttgttctgcgaataactgacgaacctcgtcaaaagctttgatataggtcaaagggatagatcgttgtgagcgtcctggaagatctctattaatatggacaaggcgagagagggctccttgaatagatagagtggaacagaatccctgttcaataaactcttccacacaagggactagtgtatcgttgataagagaagatttcccagaaccagagactccggtgacgacagtcatttgtcctaatggaattgaaactgtcaggtccttaagattatgcttattggctttagataaggtaattgtccctaaggagtttgtacgtttagcagggaccgaaatatgttgctcttgacggagatattgtgcggtcaaagagtcactctttgccagaaattctctaggagatccattgaagacaacttcgccaccaaaaataccagctcctgggccgatatcaatgacccggtctgcgagagaaatcatctgctcatcatgttcaacgagtaagacagtgtttccctgatcacggagtcttcgaataacattcataagcttatgggtatcctgaggatgtagcccaatagaaggctcatccaggatatacatgactccgatgagttcggcacctagatgcttagctaaggccgtacgttcccgttctcccccggaaagagtatcaatagctctttctggagaaaggtagggaagaccaagatctatcagaatagcaagtcgcgatttgaatccttggattacttcctcaatagcgagctctttcttaggaagttgattcaggaaaataaataactcttgaagagacatttgttgaaagtctgcaaagcttttcccatgccatcgggtagcattagcatagtcgctgagtccagtcttgttacatctggggcatactgtataggaagtccctttaggaaggtagcgagcaggcttatttgaaaatcgaattttttctccaatttcattgagcacacctttccattgcttatgtgtctgggttttcttacctaaagttccatcaaacagctttactgggatagagagaccttctttcccatataaaaaaatatgttggatttcaggagaaagattttgccacggagtgctgagactaaatcctaggctatcagctagagattgatagatggttctatataagaaggtggagcaattccctgcaaaaggacagcagttgtcttcgatggagagcgtttgctggatgatacagggatcatcgatggatataaagattcctgaaccttggcattgtggacaacgatctttgtgactgtgcgacgaaaaaagatctggggatagcggcgcataggtttgttgtgtttctggaagagtcgcctgtgtggaaaagactcgtttctgattatcgaagtgtaaggagcattcaccatgaccgatgtctaaggttgtaaataagctgacttttaaccgcggagtgttagaggtatttttgatcaacgtatcgacaatgagttgaccgggaacaggaatgcctgttgtaagaaacttatgaataggaacaacctcttcatcaatgaggactttggtaaacccttgacggagacattctcgaacggtaagaacatcctggcgggaagaggagcgagcaaagtcagttgagttccatctggaatggcagctatttcagaaaggattttttccttactgtatagagttagagggtgtagtgtaaccggatcataggcttggccctctaaggagaaaagtagggctaaatacgagttaatttcggttgtactaccgactgtcgcatgtacgtgttgttcgaaaaagttttgcttaacggctacggttggagacaatccttctatcttttttacggagggatctggtaaggagtctagctttgttgcaaagaaagaggggagggtagcaaggtagcgttttcttcctgcggcataaatagtattgaaagcaagagaagactttccggatccagaaaccccggtgaacaaaacgatctctcgaggacaaaactctactgtaatgttttttaaattccttacagtaataccagaaagtctaacgatagaagacatacctgctatatggtttcaatgattatggaactatctcgtcaagagagggggatagcgcatcatgcacagttgtcaaggtgagattgttggtatcttgcatcccagctccgcggctgaagacaagaattttatcatagttagaaagaattcctttttctactccatatacacaagcttggtgacgccagactgtacggttcgattccagggttagcataggatatactccccattctacagctaaacgatagtacacattgcggttaggggtaacagcaataatagggagataaggtcgatatttggataaaaacatcggagatcctcccgtctgggtatacacaataatggctttggcagatgctttttctgcaatttggattccagaaaacccaatggcttcaagataaggagaaactttgagagcgctgtttttgtcgttcagctggaaaaaagcgtggtaatcgaaagtcttctcagtctcttggataatggaacgcattgtttttactgcatgtacaggatgggctcctgaggcagtttctccagacaacatgactgcagaggttccatcgtaaatggcgttggcaacgtcagagacttcggctcgtgtaggaagggggttgcgaatcattgactcgagcatttgcgttgcagtgatacaaaaccgacccgtttccctcgatgctcgggccataaatttttgtagtccaggaacttcaacaatagacaattcaataccaagatccccgcgtgcaatcatgataccatcagcagctctagcgatctcttggaaattttgtactcctaaatgattttctattttggcaatgatgggcatattaggacgaccaaagctttccaaaactttacgcatgctgtcaatatcttcattacatctgacgaacgaagcagcgataagatcgagttcttgttctaccccaaattttaagtctgcaatatccttctctgtcatgaaaggaagagcaacatcgatatctttgatgctaagagatttgttggattttatttctcctgaattttgaaactctatttccaccatatgctcttgagcattgaccaccactgcttggatatacccatcatcaatgagaacaggagctcgttctctaacataagggaatacacaacttggataaagagtaacgccgctttctttggatcctaaaatttctttgctaacgagagtaagacgatccccaggctgtacttttataggagattctacttggcctaaacgaatttcgggaccttttgtatctagcataatagctaaaggaacttggcgcttctctcgtagttctttaagaatagcgatggtccggccatggctttcatgggtcccgtggctaaaattaaggcgagctacattcatccctgcatcgagaagcttttccagcatctcaggggtattcgttgcagggcctatcgtacaaataattttcgttctagcgatcataaatcgggataccggtattagtgagtagaatatcttctagaatatccgaaatgaaagaagccttcaactatacaaaatatttagcaaccgcatcgctacgctttaaaaaagcgttcgataggaatgggtgtggagaatttaaaatgagaaaggattcgttgagtgatgtgatcgctggtgagtccaatcaaatttaaatagttcaggatttccgtgcgggatanacatatctggtactccgagggagagaacatctgccttaatattatgttggtttaagaaaaggagaaactctgaccctaagccgccatgaatagaatgttcttctaaaatgattactttggagtggtgggtaagtagggattgtaggagttttcgatccaaaggtttaataaaaatgggatcaacaactgttgttgagattccgtaatctagaagatgttctttgacggttagagcagtgttacacatgtgcccaagagctatcaacaataaatcatctccttggcaaagaatctcagcctctccaggaagaatgggagaaaaagggaaggaactgttagaagctttctcattagctgggatgttagggtatcgaatggcacaaggagatttccataatagagaagaaaagaatagtctttcaagaacaagggcgttgcgtggttgacaaatgaccatattcggcatggaacataagaagcctaaatcatagataccatggtggctacgtccatcgtggaaagctagccctgcacgatcaatagcgaagatcacggggagctcttgcatacagacatcatggaatacgttgtccatagcccggtgtaaaaaagtagaatatatagagcagcatacaggggtgccgctacgagctattcctgccgaaaatgtgacagcatgaccttctgctatgcctacatctgtgaaacgatctgggaattgtttgcggaaatcttccaaacaagaccctaaagacatggcaggagttacgacttgcaattgaggatatttcttccccagtcgacataggatattcccggcatgttgagggaacgaaatcggggtttgtaattcaacattgccagaggttttttttagagaggtattttggaaatgcgctttcactccatgatagcgaatcggtctctttcagcttcagttaaaccatttccttttactgtacacacatgaaacagaataggctgaggctggtctttgatcatttgcagagcttgaacaagctttttgacgttatgtccgtcaataggacctacgtaatgtaggccaaactgttcaaacaaaggatgggataaagatttcagagcgatatctactttgtgcgataaagtcttctttttgtgtagaaaacttggaagattctgtatccaagagtgaattttttgagatagtttacttattttttgaggatatatccactgggagattccttgaggaatattcccaacgttttctgagatcgacatttggttgtcgttcaggacaataatgaacttcgataagtcagcagggatgttattcaaagcttctagtgttaagccacaagaaaaagcagcatctccaagaataggtagtatatgcgaagagctatttgaagaacccttggccagccctaaagctaaagaaagggcattgcccgcatgaccagagaaaaatatatcatggttcgactcttggggggttgtaaatccactgagtccgttatcatgtcgtatattggagaaagcttctgtgttgcggcctgttaatagtttatgtacataggattggtgcccgacatcaaaaataaactgatcatctggtgaggagaaaacgtaatgcagagcaacggtaagctctactccacctaaattagaagctaagtggccacctgttagagagagactctcaataatcttattacgaatttcatcacacaatacagggagcttatctaaagataaagcatgaagatcttgaggagagtggatgtgtggcaaaagggagtaggtcatacagattccccagggataaaaggatgcttaatgggattgcctgaagtatctactgcgacagaaccatcggggtttagttgtagctgaaaactcagctgttcgacatggttcaaattggtttctccttcttgaataagagaaaacatttcctcatagatagccaagatagcttccacggaatgacagtcctcaagcgccttctgtaaaaccagaaggcgctgtataacggtgtccagatgacttgcttcaggtaccgagatttcctgcatgaccggctacgattcgctccgttggtcggaaagctgtttaatacgtgcttcgacttcttgaatgcgagactcacatatacgcattaattgatcagcctcttcatacaaggcaagagaagcttctaaagacgtggttggttgattcataaggtctatgatctcttccaaacgtttcatagcgtcttcaaaagggactttttccacatttttagccttttttgtcattgttaagccaaacttcttttactgatacaactgcttcaccgtcttggaggcagaccgcacaagatcactttgtttaagagattccgcagagatgataacaaagtgtttattaaagtcaaatagctgggcaaaacctctttttaaaacattttttggatttagtgaggaagcttgttcttgtatagcctggcaccgttctttcgccttagttagcaggtgttgtattgtgaaagaaagttcgttctgaagacgaaccaaacactcttggtgagtttgttgtgagcttgcaatcgcgatatgcagcctcctagatagctggcttaaaatattccgcgagtgctgcgtgcggtgctgtaaattcagtagttcatttttgagacaagaagtgtatagctggtttagagaggttttttttgtataaattttattttttatagaaagcataagagattggttcagatccgccaaatgtttttctatacgaatcaaaacatcgcttttcaaccagcgtctatattgcgcaaatcgttgtttatagtattcaagtttggtttctatccctctttctaaggccgctcgggtgtaatctaaagtttgttgtgctgtgtggtagaaatctactgaagcaagatgtctttgccaatgagtgagaaggttttttttagctgcaataaattgtcttgcatgagacgagacgtagcgccgtagattttgcagttcttggcggtattgatcactactcttacatacaatttctgctgctgcagagggggtcggagcacgaacatcggatgcaaagtcgcagagagtgaaatcagtctcgtgaccaacagcagaaataataggaatggagcttgctacaatagatttaactagctcttcttcattaaaagcccagagatcctcgatacttccaccgccccttgcgatgataagagcgtggaccctcatactgttttgattgaaaaattgaatagcctgagaaatctcttgagccgcagtagctccttgtaccgtcactggatataagatgacttgaaattggtgacaacggcgagaaagaactcgtaaaatatcttgaatgacagcccctgtagggcttgtaatcacccctattacgcgagctcctgaaggaagaggctttttgcgtttaggatcgaaatatccctcagcagcgagacgttgtttgcgttcttcgaattgctgcagcaaattaccttctccggagaaggtgagagcataggccacaatctggtattgtcctctaggagcatagactgtgagtttcccatgaagaatcacgtagtcgccatcttttggtttgcggtcaaagtatttgctacggaaatgaaaaaaagctccgttaagtacagccttgctatctttgatagcaaaatataagtgaccgcttgtttgtaaagagacgttactaagttctcctttaaccactacgcgaagaaaatttttttctaaaagattcttaatagaatctgtcaggacagaaacttctataggaggggatgtgatcgacataggtacgtgtgagttatgggatatcgatttgttgtataatggataagaaattctctgaagataaagaggctcctccaactaaaagaccattcacatcagggcagagggaaagtgagcgagcattatcggctttcacagatcctccgtaaagaatgggggtgcgttccgcaatatctttggaaaagagagaagcaatcgtttttctacagaaagcatgggtttcctgaactagatcaggatgagctacttttccggtgcctatagcccagactggttcataagctagaatgaaagaggcttgctcagggagtttagataatcctatagtcagttgatttaaaagaatatcttgagttgctccagattcttgttcttctagagtttctccaatacacagaactggaatcattccactatggatagctgcagcagctttttcagcaagtacaggattttgttcatgaaagatatgacgtctttcggaatgtccgatgagaacaaaatcgactccgatatctttgagcattggggctgaaatctcaccagtaaaagctcctgagtcagcttcatgagtggtttgggctccaagaaagatgggggaatcgcttacagcttgttgacaagctgacagcagtgtgaaaggaggaatgattcctgtaatgatttggggattagacagaatgtcactagagaggaaactttttaaaaaggtctgagcttcggtaagcgttttgttcattttccaattaccgaaaacaaattgctttgatggctcagagtggagaaggtgggcccaagttggaaatggttttctgtgagtttctttgtctgtaaacataaaatttgctgaataacctgtgcatgtattttgtaagatagatcaaagcgtaatactcgatttcttgcaagggaggcttatttttatatgatttattttctattgctttgatataaactcttggatatgctgatcttcttgtcttacttttttctgtgaatttgcttaaatagttggttttagcccctttgttgtatgaaggtgaaaatttgtggtattacgcatcctgatgatgctcgggaagctgccaaagcgggagccgattacattggcatgatttttgctaaagattctcgaagatgtgtgagtgaagaaaaagcaaagtatatcgtagaggctatacaggaagggaattcggaacctgttggagtattcccagagcattcagtagaagaaattttagctattactgaggcgacagggattaccagtatccagttgtctggagaggatattctattcaaattttctcagttacgagagcatttttctattttctatgttgtatccgtttattctaatggacagccctctgcagcactgcccccaatgaacgatgcagtaactgttgtatacgaccacattggcggagaaagaggctctccttttgattggaaagcattctctccttttcaacataataattggatgttgggtggaggagtcaacctttggaatatcaaagaaggtatcagtcttctcaatcccagggggattgatgtgtcttctggggtagagcgcccaggcattttgcgcaaagatatttttttgatgcaggcattgataaactcagctaaggaactgtcgagttcaacactttagtgttttagagggagagtttttatagaccgggagacaagaatggggcaacctggatttgaaccagggacctacgggttatgagtccgcagctctaaccgctgagctattgccccaggatagaagaagggaagcttatcataggtggctaatgtttgacaagaacaaagcttatcagggtattataatttttatttaagacggttttgttttatcgttgcgccttttctttgaaatcgatactattcccttggtttcttttttatttattatgatgaacgcctaaaagtcgttttaagtaacaattgtgtattgtttttagatgctcatcagtcgatgttagtaacaaggtgttgtgtaatcagaactagatcctctggtgtaattcgagggactccgcgttacgggttcgagcagtacttaaggatagagaccgaaatcaagagaagtttataatcgttacaaagtcaaagcaagccttctggtctacagagggctttttagacatgggctcatccgttttcttcttgttttgttcaacatagtatttgtgcctacttcttagagacgggtgtgaccaagcttgggtcaaaaatgttttattgttcccaagattgttgaattagaggatctcattttcagttatttaagcgagtgaaaagctcttgagtttattttctaagaagaataaaaccttgagccaatattaaaaattatttccatatatgaacacactcagttttagaaacgcttttgctttgatttcagagtcaggtctgcagcagcagttctctgggtgtgtttgttcgcaaatgattgcttcctatgaagttgttttctctcaaatgatgcatcctgttaccaaacgttgggtttctttgactgaggggtggaccgaagaggttaagcagagaagagattagtaattcgcgaacgatgataaagctctttgttagacctaaaggtctagcaaagagcttttttttgactcgatcacaagttttttagttcatggcaatgaggggattgggtcgtttagaagcatttgtggttgttaaataacaattttaaaggggggcgcctttagggagaagatatgcctgatccatgttccaataatagtaaagacacaccttattgtcgcatacatagcgacgaagagaataccactgaatcgagtgttcagagttcttcaccagaagatggggtatctgtgagttctgcttctatgcagattcaggctactgcagaacatttgagtgttactgggggggggatagcagtccctcttcagatttgatagatttgagtcttgattctgctgcgaataggcgttctggagtgcgtgtatgtgattttagtgatgatgatgacgacgacaatcgaataccgtttgttgaagtaggatacgttaatgctagtggttaactcatcgtagtgtgtggggagagagctttcagttgagcgaactctttcatcagcctgtgactgcgattcctaatgctggtggaatggcctgtaacctgctcgctagaggactaggggtggcgggctgttttccaatttctgctcatcacctacggtacaagctttgttgagagcttgggataggtttttcagtagggtgtctgatgggcggtttttacagatttactatggcgatggagggctatttgtagagagagctcttcagttgattagctgtccgttacagcgtgctcgtattcgggttgttggaattaatccatcattttttgtaacagtaagcgacaatagacatttctacacaagtcctggtagttgtggacgaattctagatatgagtggatacctgtctgcccgaagagatgggtgtgtttcacatgttccattttctcctcactcacaaagtattactcctggagtgggggatgcatgctttgaacttggtttgcgtatggaatttatgcggcttgcaggattgagttctttgtctgcagcgagttctcctactagtgaggattcggactcttctcgtttgcaacttgttcgagtagtatcctcagaagatagtgttgcttttgcgcgtttgtatgcagctttaaatgaggatattacctcttctgtgcgagcagcgaatcccttccctttttcttatgtacggttgattcttttgttgactactctgtgtagacatactctaactacaaccaaggctgcatattcctatacccctgcatcttgggaagctttagatatgttggattcaggatttacagcttcttatgtgggaggagttctttcggaaatctttctattgtgtactcatagtccaagaagagcgcaacgttcccgtatgttaaggatgcttgcgaagttattctcctcttgggcatggttggtcggagttatggagttaagttgcggctacggggtaacgattcagttgctgcttcaaaatgatcctcgccagtcttgcctgaggaacctatttttttggatggagtctactctgacacctgtaattcttttggatattgccgagaggattggcctgccttatgggatagagttgttggattgggcatgaggattacaactccgagtgtatatagagaagaaaaggctagggtctctgaatccaaagtcaagcggtagagctatttggggatgatcggagagaccgatatcgtgctagacaacatgctgccgttggtacttcggtagagttagtgtctgtagtttgtggggctttggtgcagctaatgtttctcggaatagacggctttagcttaagattgccagagatatgtcgagaagttccttgcaacaatacctctacaccaaatctacagtaattgccaattcgactaccccgtcgttaaataatactagtacatgttcggggaatagcacaaccagacctgttcttccatctattactgggatttatgagactgatgttcagacaacaggtgtggcgcgcacgcttaatgttatacgtatgatatggtgcggggtcatgctattatactttctctatacagcattccgcttggtaaggaatgctcgtcgaagaaactaagtagtcttgtgagcaggaggagatagccaatgagaatcattggctatctcattaggtttttcgagccagatattgaacggctatacgttgcatgttcaggaatagagattctcctccacgagatctccccatggataggtgtcgacttaacttctcaaaaaataaaggcttgcaagtaagaatggtttcgggagtttctcctgaatagatatccgagaacagtacagcaacgcctgaagagattagagcttcggtataggtgaaaaaaaacactgcgttatttttgaactcgccatggaggtaaagatcgctttggcaacctaaaactaaattttcttttgtcaagaactcttttggaaaaggcttggctgtgcgaccaatctgtaagagttgtttgtaaaaagtatctttaacaaagttttctgggaagagaagagccacagctttctcttgtttttctagacaagctttatgttcagaaggggtagttaatatcattgttcaataactcgtgttggacggtcatagagttgtacaagcgattggttgagctgagcaattttattgtcgagcatagcaatgactacttgtggtttcttgcccaagatctcatgttccatttcttcgggtagagaaatgcggtttgtaagaggtcgtattgttatggtttgtgattgtcccggacgatgggcgcgtttctgtaatatatctaggcggcgttgcaaaaccatttggttacgaattaaccgacactgcatgatggcttgtcgaattcgtttttcttgtttatcaaacagttcctgatctgcaatatatcctgacctgatttgaaccggtatccataaacagctaacgagcttgtttgatgtcctaaaaaagctccaataataaacccgatagcttgaggagaggcataaataagggcagaaatcgacgcaataacggtggcaagcagaacctgacgagttccattaggatccagttgttgtaatccgtgattagtgatattccaaagactgtttaagtgagggtatttgttttctttatctaggaaattagcagaaataataccaaggacaacaccagctccaaatcctattcctagccaaatgcttaaaacaagtgcaacggaactgtgacaaattaaaataagagaccaggcaagaatgtacaagagtaagtgcttccagtttctttgtaaaaagtctccgatagtattggctacggcttgtacccgacttttgctttgagcaggctctggggtgagtacggataatgcgggcggagtcaaagaaattggagagtgcagatctcctagagaatcgtgataagctccccctctcgaagaatgtaagggcagcgcgccggaaatagaagaatgtaggggatgagcggctttgaccatggcctatctactctactttatataccgagacaacattttcaggcaaggactaactagagtgtctcaaaatgtttttctaaaacagaagcgaagcttctcattcggaagaatggggagttttactgtgaagtattgagtctaaggaggacaagtttaaggtattgggtttttgcttgtaaacaaattaaaaaaatatttgttattcccgcaaaaactcaagagagaatgtcaaaagatacttttccttctgttttttgacaagttgtttgacattttctgtttagtcgatataatcgctctctcgagtttccggaggacaacaggtgctgcagcttcattgggtgcccaggcctgttttttttgtttgaatgctgggatcaagagatagaatgctttttaggtttttttaggaatggcaaaaaaagaagatacgatcgttctagaaggtagagtggaagagctgttgcccggcatncattttagggtgatgttagagaatggggttcccattacagcgcatctgtgcggtaaaatgcgtatgagtaatatccgcttgctcgttggagatcgcgtgaccgtcgaaatgtctacttatgatttgacgaaggctcgtgttgtctacagacatcgttaaggttgttttgctatccttataaataaagtcacgcagttttaagaggaaagcttgataataatccgcgtctgaagttactatgctcgtgtcgagaccgagattatcttcagttgtattctgcgccacttttgtctgcggctgaggggttgagaaaactagttgaggctggttgagagtttgattgcgggaaagttgcgatgctaattaggttgcttcctcttttgtgctaagcccaggtagctcagtggtagagcacttgcatggtaagcaagtggccgtaggttcaattcctattctgggcaaaagatatcggtagcaaactaatttttaatttgaggatttttgagatgtcaaaagaaacttttcaacgtaataagcctcatatcaacatagggaccattggccacgttgaccatggtaagactacgttgacagctgctattacgcgtacgttgtctggagatgggttggctgattttcgtgattatagctctattgacaacactcctgaagaaaaagctcgcggtattacaattaacgcttcccacgttgagtacgaaacagctaatcgtcactacgctcacgtggactgccctggtcacgctgactatgttaaaaacatgatcaccggtgcggctcaaatggacggggctattctagtagtttctgcaacagacggagctatgcctcaaactaaagagcatattcttttggcaagacaagttggggttccttacatcgttgtttttctcaataaaattgacatgatttccgaagaagacgctgaattggtcgacttggttgagatggagttggctgagcttcttgaagagaaaggatacaaagggtgtccaatcatcagaggttctgctctgaaagctttggaaggggatgctgcatacatagagaaagttcgagagctaatgcaagccgtcgatgataatatccctactccagaaagagaaattgacaagcctttcttaatgcccattgaggacgtgttctctatctccggacgaggaacagtaactggacgtattgagcgtggaattgttaaagtttccgataaagttcagttggtcggtagagatactaaagaaacgattgttactggggttgaaatgttcagaaaagaactcccagaaggtcgtgcaggagagaatgttggattgctcctcagaggtattggtaagaacgatgtggaaagaggaatggttgtttgcttgccaaacagtgttaaacctcatacacggtttaagtgtgctgtttacgttctgcaaaaagaagaaggtggacgacataagcctttcttcacaggatatagacctcaattcttcttccgtacaacagacgttacaggtgtggtaactctgcctgagggagttgagatggtcatgcctggggataacgttgagtttgaagtgcagttgattagccctgtggctttagaagaaggtatgagatttgcgattcgtgaaggtggtcgtacaatcggtgctggaactatttctaagatcattgcataaattaagtgatatgttggcgaggctgaaaagccttgcctttgggtgtgtagcttagatggtagagcagtggcctccaaagccgccggtcgggggttcgaatccctccgcactcgtattaggtaactgaaagaagaattcgcttatggggcaagatcaccgaagaaaatttcttaagaaagtatcttttgcaaaaaaacaagcagcttttgcgggtagctttatcgaagaaattaagaagattgagtgggtaaataagcgagatcttaaaagatacgtcaagattgttttgatgaatatttttggcnttggattttccatctattgtgtggatttagctcttcgaaagtccctttcattgttaggtgaagtaacaagctttttctttggttgattcatgtttaagtggtatgtcgtccaagtttttacggctcaagaaaagaaagtaaaaaagtctttagaagattttaaagaagcctcagggatgtctgattttattcagcagatcatcctgccttccgagaatgttatggaagtgaagaaaggtgaacataagatcgttgagaagtatatttggccaggctacctcttagtcaagatgcatttaacagatgaatcttggtcttatgtgaagaagacgcagggtgtagttgaatttttagggggaggcgctcccgttgctctgtctgaagaagaaataaaaaatattttagcagatctagaagagaaaaaatctggggttgttcaaaaacataagtttgaagtgggatctcaggttaaaattaatgacggcgtgtttgttaactttgttggggttgtgtcggaagtgttccacgacaaagggcggcttagcgttatggtttctatctttggaagagagactcgcgtcgatgatttagagttctggcaggtagaggaagtcgtgccagggcaagaaagtgagtaagaataagaaattctgtgtattcttattctctatgttcttataatttaactttttcgtttttccccctcgttttgagaggaatactaaggtagagtagggttgaatatgtcgaataaaaaaatcattaaaatcattaaattgcaaatccctggagggaaagctaaccccgctccaccaattggtcctgctttaggtgctgcaggcgtgaatatcatgggattctgcaaagagtttaatgcggcaactcaagaccgtccaggtgatttgctccctgttgtaatcactgtatactcggataagactttntcttttgtaatgaaacagtctcctgtttcttcgttaattaaaaaagctttgggcttggaatctggatctaagattcctaatagaaacaaagttggtaaattaactcgagcacaaattacggcaattgctgagcaaaagatgaaggacatggatgtcgttcttttagagtccgccgagagaatggttgaagggactgcccgaagcatgggtgtagatgtagagtaattagttaaagagctgcataattatgacaaagcatggaaaacgcattcgtggtatccaagagacttacgatttagctaagtcgtattctttgggtgaagcgatagatattttaaaacagtgtcctactgtgcgtttcgatcaaacggttgatgtgtctgttaaattagggatcgatccaagaaagagtgatcagcaaattcgtggttcggtttctttacctcacggtacaggtaaagttttgcgaattttagtttttgctgctggagataaggctgcagaggctattgaagcaggagcggactttgttggtagcgacgacttggtagaaaaaatcaaaggtggatgggttgacttcgatgttgcggttgccactcccgatatgatgagagaggtcggaaagctaggaaaagttttaggtccaagaaaccttatgcctacgcctaaagccggaactgtaacaacagatgtggttaaaactattgcggaactgcgaaaaggtaaaattgaatttaaagctgatcgagctggtgtatgcaacgtcggagttgcgaactttctttcgatagtgcgcaaatcaaagaaaatgttgaagcgttgtgtgcagccttagttaaagctaagcccgcaactgctaaaggacaatatttagttaatttcactatttcctcgaccatggggccaggggttaccgtggatactagggagttgattgcgttataattctaagtttaaagaggaaaaatgaaagaagagaaaaagttgctcttcgcgaggttgaagaaaagataaccgcttctcaaggttttattttgttgagatacctgggttttactgctacgcattctagaagttttagaaataatctttccggggtctctgctgagtttgaagttttaaagaaaaaaatattttttaaagctttagagacttctggcgtagaaatggatccagaagacagcgaaggtcatcttggggttgtattcgcctatggcgatccagtatctgctgcgaagcaagtgttagatttcaataaacagcataatgattctctagtttttctagctggaagaatagataatgcttctttgtctgggcgagaagttgaggccgttgctaaattgccttctatgaaagagcttagacagcaagttgttggactcattgctgctcctatgtctcaagttgtaggaattatgaattcagttctttctggtgttgtttcttgtgtcgaccagaaagcagaaaaaactcaagagtagtgttaacattctaaaaaataagggtgacaaagtgacaacagaaagtttggaaactttagtagaacagttgagcggcttgacggtgcttgaattgtctcagcttaaaaaattattggaagaaaagtgggacgttacgctgccgctcctgtagtagctgttgctggtgctgctgccgctggtgatgctcctgcttctgcagagcctacagagtttgctgtaattctggaagacgttccttctgataagaaaatcggggttctgaaagttgttagagaagttactggattagctttgaaagaagctaaagaaatgactgaaggattacctaagacggttaaagaaaaaacttctaaaagtgatgcagaagacactgttaagaagttacaagaagccggtgctaaggctgttgctaaagggctgtaattgttatgggaaagagaatgctttgggggttacttgcaagcttctcttttcgtttagctgcacagtagctgggcacagaggggttcccggtacgtcttaacagatttgtctggacttaacttttagtgtttggcatcgcaaacagaatatttctgttgcaatggttttttcttaatggaatcaaggtgatagtatttgtcggatggacaagtgtatagggagtatccagtgtctctgtattggataggctctgttttgtcctagctggaaagcatctgtcgtattcctgtttagagatcacagagggactaaatagggaaatggtatcgccaaaagtcttaaagtcttaggagagctcgcatgttcaagtgcccggagcgggtcagcgtcaaaaagaaagaagatattttagatcttcctaatcttgtcgaagttcaaatcaagtcgtataagcagtttcttcaaatcgggaagcttgctgaagagcgagaaaacattggtttagaagaagtcttcagagaaattttccctatcaagtcttataatgaagctacgattttagagtacctctcttataacttaggagtgcccaaatactccccagaagagtgtattcgtcggggaatcacctatagtgttactttaaaggttcgtttccgtttaactgatgaaacggggattaaagaagaagaagtctatatgggaaccatccccatcatgactgataagggaacttttattattaatggggcagagagagtcgttgtttctcaagtccaccgttctccaggaatcaattttgaacaagaaaaacattctaaaggaaatgttttattttcttttagaattattccttatcgaggaagttggttagaagctgtcttcgacattaatgaccttatctatatccatattgataggaaaaaacgtcgcagaaagattttagctatgacgtttatccgagctttaggatattcaacagatgcagatattattgaagagttcttttctgtagaggagcgttccttacgttcagagaaggattttgtcgcgttagttggtaaagttttagctgataacgtagttgatgcggattcttcattagtttacgggaaagctggagagaagctaagtactgctatgctaaaacgcatcttagatacgggagtccaatctttgaagattgctgttggcgcagatgaaaatcacccaattattaagatgctcgcaaaagatcctacggattcttacgaagctgctcttaaagatttttatcgcagattacgaccaggagagcctgcaactttagctaatgctcgatccacaattatgcgtttattcttcgatgctaaacgttataatttaggccgcgttggacgttataaattaaataaaaaattaggcttcccattagacgacgaaacattatctcaagtgactttgagaaaagaagatgttatcggcgcgttgaaatatttgattcgtttgcgaatgggcgatgagaagacatctatcgatgatattgaccatttggcaaaccgacgagttcgctctgttggagaactaattcagaatcactgtcgttctggattggctagaatggaaaagatcgttcgagaaagaatgaatctctttgatttctcttctgataccctaactccaggaaagattatttctgctaaagggttagtcagtgtcctgaaagatttcttcagccgttctcaattatctcagtttatggatcagacaaaccctgtcgcagaattgacgcacaagcgtcgtctgtcagcattaggacctgggggattgaatagagaaagagctgggtttgaagttcgagacgttcacgcaagccactatggtagaatttgtccaattgagactcctgaaggaccaaacattgggttgattacttcactatcttcctttgctaagatcaatgaatttggattcatagagactccttatcgtgtcgtgcgcgatggcatcgtgacagatgaaattgagtatatgacagcagatgttgaagaagagtgtgtcattgctcaggcttctgcggagctcgatgagtataatatgtttaaaactcctgtatgctgggctagatacaaaggagaggcttttgaagccgacacaagtacggttacgcatatggacgtttctccaaaacagctggtatctgtggttacggggctgattcctttcttggaacacgacgatgctaaccgagctcttatgggatcgaacatgcaacggcaggctgtaccattattgaaaacggaagctgctattgttggaactggattagaaggacgtgctgccaaagattctggagctattattgtggctcaggaagatggggtagtcgaatacgtagatagctatgagattgtcgtagcgaagaagaataatccaacgcttaaggatcgttatcagcttaaaaaattcttaagatccaactccggaacatgcatcaaccaaactcctttgtgttctgtgggagatgtggttacgcatggagatgttttagcggatggcccagcaaccgataaaggggaattggctcttggtaaaaacgtattagtggccttcatgccttggtacgggtataacttcgaagatgcgattatcatctccgagaggttgattaaacaagatgcgtacacttctatttacatagaagaatttgagttaacagctcgagatacaaaactcggtaaagaagaaattactagagatattcctaacgtttctgaagaggttttggcaaatctcggagaggatggtatcgtccgtattggagctgaagtcaagccgggagatattcttgtcggtaaaatcactccgaaatctgagacggaactagctcctgaagagcgtttgttgcgagctatttttggagagaaggcggcggacgtaaaagatgcctctctaacggttcctcctggtacagaaggagtcgtaatggatgtcaaagtattcagcagaaaggatcgcttgtccaagagcgatgatgaactggttgaagaagctgtgcatcttaaggatctacagaaagaatataagagtcagttggctcaattgaaagtagaacatagagagaaactaggggctctattgctcaatgaaaaagctcctgcagcgattgtacaccgtcgttcggcagatattttggttcaagaaggtgctatttttgatcaagagactatcgaactcttagaaagagagtcgctagttgatttgctgattgctccttgtgacatgtatgatgttttgaaagatattctttctagctatgaaacagctgttcagcgtttggaagtcaattataaaaccgaagctgagcacataaaagaaggtgatgctgacttagatcatggagttatccgacaagttaaagtttacgtggcttccaagcgaaaacttcaagttggggataaaatggctggacgtcacggaaacaagggagtggtttccaagattgttccagaagcagacatgcctttcttagctaacggtgaaacagtacagatgattttgaacccgttaggggtgccttctcgaatgaaccttggacaggttttagagacacatttaggatatgctgcaaaaaccgcaggtatctatgtgaaaactccggtctttgaagggtttccagagtcccgtatttgggatatgatgatagagcagggattgcctgaagatggtaagtcttatctatttgatggtaaaaccggagagcgtttcgatagcaaagtggtcgttggatacatctacatgttgaaattgagtcacctaattgctgataagatccacgctcgttctataggaccttactctctcgttacgcagcaacctcttggaggtaaagcgcagatgggaggacagagattcggggaaatggaggtatgggccttagaagcgtatggggtagctcatatgttgcaagagatcctaactgttaagtccgacgatgtttcgggaagaactcgtatctacgaatcgatcgttaaaggagaaaacttacttcgttctggaacgcctgagtcgttcaatgttttgattaaagaaatgcaaggtctagggcttgatgttcgccctatggtagtagatgcttaaaaaacacttgttggagagaagttaatgttcagagaaggttctcgagacgatgcagccctggtaaaagaagggctgtttgataagttagaaattgggattgcttcagatgtgactattcgcgacaagtggtcttgtggcgaaattaagaaaccggagacgatcaactaccgtacatttaaacctgaaaaaggcggtttattctgcgaaaagatttttgggcctactaaggactgggaatgttattgcggtaaatataagaagatcaaacataaaggaattgtatgtgaccgctgtggagtagaggtcacactttctaaagtgcgacgagaaagaatggctcatattgagttagctgttcctattgttcacatatggttcttcaaaacaactccttcaagaatcggaaatgttttaggaatgaccgcttcggacttggagcgtgtaatttattacgaagaatatgttgttatcgatccaggtaatactgatctcgtgaagaaacaacttctcaatgatgcgaaatatcgagaagttgttgaaaaatggggtaaagatgctttcgttgccaaaatgggaggagaggctgtttatgatcttctcaaatctgaagatttggaaagccttttaggagagcttaaagatcgtttaagaaaaacgaaatctcagcaagcgagaatgaagcttgctaaacgtctgaagatcgtagaaggttttgtatcttcttcgaaccgtcctgaatggatggtattgaagaacatccctgttgttcccccagatttacgtcctttagttcctttagatggtgggcgttttgctacttcagacttaaatgatctgtatcgtagggttattaaccggaataatcgcttaaaagctattttacggctaaaaactcctgaggtcattgtccgcaatgagaagcggatgttgcaggaagctgttgacgctctgtttgacaatggacgtcacggacatcctgttatgggagctggcaatagacctctgaagtctttgtcagagatgttgaaagggaaaaacgggcgtttccgacaaaatttgttaggtaaacgagtggattactccggacgttcagtgattattgttggccctgaattgaaatttaatcagtgcggtttgcctaaggaaatggcgctggaattgtttgagccatttattatcaaacgattgaaagatcagggtagtgtttatactattcgttcagcgaagaagatgattcagcggggagctcctgaagtttgggatgttcttgaagaaataattaaagggcatccagttttactaaaccgagcgcctactttgcaccgattaggaatacaggcttttgagccagtattgattgaagggaaggctattcgggtccatcctctggtatgtgcagcattcaacgccgactttgatggagaccaaatggctgttcacgtgccgctctctatcgaggcgcagttagaagctaaggtcttgatgatggctccagacaacattttcttgccatcttctgggaaacctgttgcaactccttctaaggatatgacattgggtatctattatttaatggctgatccaacctacttccctgaagaacatggagggaaaacaaaagcatttaaagacgaagtagaagtgcttcgagctctgaatgctggagggtttattctgaaggatgagatctgtggttctcgtcgagatgaaactggacgagggattcacatccatgagaaaattaaagttcgaatagatggtcagattattgaaacaacacctggtcgtgtatttttcaatacgatcgttcctaaagaacttggtttccaaaactatagcatgccaagtaagcgtatcagtgaattgattctgcagtgctataagaaagttgggttagaagctactgtacgcttcctagacgatcttaaagaattaggctttgtacaatctacgaaagctgcgatttctatgggtctgaaggatgttaagattcctgaaatcaagaaagaaatcttaaaagatgcttacgacaaggttgctattgttaagaaacagtacgaggacggaattattactgatggggaacggcattccaaaacgatcagtatttggactgaagtctcagacctcttgtctaatgctttgtactctgagatcaagaaacaaacaaatagcaaacataatccgctattcttgatggttgnttctggagctcgaggaaataaatctcagttaaaacagttaggtgctttacggggactaatggctaaaccaaacggagccattattgaatctccgattacttcgaacttccgagaaggtttaactgttctagagtactctatttcttctcacggagctagaaagggattggcagataccgcgcataaaacagcggattccgggtatttgactcgtcgtttagtagacgtcgctcaggatgtcattattactgagagagattgtggtactttaaatcatatcgaggtgtcgacaatccgtcagggttctgaagaactgttgcctctaaaagatcgtgtttacggacgtacggtttccgaaaacatttatcagcctggtgataagagcaacgtcttagcatatgctggcgatgtattaacttctgctcaagctgaagctattgatgacgctggtattgaaagtgtgaagattcgttccactcttacttgtgaaagtcgtcgaggagtatgtgctaaatgctacggtttgaatctcgctaacggtcatttgattggattaggagaagccgttggtattatcgcagctcaatccattggggaacctggaactcagttaacaatgagaacgttccaccttgggggggttgctgcgacatcctcaactccagagatcgttgctgagtgcgatgggattcttgtttacctagacttgcgtgttgtcgtagaccaagagggtaataatcttgtgcttaacaagatgggagctcttcacttagttcaagacgaaggacgaagcttaagtgaatataagaaactcttgagtacgaagtctattgaaagtctggcaacattccctgtggaattaggagctaagattttagttaatgatggtgctgctgttacagcgggacagagaattgctgaggtagagcttcataacatcccaattatctgtgataagccaggattcgttcattacgaagatttggtagagggagtctccacagagaaggtcgcgaataagaatactgggcttgttgagttaatcgtaaaacagcacagaggggaattacatcctcagatcgctatatatgctgatgccaatatgaaagagttggtcggtacgtatgctattccttctggagcaattatctccgtagaagaaggtcaacgtatcgctccaggaatgctcttagcgagattgcctcgaggggctatcaagactaaagatattactggaggtttgccaagggttgccgagttagtagaagctcgtaagcctgaagatgctgctgatatcgctaagattgatggggttgttgacttcaaaggcattcagaagaacaagcgtattcttgttgtccgagatgagattacgggaatggaagaggaacatttgatttctctaaccaaacacttaatcgtacaacgaggcgatagcgtaatcaaaggtcagcagttgacggatggtttagttgttccacatgagatccttgcgatttgtggtgttagagagcttcagaaatatttagttaatgaagttcaagaagtataccgcctacaaggggtagacattaacgacaaacacatcgaaattattgttcgtcagatgttgcagaaagttcgcattactgatccaggtgatacgacgttattgtttggagaagatgtcgataagaaagagttctatgaagagaaccgtcgcacggaagaagatggagggaaacctgctcaagctgttccagtgctgttgggaatcactaaagcttctttgggaactgagtcctttatttctgctgcttcgttccaagatacgactcgggtcttaacagacgctgcttgcagcagtaagacagactatctgttaggattcaaagagaatgtgatcatgggacatatgattcctggaggtacaggatttgatacgcacaagcgtattaagcaacatcttgaaaaagagcaagaagacttggtctttgattttgacagcgagtttgagtctgtggcaggttaaagatctgccccaaaaactagagaaagagagggggtatgagtcataacccccttgaatagtatcgttttttttggtaggcttcacttagagtcaaaaattgacaaggtgtttatgtctagccagttcgatcagtttaagctttggagtgttcttgttggagatactggagatcccgctttaatcaagacgttaggggttcaggatgctacgacaaatccttctttgatcttgaaggttgctcaagagcctaagtaccagtcgatgctgacggaagccatttcttggggcatccggcagaatggtgatgatgttcaaactctgacttttgttttagataagatccaagttaatttaggcttggagattctaaagcatgttcctggtcgggtatcattagaaattgatgcccggctttcttttaatacagaagcaatggttcagcgagcgatttttttgtctcaactatttgagaaaatgggaggagataagaaacgtttgttagttaaaattcctgggacttgggaaggtatctgtgctgcagaggttttagaaagtcaagggattgcttgtaacgtgactttaatttttaatcttgtgcaagcgatcgcagcagcaaaagctaaagtaacattggtctcaccttttgttggtcggatttatgattggtggatcgctgcttatggcgcagaagggtattctatcgaagccgatcctggagttgcttccgtagcaaatatctattcttactataagaaatttgatattccaactcagattatggcggcttcttttaggacgaaagagcaagtgcttgctttagccggatgtgattttttaacggtttctcctaaattattagaagaactcaagaaagatcagcagcctgttgaaagaaagcttagcgtggaagaagcgaaaaaaattagatattcaacctgtggagttgtcagagagtgtatttcggttcttaatgaatgaagatgccatggcaacagagaagctagctgaaggtattcgcatcttttctggtgacactcaaattttagagtctgcagttaccgaatttattagacagatcgcagcccaggaagcatagttttatattgataatgtggggcagtgttgaataaaaaggatgtcatggaaaaaaaggaacaggcgttatgtttttcttgtccgtattgttgtgatgggaacgtagctttttctgtaattgatttagaaaattgtcttgtgtgtgattgctgcgaagcttcatttatgtttgatgctgagatgtgtgatgctattagacgattctctgctctttgtttgagaatttatgaagctaaggccctcctcggtgaggccgcggtctcggtctctgttcaaggccaaaggattgacgttccttttcagctgctattttctcgattccctgtttttttgaatttgaatctagcgggtaaacttgtgcgagttagatttatattcgattctttgcgaggagaagtcttgtatcatagaggatagcgttccgctattttccattttgcagatctttcaaagctttttctaaaatagcatcaccacgagcagcttcttctttttctgagagcttaaaggaggaggctgcttttagaagagctaaggagacgttgggatagtcatctatggtagacgtgcttgtaaagatgtaggctgtgtgatcaatgactgtcacaccttggaggcaaaagactcgtccccaagaggtgtttttttccgttttgataattgtaaatttgccactgggagcttgaatgtgcgcaaagatagaagattccagtgtattctcattcgcgcgatgatagtctaaaatctcctcaatataggcatcttcagttttatggatgatttcgtgtgcgctgttgattgttggcgtcagtcctcctgctccctttccaatgaaaagaacatctaatttttccggtagctgcgttttatcatcgatgcattgccaagtattagggataagaaaggaataggtagcattggaataggttatccagctaatagaaggcctattttttttagcttctaaagcacgttttttcaaagcataacgaggagagggtttccttgatacatggagatcttttcgtttctctcgtaattgagcagctctagaaagaggctttccttctgcggctgccttcgaaactatagggaaacttgcaaataaaagagagcagaggataactcttttcataaggtttagtgtttgattttaaacgttgttatgatctaatcttaagggttaaccggatcataatcgatcgtttttttaagataaacgttgtttttcttggtatcagatatggcagatctcagcgctcaagataaattaaagcaaatatgtgatgctttgcgagaggaaactttaaaaccagctgaagaggaagccggttctattgttcataatgcaagagagcaagcaaaacgtattgttgaggaggccaaggaagaggcgcaaaggattattcgttctgcggaagagacagctgaccaaactctgaaaaaaggagaggcggctttggtacaggcaggaaagcgttctttagaaaacttgaagcaggcagtagaaacgaagatcttcagagagtctttgggtgaatggttagatcatgtggctacagatccagaagtcagcgctaagctcgtgcaagctttagtacaggcagttgatgcgcaggggatttctgggaatctttctgcctatatagggaaacatgtgtcagctcgagctgtcaatgaggctttagggaaagagataacttctaaactcaaagagaaaggggtatctgttggcaagttctctggaggtgctcagttaaaagttgaagagcgcaattgggttttagatatgagctcagaggttttgctagattttattgactagatttttacagaaagattttcgggaaatgatctttcagtcttgctaaaggatctttggcttaaggggctatgttgtttaaatcgttattggggaaaattcgttgacgatagaagctccgagttcgcggagcttttttgtatgcgttgagaaaagaagaactatctctggaggactttctagagagtttcttagttgaaggtgtaagagcgcgttatgaatcagtattattttttatcctccttcctttctcctcaacaacccgaatcttctcctctctattcatttcaagaaatcaatgatttattagcgctaaactttacagataaggattggcggtcctacgtaatattgcggcgtttttttgatttagaaaattttgcttttttctgggcagggaaatcgattcccttttcttttgggaccgttacaaatagtaatgtggagtctttgttgcggcttcaaatgtggtcggatgagtgggagtttgaagacttttttaaagattttctgttgcgctataaaactcctcgagagcgtttaacgcatttctcagagttagttagagattttctcgatcactatcaagattatccttcagaatttcttagaacctattttcgctttaagcaagatttacgaattattttggcagggtttcgagctagagtaatgcagaaagatgtgtcttttgtccttagggatgaagatagttcgaatcccattgtcttgcatgtgttgatgcaaaaagattctcctaattatgagcttcctgatgaattcttcgaattgagagatgttttaggaagattacgggcgtcttccacacatgttgaatcagactctctctttctatgaatttcataaggtagaagagatgtcacgagacaaatactttaacacagatgcaattctttctcgggtaactacatatttaatggccattcgtagtagttgggcgagtgttcagaaggggaaagaactgattaatttgatggagaaaggaatcagatggtagcaacttcaaaacaaacgacgcagggctatgtcgtagaagcttacgggaatttattgcgggtgcatgttgatgggcatgtgcgtcagggagaagtggcctatgttagcgtagacaatacttggttgaaagcagaaattattgaagtcgtagggatgaagttaagattccaagtttttgaggagactcaaggaatttctcgtggcgctttggtaactttttccggacatttattagaagctgaattagggcccggtttactccaaggaatttttgatgggttacagaatcgcttggaaatattggcagatacaagcctatttttgagaagaggcgaatacgttaatgccatttgtcgagaaacagtatgggcttatacgcaaaaagcttcggtaggatctgtactttctcgaggagatgtacttggaacggtaaaagaaggtcgttttgatcacaagattatggtgcctttctcttgttttgaggaagtaaccatcacatgggtgatttcttctgggaattatactgtcgataccgttgttgctaagggacgtacttcaacaggtgaagagcttgagttcactatggttcagaaatggcctatcaagcaagcttttttagaaggggagaaagttccttctcacgagatcatggatgtagggttgcgagtgttagatacacaaattccggttcttaagggaggaacgttctgtactcctggaccttttggagctgggaaaacggtattgcagcaccatttatccaaatatgctgctgtagacattgtagttttgtgtgcttgtggagagcgtgcgggggaggttgtagaaatcttacaggagttccctcatctcaaagaccctcatacagggcagtctttgatgcacagaacttgtattatttgtaatacatcttccatgcctgtagctgctcgagaatcttctatttatttggggattacaattgctgagtattaccgtcagatgggtctgcacattttgttactggctgattcgacatctagatgggcacaggctttaagagagatttctgggcgattagaagaaattcctggggaagaggctttcccagcctatttagcgtctcgaatagccgctttctatgaaagaggtggggctgtaaaaatgaaggatgggtcggaaggatctttgactatctgtggagcagtttcgcctgcaggagggaatttcgaagagcctgttacacaagcaactttatctgtggttggagctttctgtggtctttcgaaagcgcgtgcagatgcaagaagatatccttctattgacccaatgatttcatggtctaaatatctggattctgtagcagaaattttagagaaaaaagttccgggttggggagaatctgttaaacaagcctcccgcttcttggaggaaggtgctgaaattggtaaacgaatagaagtcgtaggggaagaagggatttctatggaagacatggaaatctttttgaaatcagagctatacgatttctgttatttgcagcaaaacgcatttgatgctgaggactgctactgtccatttgatcggcagatagagctcttttctttgatgaatcacatctttaactctagattctgtttcgattgtccagataacgcccgcagtttctttttagagctccaaagtaaaattaagacgctgaatggtcagaaattcctatctgaagaatatcagaaaggcctggaagtaatctataaactgttagaaagcaaaatggtgcagacggcgtaggtatgcaaacgatatatacaaaaattacggatatcaaggggaacttgattactgtggaggcagaaggcgcctctttaggtgaattagtgcagattgaaagagctgatgggcgctcatcgtatgcttctgttttgcgtttcgatgcgagaaaagtgactcttcaagtgttcggtggtacttctggattgtctacaggagacaaagtgattttcttaggaagacccatggaggtcatttatggagactctttgttaggtcgacgttttaatggaacaggaaaacctattgatcatgaagatgagtgttttggtgagcctatacctattacaacaccttcatttaatcctgtttgtcgcattgtgcctcgagagatggtacgaacgaacataccgatgattgatatgttcaactgcttggtcaaatctcaaaaaattccgattttctcctcttctggagaaaatcataatgcgctgttgatgcgtattgctgctcaaacagatgcagatatcgtaattattggagggatgggattaacatttgttgattacaatttcttcgtcgaggaatctcagcggttaggtttcgctgataaatgtgttaagttcatccataaagccgtagatgctccggttgaatgtgtattgataccagatatggctttagcttgtgcagagcgttttgcattggaacagcagaaaaatgtcctggttctgcttactgatatgacagcttttgctgatgcattgaaagagattgctattacaatggaccagattccagcaaataggggatatccagggtctttatattccgatctcgctgttcgttatgaaaaagctgtagatattgctcaaggcggatcaattactttgatcagtgtgactacgatgcctggggatgatatcacacatccagttcctgacaatacaggttttattacagaaggacagttctacttgaaagacaatcgaatagatccttttggctcattatctcgactgaagcagttggttattggtaagaagactcgagaggatcatggtgacttagcaaatgctttgattcgtctttacgcagactctagaaagtctgcagagcggatgtctatgggtttcaaactctctaattgggataaaaagttattagcgttttctgaattatttgaggctcgcttaatgagtttagaagtgaatattcctcttgaagaagctttggatataggatggaaaattttatctcaaagttttcattctgaagaagtcggaattaaagagcagttaattcagaaatattggcctaaagcatgtcttcacaaataaagttaacgaaaaattcatatagagctgagaaacaaaagcttaatatgttgggcatgtacttgcccacattaaaattaaagaaagctttgttacaggccgaggttcaatctgcaatccgtttagctgcagaaagtacagcgactaatgaacaagctcgagatagaatgtacgcctttgccgagcttttcagcattcctctctatacggatgcagtagagcagtgtttttctgtcgatatccttgaaaaggatgtcgagaatatcgcaggcgttgaagtccccttactaaagcgggttgtacttacttctccagagtattcgttattggatacacctatttggttagactctcttcttgcatctgtaaaagaatatgttgtgagtaagatttatgctgagaatgctcaagaacgactgctgcttttagaagaagaacttcggagagtctctattcgagtaaaccttttcgagaaaaaactcatacctacaacttcgcaaactcttaaaaagatagccattttcttaagtgatagaagtattactgatgtgggacaaatgaaaatggctaagaaaaaaattcagcagcataaggagtagtctgcatgcgcgtagatgtggataaatatctatttattggacgtaagaagtctgaatttttctctgcatgtcgagagattggggctgtcgaatttttatcaaaaagtaaactcaaagattcagaaaaagtacgaaagctttctgagggattaaaggttttaaatctgctaactaagagctgttccccagcagatttagtaatcaacgaagtcaggctatttggtaacagagcagttgcttcaagagatctttgatcttaatcaggagattacaactcttacagagtctttaaaagctctaggtaaagnaatagttcgagttaagcctcttggagatttttcatccgaagaaatccgagagttgacgttaaaaacaggtttagcagttcgatttttttataagagacatatagaaggagctcctttagaagtcgaagaagagaatgttttctacttagcaacagcgtacaactatgattactatgctgtgattgggatagtttctctgtctaaggatatctttactgagatagaggcgccgcgttctgtcaatgaattaagagaggaggcagggcatcttcaagctcttttacgtaaaaagaaggctcgagtttgtgagttatatgcttatcgagaggatcttttagaggctttatgtgaacaatgcaatgaacaaagtttacagcatgcagaagctagtgcagaagatctgtttgatgataaggtttttagcgctttaggctgggtgatcgtagatcgtttagatgaagtgaagaaactttgtgatagtttaggcatttatctagaacgggtgcagcctgatccagatgaggtgattcctacatatttagagaatcatggtctgggagcattaggggagtctttggttaatatttatgatactcctgcatcaacggataaagacccttcattatgggtctttttctcctttttcgtttttttctcgatgattattaatgacgcaggatatggattagtttttttagcaacatcattatttttatcatttaaagctcggaaacagattaagcgctctatagcattaaaacgctttctgcagatgtttatgatattagggcttggatgtgtgtgttggggaggagctacaacatccttttttggcgtttctgtgagttacaccagccctttccgggagtattcactaacacattttctggctttgaagaaagcggagtattatctgaaggagcgtcctaagggttataaggaattggtgcatgattatcctattcttaaagagaagaaaactcctaaagagtttcttctagcccaaagtactagtagcggggactcagtatataaagccgttgtttacgataagtttatagataatattttaatggaaatagctttgctagtgggggtagtacatctgtcattgggaatgctacgctattgtagacagcggtattcttctataggatgggtaatctttatgtgcggagatatatgtatctgcctatctatttgcaagccgtatctttaattcattatgctctacatattccttatgaattaggagggttggtagggtattatgtaacgtttattggcttaggggttgccattttaggtggggtaatccaaaggggattaagaggactagatgagataacggctgttatccaagtgttttcagacgttttatcctatttgcggttgtacgctctgagtttagctggagagatggttgggaatactgtgatggttatgagtgaaagattttcccccgcagtaggaattctaattattatcttcgggcacacggtaaatattgcgctttccattatgggaggtgtgatccatggtttacgccttaatttcatagagtggtatcactatagcttcgatggtggtggaaagtttttgcatccattgaaaaaagtaatttatcaaaagtcgcaaaatctttaaatacagaaggtttttgtgcgttttttgaaaaaaataggaaatgtctagtgagaggaaatatatgatagatgtatcagtagtggggcctgtattggctatggctttggcaatgattggtagcgctgttggatgtggaatggctggagtcgcttctcacgcagtgatgtctcgaatcgatgaaggacacgggaagattattggtctgtctgctatgccctcgtcacaatccatttacggattgattttcatgttactgctgaatgatgcaattaaggatggaaaagtctctgcagtcagtggtatcgtaatgggtatagctgtaggatctgcgttattgctttctgcttttatgcaagggaagtgctgtgtgagtgctattcaagcctatgcgcgttcctctgcaaatatatggtaaatcatttgcttcgattgggattgttgagtcttttgcgttatttgctttcgtttttgcgctattgttattctaagtggtgngcagcggcgttctctgctctgtgtttaggaggatgctcgcagcctgcattatcttcgtttttagagtttatagataatgactatacagctgcagctcatctaggtatagatcggggatgtgttacggagtctgtagggcagcagctagttgtcacttgggggctgccttcacgttttagagattctctccctatggttcttcacgtatgggtatattacggtaatggagaggctgccaaattttcttatgatgtgcaacatctttcaggctatcaggtatataccctcaaagagaacgattaccaagatcggcaaggtatcanntcttataaagtttctttgacaaaagatggtaaagaaattttaagtcggagccatcacttatggatggaagtaatttcattaaaagcttttagtcagttgtcttagggcacctcttgcttgatcataatcaagctctaaaggcaatatgttctccgttaaagtcacctcgtactcatagctcaatcggttaattagagatgcgagaatagtcacaacatatggaagtaaggcatgaacgaagatcaatttcctaaagcgtatgaccctaaaagctctgaaactggggtgtattcgttttgggaacgctctggtatgtttgtagcgaatgcaagtagtgagaaacctgcatattctatagtgatgcctccaccaaacgttacagggatcctacatatgggtcatgctcttgtaaatacattgcaagacacgctcattcgttacaagcgtatgcaaggatttgaggtttgttgggttcctggaaccgatcatgctgggattgccacgcaaacagttgtggaaagacatctaaaagcttctcttggtaagcgacgaacagatttttctagagaagaattcttgaagcatgtttgggattggaaggaaaaaagtcaaaacgtcattctttctcagctgcgacagcttggctgttcttgtgactggtctcgtcagcggtttactatggatcctggcgccaaccgtgcagtgaagaaggcttttaaaattttattcgataagggggtcatttacagagggtattatttagtcaactgggaccctattttgcaaacagccttggcggatgatgaggtagagtacgaggagagagacgggtggctttactacattcgctatcaagttgtgaattcagaggaattcattactgttgctacaacacgaccagagactttgctgggggatactgcgattgctgtttctcctgaggatcagcgatacagtcatttaataggggccaaagtcgttgtgccttttgtaaatcgagaaatccctattattggagatttttccgtagacgcatcttttggaacaggagctgttaaaatcactccagctcatgataaggatgattacaagacaggaatgaaccatcaactccccatgatcaatatcttgacttctaccggagagattaatgagaatggaggtattttcacaggtttatctagggaagtagctcgagaaaatattatcacatctttggaagctctcggtttattcgttaaaaaggaagcgtattcatctcgtgtaggagtttcctatcgttcaggggcgatcattgaaccttatctctcaaaacagtggtttgtctctgttgattcttttagagactctttgcgggaatttgtaaatagtgaagaaattcgtatctttcctccagagttcgtacggaattaccttacttgggtaaataatctaaaagattggtgtattagtagacagctttggtgggggcatcgtattcctgtctggcataataaacacgatgagaatgtaatttgctttgatggagaagggggtccagaagaggtaatgcgggatccagaatcttggtatcaagatccagatgttttagatacatggttttcttccgggttatggccgttaacttgttttggttggcctgatgaagacagtttggatttgaagaagttttatcctacagctgttttagtgacaggacatgatattctctttttctgggttacgcgaatggtattgatgtgctctgcaatggtcgatactgaaccattttctgatgtctttttacatgggttgattttcggtaagtcttatcgcgaatatgatgaaaaaggggagtggttttatgtttctggagaacggaaacgtgattatgataaagggaaagctcttcctaagaacgtagttgctaaatgggaaaaactttcgaaatccaaaggcaatgttatcgatcctattgagatgatagaagcatatggagctgatgcggttcggcttactttgtgttcttgtgcaaataggggtgagcaaattgatctcgactaccgcttattcgaagagtataagaactttatcaataagttatggaatggagctcggtttattttcgggcatatttcagagttaacaagtcgtgatttggaagaaggggtcaaccaagatcttcttggattggaagatttttatatcttagatagatttaatgagttgctggatcttatagatgggcactataactgttactcttttgataagatagcttctttggcttatgacttctttaaaaatgatttgtgttctacttatctagaaatcattaaacctactttatttgggaaacagggtagcgatcaacagcgagcaactaagcgtaagcttttagctaccttattgatcaatattttgggagtattacatccaattgttccttatattacggaaactcttttccaaaaactcaaggcaactttaggaactgttgagaatgggaagggggattctgtaacagggcatgcagtcagcatgttgcgttctgaagcttgtatggtagcggaatatcctaaacctattcatgtagcttttccacaaggattacgagaatcatttggcatagcagaaaggctagtttatacgattcgcaatattcgcggtgaaatgcaattagatcctagagagcctttacaagcttttgtgattagctctgagaaaaaggagctggtggatgtctgtattccaatcatgtgtgctttgggaggagtaaaaactgtagagcagcttgcagaagctccaaaggacagtatttttagtttaggggttgtagaaggaattcaggttggagtgattcttcctcctgaacatcttgctaaagagcgtgtacgtttagaaaaagagaaaactcgcctagaaaagagtatagatagtgtgtctaaactattggctagtgaagattttcgtactcgcgccaatcctagtttagtacaagctaaaaaagactcgttaaggaatagtcagagagagttgcaaagcattttagataaactcgcatcgctttaaaagaggctgttcttttgcaacgatacgaattgattaggctgataggcaaaggaggcatgggcgaagtctatttagcccatgacaaagcgtgttctcgtcgagtggctctgaagaggatccgagaggatctgagtgggaatgcgctgcttagaaaacgctttttgcgagaggcaaaaattgctgcagacctcatacatccaggtattgttcctgtatattcgatatgcagcgatggtgaggctgtatattacacaatgccttatatagaagggttttctctaaaaagtttattaaagagtgtttggcagaaagaagttctttctaaagaactagaagaaaaaacctctgttaaatcttttcttcctatttttgataaaatttgtgccacggtggaatacattcattctaaaggagtgttgcatcgggatttaaagccggataatatcttactgggtttgtttggggaagttgttatcgttgattggggagcagctatctttaaacatgccaaagagttaaagctagaacaggatgatgaagctgctgtttcattcgacgagagaaatatctgctattccagcatgaccattccaggcaagattgtagggactccagattatatggctcccgaaagcttgttgggagtagaagcatcggaaaaaacggatatatatgcactagggctcattctttatcagatgttgactttagctttcccttatcgaagaaaaaaaggtcgtaagctgtcttatagagatgttgttttgcctcctatcgagatgtcaccctatagggaaatcccgccttctttatctcaaattgctatgaaagcaatcgccattaatcctgcggataggttttcttctattcaggagttacgccaagctttgcagccatatcttcagggtgatccagagtggacagtaaaagctactttgatggctaaggagaaatcgtgttggaaatattatgaccctatcctactctcacgctatttccctgtactagcaagttcccctgctcaatggtataattttatgctctccgaggtggaaataagtgcttctacgcgtgtggagtataccgttacaaaaagtgcagttcatgaaggaatggggattcttttcctaccttctaaggaggctgaaagaggagagttttactgtggttacggactatggttttctgtccagaatcatgaacttacggtctctcttatcaaaaatggaatagagattcagaaaaaatcccaagagatgatttctcagcaatatcgttttgctattttgatagaaaaatcagacaacagaatcgcagtctttgttgagcaagctttatttattttacatatagactaccttcctagcttaggtaatcgtctaggcgtcattattcaagatttacaaggaatgagcaatattgcgatttcggaaagtataggagctttgcgagtcagctgtttagctgttcctgacgcgttcttatctgaaaagctgtatgatcaagctgcaatcttttatcgtaaaattcgagattcttttccgggtagaaaagaaagttatgaagcacagtttcgtctgggagtgaccttattaactcaaattgaggagcagggcggagatctgacgcaagctcttagttcttttgattatcttcatggaggtgctggcgccccattggaatatcttggcaaagcgttagtttaccagaggaacggaagttttgtagaagagatacgatgtttgttgtttgctttaaaaagatattcacagcaccccgagattccgcgattagaagatcatctttgcttccgcttgtatgatagtttacacaagcatcgcagcgaagcgctagtattcatgttgttaattttgtggatcgctccagaaaagattagtgttagagaggagaagcgtttccttaggattatttatcataagcaacaagctaccttgttctgtcaggtagataaggctcctttgcagtttagatcttctaagatggagcttttccttagtttttggacagcattttccttattccttcccgaactatttcgtagagcaggggaattgcgggattatcaagcgcttgcagatattttttatgttgcaggagtttcagggaacagggaagcatttatgcaattctctacagctttagcgaacgtatccgatgaaatcacattccctgagtctttacacaatcaaaaggtagcggaattaatgttctttgttaagggggtggaggctttgcggaacaaggattatcaaaaagctaagaaggcttttatgggaaagactccatttactttgcagttgtatgctttggatatattccacatacaggcttttttggatgaagagatcgagtctttcatagatcttttacaagctatctatgacccagccagtgaagaggagcgcgatcatattctcgtttatataatacagacccatttatggaatagagatctagagcgagcttataagctattaaatgatagattccctctagacgaagagctggcagagtattcggaagcatttattctttggggatgctacttagctttgactggggatcgtgttgctgttaaagcgcatttttctcgttgccggtataaatacggtaagtcagctttaatcggaaaatgtgtggacggtgatatatttgattatttagataatcttgtctggtgggagaagaaaatgacgctgtttcaaagttactttcttcttcgttgtttaaatgagtctccaagacgatacgaaaaatatcgacaagcttatctttctatggagaacaatttttttgattaaaaaaataaagaaataaaaagccctttcctcataaaggaaagggctttttggcttagatttcgatttgatgagagcttccacagcagtgagctggtaattggcagagaagctgatataagtatcgtaaacaaaagattataggggtgataacaaccatcaaagcagcggcaatggttataagacctaatccaccggcagttgcgattgctgcgttacccttccaataatttgcgcgtctagcgcataagtaaattgcgacacctaatcctatgacaggcagcagagccaaaacaaacaataagttactgtggccaccagttttttgggggggattgggggcggcagttgttgggagagggtgttgaatatttcccggtgatgaaattgaggacataacacatatctccaaaaatatggggccagtacatattactgactggttccccaaggggggttaagaaaactttacttcaaggtctttaccgtctttaacaagacaagtggaccaagatttttaagattcttccggagtgcacctcactattcaacgagttgcgttgccgatacgagaggagttattaaaacattgggaagagcgttatcagtgaagctaaagagaacgtagtattcagatcttgactgtaggtcactctaggtctctcagcagtcgcccatcaatcgttagggcggatatcattacaattttacatggaataaaaaaccttttaaaagattttacactaaccctaaagcttcaattagaggtgtttataattttaattaacaatcttttgttaagaaaaacacataatttctacatcttctgtgatgccgcaagttaagaataaacctctccagctccgtatatgtcggctagcagtgatggctagacgtccttgaagaggatgatagggtggggggaggatttttgtgcaaggaagacgtagtcctagtcgagacaccgcagcattagccatgactatggcatcaaaatttttctcttctaacagctttaagcgagtctggatagtccctcgaatatcggtaataatggcagagggatagagcagagagagaagctcttttcgtctcacggaggagctccctatgcgtaaacggcgaggtaacgggatcgaaaggtatttttcatgaaatacgaggatatctcgaggatctatactggctgtaatggagacaaccgttgccttcggattttctggaaggtccttagcggaatgtataccaagatcacattgcccagattgcaccaagaaatcgacatcatctgtaaaaaaacctgtattttctacagcacacagaggtgtctcttgatcaagatcaccctgtgttgttgtggtgataatctgtccccataatcgagggaaaaatatctgtagttttctcaggcattcgtgagcttgcagaactgccagagaagattgtctagatgccaaacgtaaaggaatgttccctaaacaaaaatcagctaaaaatgggtcattgtagtaagcggacagcatctttaattgtttttactccaataatatcaatttgatccagaaattctttaggtaagccttttatctgcccaaaaggcatcacgatacctttaaaccccataataatgctttcttttatgcggtgttccatgtgtgaaacgtgacgaatttctcctcctaggccgatctctccagtataggtataatttttaggtaaatagcggttatatagggaagacaccaccgataacaccgctcctaagtctgccgaaggttgtgtgattttcaagcctccagcgatagaaaggaagacatcggatgtatataatttaatattcgctcttttttctaaaacagctaagagtaaagaaaatcggtttggatcaaatccggatgtttttcgtacaggattagaaaatggggatgaagaaacgagagcctgaacttctacaagaagagtttcagagccttctacaatagggataatggtagagcctgtagtttctacaattttttcttgtagaaagagacctgacggattttctacttcgcgtaatccatctgtatgcatggataaaattaataattcattggttgggccgaaacgattcttaacagagcgaatcatacggtaattagcatgcacattaccttcaaaatagagaacagtgtctactaagtgttctaggatacgtgggccagcgatttctccagatttagtgacatgtccaataataaaggttgtgatctgtttttgttttgctatatgcatgagctctgcggtcgtttctctcacttgagcaaccgatcctggagcagagcttaaggatggagaaaaaatgatctggatagagtcgataactaatatgtctggagcaatgttatcaatctgttgtttgatgtcttcaagatttgtttctgggaataggaaaatattgttgctagagatttgcaggcgttgggctcgtaatgaagtttgggacacggattcttctccgcaaacgtacaacactttatgaccagctgccgcgaattgtgaggaaatttgaagtagtaaagtagactttcctatgccaggctctcctcccaatagagcgaggctacctcggaccgttcctcctcctagaaggcgattccagccttgagcttgggtatgaattcgtatttcttcctgaaattccacattgtttagtggtatgggaatagaagagctagaggagtaagaagatgtgtttagtttaggagctgttctttcttcgactagtgtattccactggagacatccagaacattgtcccaaccattttggagaatgtgtgccacattctgtacacgtccactgtgttttaatttttgttgtcatgtgttgataacgcctgtttagcagcaagtttttctgcttctttttttgatcctgcaaagccttctccccaaagatccccattaacaaagacttgtacatgataaccaggagagccgtcttcagatttccaaggcaacgctttataagagggaagcacttttagtgtttgttgtgtgaattgttgtaagcgatttttgggattcacgagcatgagaggaagaatagactctttatcaggtagaagagggactatgatttgtctagcaggagataggccgccatctaagtaaacagcacctaaaatagcttcgaacagattagcgtatgcagagatttttcctcgatgactttgcattttttctccgcgaccaatcaagagatgctctcctagagataatttttgtgtgtattcgaaacaagcttctgcatttactagagctgctcgcgttgttgataagagcccctcattaagtgcagggaaaagaaggaaaagatgttccgtaactactaatcctaaaactgcatctccgagaaattccaagcgttcgctatcttcttcagcagaaggaaattcatttctataagaaggatgtgtcagagctgtaataagaagtctgggatgagaaaaagtaaaatttaatttagattcgatagcttggatatctactgtgtgctgcataactattttttaagaatacaaaatcttganagtcaatcgggtttttataggcggaaataatcttaaagtctatagtactttcgagtttattcgcctaaataagtgagtatgagggcagttttacacctagagcacaagcgttatttccaaaatcatgggcacatcctattcgaggggttggctcctgtttctgactgtaaacagttggaagcggagttgaagctatttctaaaggaggttgccgtggtaaaggatcgacatcttcagcgttggagagagaatgttcatcgaactttacccggagtgcagatgatagtcaagagagttcgtttagatcatttagctgctgagcttacccatcgttcacgggttgctttggttagggatctttgggtgcaaaagcaagaagaaatactcttcgatgactgtgattgttctgtgctgctttgcctttccggagaaaaagctggttgggggcttttcttttctggagaatatcctcaggacgttttcgactggggggcaggagatacagcaatcattcttaggttctcctcagcgggatttcctaactaattctttggatttttgtgcatatcccactttctaagttaagcaagttttttacaaaaacagaagcctgacgtatagtcccgttttgtcctcgcttgtatctgtatttgatagagcgtggatgagtgtttcgttctgatcggaaggttgtcttatggaaattcctagaaggaaaatagagggaatgtttgatcctcaaacagccaaaaacattttgtcttggcttgaggatgttgtttgcgaccacacctctgttttaaccctgcttgataatgatcctgagcgattgagagagttatttagtgagacgttgacctttgggactgccggattacgaggtctcatgggaatagggacaaatcgcttaaatgtttttacaattaggagagcaacacagggtttagcccgagtcttaaagcgaagatatccagatgagaagattagtgttgtgattgggtatgatacgcgtcatgattctttcgagttcggacaagagactgctaaggttttagctggtaacggtattcttgcttatttatttcagattccagagcctttggcgttagtttcttattcagtgcgagagcttcaggctaaagctggggtcatgattaccgcttcgcataatcctcctgcctacaatggttataaagtatacatgtcaacaggaggacaagtccttccgcccatggatcaggaaatcatggaagagttccagaaggtggagatggtctctgctgtagagagtttagatcatccatatattcgcatgattcaagaggatatggagaattactacgaggaaactctacataaactgcagttatgcgaagaagataatcggcggcatggttcgttattacgaatcagttattctccactacatggtactggagtaactatgattccgaggatattgaaagattggggtttctcttcagtgtctttggttgaaaaacaaatggttccagatggggacttccctacagtggttcttcctaatcctgaagatccagaagctttggtattgggtattcagcaaatggtagagcaaaaagatgatttgtttatcgcaacagatccagattcggacagaataggggtggtttctttagagaaagaaggcccttatagatttaacggtaatcagattgcttgcttattggccgcacatatcttgagtaaagagtctcaaaaggctcctttgggtgcggaagataaagtagtgaagagccttgtaacaacagagcttttaacagctatctcagagtcttatggagccaatatcgttaatgttggtgcaggctttaaatatataggtgaaaaaatagaattatggcgttccggtatggagcgatttatttttggagcagaggagtcttatgggtatctgtatggctcgtatgtagaagataaagacgctatgattgctgcggtgctcatttctgaggcagcgttgcagcaaaaaatacgagggtgtacgttacgagatgctctgttagagctttatgaggtctatggctattatgctaaccggacagagtcgatagatcttcctatcgatcaacctcagcggaaacaagaactgttggatcgttgggaaacacaggatcctcttcggatgtctttgtcaagtcgtaaattaattgcctttgaaaattacaatacaggggaaggacgcgatttagttaccgatattacgtacaaattatctttacccaagatgtcgatgctttgtttctattatgaaggagattgtagagtaattgtacggccttcaggaactgagccgaaaatgaagctgtattttgaaatcaagcaaagtttttcagaattttctaaagagcgaactgtccgtgaagctcgagaaaaggagagttttgaagctttgcaacaattcattaaagaaaccaagagtcaccttttttactcttagcatcagtacgtaaagatgtggatagctcttgacagtgaatattttattgataatctagagggatctatctagctagcctgtagaaaatagagaaggtggcgaggatagtaaccttattttttaggatggctatggtcttttcttcttatatgcttcccgcattgccttatgattacgatgctttagagcctgtaattagtgctgagattatgcaactgcatcatcaaaagcatcaccaaggatatataaataatttgaatgaggccttaaaaagtttagatgtagcaaacgctactcaagatttaacaaggctaatcgcaatcaatcctgctctgcgtttcaatggtggagggcatattaaccactctcttttctgggagatgcttgcgcctcaagggaaaggagggggagttcctcctcgtcatgaattactaaaattaatcgaaaaattctggggctctttcgatagttttttaaaaaattttattgcttcttctgctgcagtgcaaggatctggctggggatggttagctttttgtcccaaaaaacaagaatttgtggtacagaccacagcaaaccaggatcctctagaggcgacgaccgggatgatccctctaccaggagtagatgtgtgggagcacgcatattatctccagtataaaaatgtgagaatagattatctaaaaagtttcccgagcataattaattgggattatatagagaatcgctttgtagaaatgagcaagcaataattttattattgatcggttaaaaaaattataataaaattattgctcaattttttgtgaagaggatggttttgtgcgtttattttcttacgataaaccaaagatcaaagtgcaaaaaataaaagctgatggcttcagtggctggctaaaatgtacgcattgtagcgaaatgattcatgccaatgagttgggacagaattttaattgctgtcccaaatgttcgtaccactatcggattagtgtttcggaacggatagcattgttggcagataaagattcatggaatcctttattttcggatttacgttcgcaagaccctttgaatttcgttgatacagatacctatcccaatcgtctggagaaggcgcgtaaagataatcctgatagcgaaggggttttagtcggggcctgtacaatcggaagttatcctgttgctttagccgttatggatttcagtttcatggctggttccatgggagctgttgttggagagaagcttactcgtttgatagagaaggctatagactctcggttgcctgttatcattgtctccgcttcagggggagctaggatgcaggagtctgttttttccttaatgcagatggcaaaaacatctgctgctttggctaagttacatgaagccaagctaccttatatttccgttttgacgaaccctacttctgggggagttactgcttcttttgcttctttaggagatgtgattatcgcagagcctaaagctttaatttgtttcgctggaccacgagtagtatctcaggtgataggggaagatcttccggaaggagctcaaaaatccgaattcctattagaacatgggatgattgataaggtagtagagagaaaacagctcaaaacaactttagaaagtttgttaagttttttcagctgtcaggcatattctggaggcaaaggtaattgccccagagatatctctaagaccattaaagagatttttttgttgacagatgataacaaataaaagatcataggcggctcttcaaaaagagggccttctatgaaatttttctgtaaattggagtctggaagctccttacccgagtatgctacttctggagcttctggcgcagatgtccgtgcaaatatcaatgagcctatagctattttgccagggcagagagccctgattcctactgggatttctgtggaaattcctcatgggtacgagattcaagttcgttctcgtagtggattagctagcaagtacggcgttattgttcttcaatctcctggaactgtcgatgcagattatcggggagaaattcgggttattttagcaaatcttggcgaanctacattcattgtagaacccggaatgcgtatagcacagcttgttgtagcaaaggttgaacaagtgtcttttgtcgaaactcaggaagagttaaccgctacggcgcggggaaccggtggatttgggcatactggggaatgttaagatgacttgcgttgctgaccataagcaagctgttactttaagttcgttactttcatcagatttaatcactttcttacattcagatactagagaagatatcctttttgaactttcggagctagctgccagagctgggttactggaagatagggaggctttctttcgtgctctattggcaagagagaatattatgtctacaggtatcggtatgggagtagctattcctcatgggaaaatcgatgggagtgcagatttttttattgctctaggcatccattcagagggtattttgtgggatgctatagacgggttgtctgtgcggcttgtttttcttattggagggccatctgatgccccttcgaaatatctgaaactgttatcggcattaacacaatctttgcgagatgaagccagaagatcacaactcttacaagtgcaaactgttgaagaagttatgagtgttttttcaggagtctagttatggatttgcgattagatcagttagctgtattattggatgtagcagaagattctatccgacaatgggtatcttgtggaggaatccctagttacacgattaacgatgagttgcgtttcaatagagaagaagtagaagactggcttatccacaatcatggggttattccagatgaaaaacgagaggaaaaaggggagtccaaggatttgtcacttagatatagcctatatcgagctntttatanggggaggggttctaaaaaatgttcttgtagatagtaaggaaggcgccctacggtatgctgctcattatatagctaataagttcgagttggatccggtagttctattcgagatgcttatgcatcgggaaagtcttatgtctacaggtatcggagagggaattgctttacctcatgctaaggacttcttgattaacgttgggtacgatattattgttcccgttttcttatctcaaagcattgaatatggagcgcttgacggtaagcctgttgatactctgttcttcttattcgctaatcaagatagaaatcatttgaatcttgtgaataaaatcgtgcacttaggcatgtctattcaagctcgactctttcttaaggagcatccggatcagccacagcttttagcttttgttaaaaattgggaagctcaaattcattaagttatcaataaaaaaagaattgtacgtccaagttgtgaaaaaagctttaatgttgctatggtgatccctaaggtggatctaggagaaagtgccgtcatgctgggttacaagcttacttcgcaacttgctatgctttcgatcttattgactttcacccatactatgggtcatgcaagtcagatgagccaaactcttcctactattatggaagcacaagcggaagaggcattgcaggctgacaggggagtttctggacaggctcttaaaaaacttcgtaaaaaaagatgtgcttctagaaaatctgcatggaaggcttcttttgagaaaaaggatttcttttcttgtattacaaatggattgttctctagaaatcatgagcagcgtttaactgcgaaaaaagagaacaaggctcgaggtaaagagcctcgagtagtggttcaaacgactaaaaaacgacaaacaactcagtctgagaaagaatttttcgattggctatgtaatagtaaaagagatgataaaagaaagcttctcaagaaaaagcctgtaaatacttctcttgctaagagtgaagaattgagtcctaaagaagcagcaatagctgctgctcgagcttctctttctccagaagaaaaacgtcaattgattcgtgagtggttagcagaagaaaagactgctcgtaaatctgggcgtgcggcttgtgcggtaagtgagaatcttaaaagagacggaagtattacttctacattgcgctatgatgcggagaaagctttgactacacgtgtaaaacgcaatgaaaattctgtaaatgctagagcaagacaacgagccgctcttcaaaaagccaagaaagcaaagacggagaaacctgaggctgatgagaaagctgcagaagctgttgccgcagctccaaccaaacaggcgcataaggagccagagaattacttcgcagctacagcttctacaaataatactaatgttatgtcctatctaaatgctcatcaataccgttgtgattcttcggagacggactggccttgctcttcttgtgttacgaaacgccgagctaacttcggtatttctgtatgtactatggtggttaccgtcattgctatgatcgtaggagctgttatcatttctaatgctacagactctaccgttgcgggctcctcgggaacaggaggaggaggctcaacgcaaccataaaaaggttagtctttcaggaatatttagagaaaaaggagagcacagcaacagctctcctttttctttttgtcatttatgaagaaccgttagtgattatctaacaggtattgtgctagttgttgtaattcagagaggatgttcagaagccggtgtgtttcttgattcgctctagctaaatccatcatggttaaactggattcataagatctgtctagagcatgcttttctaggactgggaatgatttttgtgccgccttcagttcttgactcactttttggagtgcagcttgacattctgaggttttataactcatataatcttctaagaggagagcttgttgctcttcattgcaagcttcatcatgcactctccacaaatcttctaatgccaagttctttgtgggtttccatatagagaattttttgtcagaggtttcgtcttccgtatagaattttgacttagcgtcagctcgtcgtttattggcagcttctagtcctttatttataatctcctgaaattcagaatttgaatcattttctgagtctagaagctgcgattctttagttttagcattttcgtcgttattaggaattgggaataagtaagctcgtttctctacttgagaacggagcgcctcatcttgttgtaaagatttattaaaggctgcgttcaatatatcatattgttttgtcaaatcttcaatttttgccttaagattagcgtgttcaataaagaagggctcgccccatctagctgtgatggcttcatctaatagagtttcatgtagatgtgatagtaattgatgctggtaatgaaccatagaggcccagacatctgggctaatggttttttgaatatctttagctagctgctttctattcagaggagaatgttcgagcaaatacttaatgccccgaatcataaggaaagatgccatccccaatgctaaggaagatactcctataacagcgataaaaggcaggctagggggaagaaagacgacaagagtagcgactccagcgagaactcctaaggataaagcgactttcaatactgtatatagtgtgcggctggcatgacttagtgtattgctttgagggaaaaaacaccaccgaattttggtagcatcctaatcatattggatgtgatttggatcagcaaacgattctttttaagtagaggaggggttaaatagggggtataacgttcttctcctcgataaaaatgttctcttaatcgaagaagagagagcattttcgtaaagcgatcggagatctcttcgatggagtgattaatggaatcgtatctggaaccaagaacttcttttaatagttttttttcgggagcttgaatagttaagtcaatctgagacaactgcttatttagagcatctaaggattcccattgattaaaataaggggtgtctgaggtcaggtaattcacatgctcggtcgcattatctaacggaagcgacgcttctagttgtttttgttttcgttgagccagagccttttttgcagaacagataatggtggcagcggataagaggccagacattgcagcaattccaccaacgacagtaagaggaatggcagctcctcccgcagagacggcaataacgcaggcgactacagcgagcagagatagagctgcgagggctatccccgtaatccacatagctttagcaatttgaggatgcttatcggagaacgaatggtgaactttcaaaggaaatgttttaggcgtatgctaggttgatgagctctaaaataaaccatgaaagagattcccccgtaactatggttattattttagaataaatattgttttttacaacaattaatgtttaaattcttttttgaaaaattgaattaatttgtctctttgtaattaagatttaaaagaggcggcttgagaaataggtttttttgatcctatttttttgctaacatgatggccctttgtaatgtgcaaacttcaataaacgaaagcgttttctgggttcattgtgcgtaaaactgtcattgttgctatgtctggaggagtggattcctcggttgttgcttatctcttaaagaagcaaggggagtataatgttgttgggctcttcatgaaaaattggggagagcaggacgagaatggtgagtgtactgcaaccaaagattttcgcgatgtagagcggatcgcagaacaattgtccattccatattacacagtttccttttctaaggaatataaagagcgagtgttttctagatttctaagagaatatgcgaacggctacactcccaatcctgatgtgttatgcaatcgagaaatcaaatttgatttattacagaagaaggtacttgagctaaaaggtgattttttagccacgggacattattgtcgaggaggggctgatggaactgggtttgtccagaggaaaagaccccaataaagaccaaagttatttcttatgtggcactcctaagatgctttatccaatgtacttttccccctgggaggtatgtataaaacggaggtacgtcgaattgctcaagaagctggtttagctaccgccacaaaaaaagatagcacagggatttgcttcattggtaaacggccttttaagagtttccttgagcagtttgtagcagactctcctggagacattattgattttgatacacaacaggtagtcggccgacatgaaggagcccattattatacgattggacagcgtcgagggttaaacataggaggaatggaaaagccttgttatgttcttagcaagaatatggaaaagaatattgtttacattgtaaggggtgaagatcatcctttactttatcgacaagagcttttagctaaggaacttaattggtttgttcccttgcaggagcctatgatctgtagtgctaaagttcggtacagatcccctgacgagaaatgttctgtatatcctttggaagatggaacggtaaaagtgattttcgatgtccctgtgaaagctgtcacccctggacagacggtagctttctaccagggggacatttgtttaggaggaggagtgattgaagtgcctatgattcatcagctgtaataggctctgagccatcgccttctatagctaaagcagaaacagcttcttcttctctttcgaaaacaacgcgttcttctgtgaggcgcgcgcgtaattttctagcttcttgtcggcaagactctttcaatagcatttctgccaaaggatcctccagatactgctccacaacacgtcttaaaggtcgagctcccatttctggcgaatgccctttagttaccaaaaaggaaatcactgaatcaggaatattaagatccatttgatagttttgtaaacgagagcccagcttattaatctctagatggataatctctgaaagagcttctttttcaagaggcttaaagataacactctcatctaaacggttgataaactcaggttttaaatgcttcttaactgcagcatctattttctctttgataactgcatagtccatgtgagaacgaagcccaaaccctatttcaccacttttccgaattaaatctgctcctaggttagaagtcataatgatgatggtattacgaaaatcgatcttacgtccaaatgagtctgttaaacgcccttgctccaaaatctgaagcataaggtccataatatctggatgtgctttttcaatttcatcaaacaacacaacacagtaagggcggcgacggacttgctctgttagatgacccccttcctcatgaccgacatatcctggaggagatcccatcatcttagtggctgcaaatttttccatgtactcagacatgtccacttgaataagagaatcttctcctccaaacatctcaattgcgatttgctgcgctaataaagtcttcccgacaccagttgggcccaaaaataggaaggatcccataggtctattaggatctttgatgcctgttctagaacgacggatagctctacagatactagcaacagcttgactttggccgattactttcttttgtagagtcgtttctaaggttaaaagtttttcgctttcagcttctgttaaacgagctgcaggaattcctgtttgtacggaaactacttgtgcaacagcttcttcatcaacgggaacttgatgttcttccttattggactcccactgttgtttcatatttcctaatttttctcttaacttcttctcttcatcacgaaggctagcagctttttcgtattcctgagttccgatagcttgctctttagcttgttttgttttttctatctcagcttctagacgcatcaggtccgaagttgtcccatcgtattgactcgtacacgagctccagcttcatccaagaggtcaattgctttatcaggaagaaatcgaccatgaacatattggtcagagagtttagctgcagcaacgagtgcttcatcagtgatgaagacattgtgatgctcttcgtattttttctttaaacctctgagaatttctactgtttcatcgacgctaggaggttgaacaacgattttttggaaccgacgttctaaagcggcatctttttctatatgtttacggtattcatctagggtcgtagcgccaatgcactgaatttctcctcgagctagagctggttttagaatatgagaagcatcgatagctccttcagcagctcctgcaccaacaatcgtgtgaagctcatcaataaataagaggatgttcccatgtttacgaacttcatccatcacagctttgatgcgttcttcaaactgccctctgtatttggttcctgcaatcattagagccaaatctaaagtgatcaagcgttttttacgaagagcttcaggaacttctcctgagacaattttctgagcgaggccttctacaatggctgttttccctactccagcttctccaactaagactgggttattttttcttcgacgacaaagaattaaaattaatcgttcgacttctgcagaacgcccgatcactggatcgaggcgcgattctttaaacatttctgttaagtcgtaaccgtacgccttcaaagctgaaagtttttcaggtttatctccgcccaaagtatgacctcctaaaggagaagaagatttcgaagaagaagagctattagtatttctaggagtgatggaggaagagggggggagttgtaaattaaatgtttctaattcttttaaaatctcttttcggatttctttaggatccacgtgcaaattttctaatacttgcaaagccactccatcggattgattgagaatacctaacaaaagatgttcagttccaacataattgtgttctaaaagagcagcttcttcattagcggattcaaaagatttcttcactcttccagtaagagctggatctccgtaaacttgaatctcggggccatagccaatcagcctttctacttcgtgctttgctgtatcgaagtcaacaccaagagtgcgtaatacattaacagccacaccctggcctaattttagtaatcctaacaagatgtgctcggttcctagatagttgtgattgagtcgttgagcctcttttttcgccaacttaatcacttgctttgcgcgattggtaaacttctcaaacataaaaacctgaatggcaaggtggaatatttttcaagcatatacgacatttatgataatgatgcaacttttcgtaaagggaaaggaattgggagattaaagcactttttatagcagactttttttgaatttttagaagcttttttagagtcaggcattatttattttattagatcactgttctgatgtaatatgtttccgtgaaataaacgggagaagttgttctctgtctgtttatttagaatggttatagatatttattgaataatgagaacgcgtgtcattgattctattagaggaactcctaaagatctcatgcaaaaggatcgtttgcttctagactctttaagaaagggagaagtcattcttcatttgtatgagtgggaagggattttccctttgacttatggatgctttattaagcctgagagattcttaaaggctaactgggaatctttaggagtaagcgctgcaagtcgtccgacaggtggtggtgttacatttcataatagtgattacgcgttctcgcttttggtgtcttcagaacatcccttatatcaagactctatcctggcgaactatcatacggtcaatcgttttgttctgaagacaatcaataaattatttggattggaaggttcgttatcacccattgaagtatctactgatcgagcagagtcttctaatttttgtgtggcaaaaacttctaaatacgacgttcttataggaaatagaaaagtaggaggagcggctcaaaggtctgtgaaacaaggctttttgcatcagggctctatctttctatctggtaattctcttgatttctatcgaaatattttgcttccagaccttgtggataagatcggacctgaggtagagaagagtgcttttttcccattagggatggaagcatcctcaacagtattaaaagaagttagaaaagaggttaaagactctttgatgcggatctttatgcaggaggggatttaataaggatgaaaatggcttttttacggaaaatatttgtatttgtagcttgtgttgtctcgttgaatggttttgcgcacactatagctattccggatggagacaaaaaagctaaggttcttattcatgataacggctatgaaatgtacgaacacctgttggccgctattagtagtgctaaatatactgtagaattgtgtccttgtttagcaggaggagagattttatccacagttcttcagcgcttggagcagcgtatggaagaagtgcctgcgcttgtaagctacatattggtccaacctacatgtattgatgataatgatcggaagaatttaaaaactctgcaagaaaattatcctgacaggtttttctacctgttttcagattggccgccgtattgtaatgtatttttccctaacgtgacagagtcgcatactaagttgtccattgttgatgggaagtacatttttatcggaggttcaaatttagaggatcttcaatgttctaaaggggatgtggatttagaagtctctgattcccctcgtgctgtgataggaggagtgcttcggccttcagctatgcgagatcaagatgtaacgattgtctcggaagaatatggagcattgctgagaaaagaattttgtgctcactatgctttgtggaaggatttcactcaaaaactatggttaaacaaaaaattagatgattttagaggcattgatccaatcaatctttctatagaaaaagctagatcctctttctgtgctatgattgagacgagcctttgtgctgtatctgtacctttagataaaatgcattttatcttttccggaccggatgaatcgaacaacacgattgctgaagaatatgttcggctgattaaccaagctcaacattctatccggatagcgcagatgttttttattccggtagcgaaaatatatgatagtctcatggctgcttgctgggatagaggcgtagaaatctatttagtaaccaatgggagaacggatcggagtcccgaaatcactagaagctatgcttggggaaatcgaattaattatttcccattgactttcggttctcggccgcttttgtgggaacgctttttgtattctcccagtcgagcctctatgaagttttatgtgagcgagttttatgtagctaatacacaactgcataaaaagtgcatgcttgtagatgatcatattttagttataggcagttacaattttggaaagaagagtaacgattgcgattacgaatgcattgtggtgattgattcaaaagaagcggtttctaaagctcaggtagtatttgaaaaagatttgcgactttctaaatcagtgactcatgatgacattataaactggtattttgatcctgtacattattgtttagggtacttagaacagagatacatgccatcttaactcttctaatagggagggaggatctgtacagatcctcccttaggtctttgtccatgaaaacttgataataatcttacgcaacaagtaccatgagatattctagagggtctctttctctcttcgtaaaggaattctgtagaagtagttttccttttttttcttaaaaggattgttctcaaaaaaaaagggtctcttgttagcattttttaacaagcatcaaaagaagtttatcggactagttatcgctggcgtttgtttatctggagttggcgtaagcgttggtcaaaccgttaaaaaaacaaacaaattaggatctggtaaaacagtctatagaactccttcgggtaggaaatattctgaaaaagaattccttcttttgaaacattttttatccaatgaagcctatccttttacagggaatcctagggagtggaattttcttaatgagggtttgttaaccgagcgttttctaacgaataagttaggggaaaagctcttcctgagtatatacaagtctggatttccagcttttgataaagagaggagttacgaagggtatcggcgattcgatgctccttttatttcttcagaagaagtttggaaatcttccgcgcctcaattacgagaggctttccatatattccagcaattgactgatccagtctctccagaagggtttgctgttcgagtaaggctgttcttagaagaaaaaaaattccctcactacgttcttagacaaatgctggaatatcgtcgtcagatgttcaatcttccagtcgacaattctttggttcaaggtcgtgatttacgtctattcggatataaaaatgtgaaagattggtttggggataagtacatttcttctgttacagaggcaatgttatgttttatagatgagcaaaaaaagaaggttgggatgccttctttaaaagaagctcgccaagatttttatgataaagcgcagatgcatttgccagacttagtaaacatgctgagtttaatttaacattcgagcagttagtggcctctttttatgcttttatgggggtagaagagtctgattttctcggtatgtatcgagaaattttgttatataaaaaagctcttttatctctggaaggggctgtgagtttcgattactatcctttgcagaagttcttctccatggggaaagattcggtatctgtggagttattccatttaccggatagtttagttttcaaggacaaagaagatttagaagcttttgagacctaccttcatttaacagcttttccttctgtccatgttttagatgtccctacaaaagccttcccaatagaaagggtacgaagtaaagccgagtgtctggttggaaaacgtttcgctgtttcttatcagagcgtaaaactagcggatctagaaaaatatgtgccgatggcgcaagtctaccagtggtatcaaaatcctgaaaattttgaagaaattttattagaattcccagaattagaaacaagctcttctttgcgtgatatcttaaatttgaaacctactatcgtagagaaagcccattcctatgtaagaaaagcaattcttcgtgcagatccagagcggattcaatctgaattagctaagaaagagcggcaagaggaagaacttttcttgtctataggtaaggatcatgtgttaccaggtattcagaacggtgttcgtttagctaatgtgctgatgcagcaagattctgtagatagctatactcaagataatgaacatttctattccattagtgtaatcagtcgcgcagataaggatgaggttttgccgtataaagaagttttgcgcaaagggctaaagaaagttctattagagaaatacaaagcagaagagcgcattagtcgtgttttgacgcatctgcaagaatcttttccaaatagtcagggccaggatttatatcagagacgtttagttagatttgtcaaagctttccaaacaggaaaattagcgcagggagatctttttgggggactagagaaaaccatgaagacgttttctagaggtgatcagggggcccctcaagagttcgaagatatgtttgccttaaaagaaggtcaagtatccgatgtgttattcgatttggataaaggccctttctattacactgctatttccaagtcttgttgtgattatccagtaagcctagataagctattatttgctaaaagtcacttgaatgaggaatttttaagaccctatttggaagaagttttttttcacaaccctagttaaaggattgagtaggactaatatgaaagggcaaaagtattattctgactatcatgtatggatagaaccgattcattctcgaatagtaaaacttggtttatcgtctcaaatggcggganatttagggaatatcttgcacatagatctaccttctgtaggttcttttattaaagaaggggaagagctttgtattttagaatcttcaaagtcagctattgaggtgctttctcctgtttctggagaagtgttagaggtcaacacagctcttgaagatgatattcttcctgttaataatgccacagaatcagaaggatggtttgtggttctacaactcaccgaagatttccgcagcgaaagcttttctttagaaccctagcaaaggcggctattaaccgccatttatgaagccttgggttcttctgagctagaatgtgtatttggttgtgggctatcagtggctatattcatgannaatgcaggtttagatgttgtgggtttggaaatatcaattcctgttaatcccataaaagccatagccatcagtcctgtcgtaatgaaggaaatccctgtccctcgtaagtgttgaggaacatcggagtaagctaatttttctctaatagttgcaaaaagaacgatcgcaagccaccagccacatcctgagcccaaggagaataccaccataggcagaaaaggatagtttcgagtaattccaaataatactccacctaggatagcgcagtttactgcaataaggggaagaaatattcccaaagctaggtaaaggtttctggaaaatctttcgaggagcagttctaaaatttgtgtgaatgctgcgataacaacaataaacatgattaattctaggaagctgagatcaatatttgctaatgcaggtgataaccaagccaaggcgcccggttttgtgataaaataatgtaccaaccagttaatgcttcctgtaattgtaagcacgagagccacagacatccccaagccgttggctgttgacaagcgagatgaacaggccaaatagctacacattcctaaaaatgtggacagcaaaatattctgaataaacgtggcttgtaaaaagatccctaagagatttaataaagaatagtctcccaaccacataaacgctacctctttgtctttggagctctaataatgtttacgatccaaatcatgattcctaaaaggaaaaatgcggatggagctaaaaccatcagacctaggttttcgtatccatcagggtgtgctgctgaagcgtatagaatttcaggaatgacacgaaatcctagaatagttccgaagccaaatagctctctaatgatactaatgcaaacaagtacccacccatagccgaggccagatcctaatccatctaaaaacgctggaataggtgaaacgtgtctagccatactttctgctcgccccatgacaatgcagttagtaatgattaatccaacaaaaacggagagggttttcgaaatagtaaagaaaaaagctttcaaaaactggtcaattaagatcacaaataggctaatgataattagctgagcgatcatccgaacactttcgggagtaattttcctaagcaaagaaacaacaaaagaggagcagccagtgacaaagctaaccgcgaatcccatagttagagctgtagtcaccgtagtcgtaaccgcaagagctgagcagatacctaagatagcgatcaaaggttgattgttgatccacaacgcatctgtaaaataggttaagtaggatttattagtggtcatgagactctccactaggtttagagttggcgaagaaagtcaacaaagcgcggtagggagctagagaatgagagaaggattcggtaacaccattacaagtcaaagtagctcctgaaattccgtcgatggaagaagcagctttaggtgagtctcctaatgctgcagatacagatccttttataacttccagtcctagggttgtcttagcaaaatctgtttctccagaagctgagactagaaatacttttttgcctctgaaatttttttgccattgagggttagcgatatttgctcctaatccaggagtctcgccatgttgataccaagaagtaccaagaacagtattcccgtctttttctagagcaaggaatccatagataggtccccacaaaccaaaaccttctataggaagaactatagattctatagctgttggattttttgctacttgggaagcagataatttagaggaagctgcatcgttgtgtaggatagcgtagaccacataaagggcaagaccatgtattacaggagttggttgagataaaaattcttctagattgagattatggtcttcgaatgaagaaagatttccttgtgtatctgtaagcaagactctaacaaagttttgaaaatatgagcttaaagttgtcacggttactttaggaggagtagaggagatctctagcaactgctttttagtattatatagggctggatgccaatctcccttttcatagacttggaatgtgttatcggaagaaattacttgtgcagccattagcatttgttgattgcgatcgaattccgcagcttgctgttggataggtgcaaggacataatacacagaagacaggagggtcccagcaattaaactaagaacaaagatgaataagataatgtaccaaggctgattaagataatggcgagacttggatgccatattttatattctccgttgtctgtattgcttaagagcaatgttatcaaataatggagcaaacacgttccctaataggatggctaacataactccttcagggtatgcaggattgattaaacgtatgagaattgttagaaatcctataaaagcgccatacagccattttgcaagcttcattgcaggggaagaaactggatcggtagccataaatactagcccgaatgctaagcctccaatacaaagatggcgataggcaggaataaagaactttgcaggagcccaagcaccagcattcccggttgttaagatgctcatgattttaaagaaccatgcaaagaaaaaagcacttagaccaaaagatagcatagttcgccaagaagcgattcctgttaacaaaagaagccccgcacctagtaagcacgctacagttgaagtctctcccaaagatcctagaatatttccaaagaataggtttcctgtagaaaattttccgataccataaacagcctcagtaagggaacaggcagaatcaaagtgtgcaggaagaagccctaaacctccttcggttattggagtagttacaaaattttgaagttngttctaaggaaagttgatctactgttaaacctggataagattctgcccatgtcgcaaattgagtctggagaacatcttgggtaggaacatgttcaagatttaagatattagaggctatggcatcgatgtgaacacgtttgacggatggaggagtcgaattcagaatttgtaaacaagtggattgagaaaatccatcgaaatggctcttctctgccaaagagctcatcgttgcaaggctttctttaattctgctagggttactgccaacccaaacgtctccactcattttagcagggaatgtaaagaatagaaaagctcgtcctgttaaggctgggttgagaatattcattcctgtgccgccaaaaagttctttccccataactactccaaaagcaatgccaagggcagccatccaataaggaatagtaggaggaaggattagcgggtaaagcattcctgttactaacagtccttctgctattttatgcttacgaataatagcaaaaagaacttcgcaagttcctcctacagcatagctaatgaagaggagagggagaaaaattttgcatccagcaaaaaggacggatcctataccgatctcttgtgaaacgaatgaaaaatagctcttaaatccagatatgtgtaanaatgcctccatgattcgtggattagaggattgatagaccagagcttgtagacccgaattccagacggctgcaaagatcgttggcatgagcgcaattacaaccaacatcatccaacgcttgacgtcaacagcatctctaacgaacggtggagaagatggggtgtgtagaggctcgaagcaaaaagtatcaacagcatctgcgataggcgtcatgtgttgaaatttgcttttacgacaaattttccaaagggaatcgacaagtttttcgagcattgtgtctgagagaaaggttgagaacgttacacgttcaaaacgtaacaaattattaaaatttttacgaataaaaaactcggttgtttataggattctaatatttgttattcgacaaatatttccagtcctttgctgcatttgtaaagctccaggaagagagatttgtctatcttgttggcggcgatgtagtaaacgtatttacgataatcgttgtactaggtgtttagaaacgttgaatataggggagatttcggcgatctgttctacttgttcagccttatctccgcatctctctttatatttgtatgagcttatgcctgagacattagctttatatcgttgcgcatgtttagggaatagaagtggagagcagagtttctcgaaagctgctttgagagctctaatactaaatcagtgctcaattgatcggattatcttttcttcaaaagacatagagagaaacattgtggagtctatagcaagatatttgaaagttccttgcgaaaagagatcttggtataggaaaagaaaagctttagactcagcagaaaacatatgcattctttctacttatccttttaatagaagagtgcgcgaagaaatttttagccaagtacccgacaacgcgatttttatgagtctatttcctcttgctcattagagggggctccttgaatagagacataaccacacaggcgtacaccctcatccacacatagacttcctgcttgaatatctcctgtaaccatagctcttccttgaagagatactcttccagttactgtaatattgccttcaacgactcctgctatcacagcttcttcaagttctatattggctttgacatatccttgagggccaacaataatctttcctttagagacaagaataccttcgaacgtcccgtcaatacgaaggagtctctcaaaagttaattctcctttgaaagagactccctcacctaaagtggtttcaggttcttccgggaaggagctttcttgagttgcgagtccttcttgttgatcagtccattgagaatgttcttcttgagatagcaatcgtgtttccgcgggcttagctggttcaaaaatatttgaatgattttctaaacgttctgttctttggggatatatactgtaactcgtggagttggcgccactatcctcatacagagtttggacttcatcaaagaaattttttgcaggtcttttgaacattcctctccccacataagacggtctctgtaaaataatgaaagcttttcaagactacacaaagtgttgtggtgagtctatcgctatattattcttgcataagctaatctgattttttagcagagcgtctttttctattttctgttcaattgtcttgcacgcataaagaactgttgagtgagttttcccaaaagcagcaccgattgcaacaagagaatctgtaattagagtttttgctaaatacatggcaacttgtcgagccaaaggaacatttttagctctggaagaccctttaaggtcctgaatttttacctgaaatactgtagcaacgctctttaaaatactttcgacagaaactttttgtttagaaggtgcgcggaaaagctcttttaaagtatctcggacagttgtttctgttagaggcttattaaataagagacagtatgctgtgagtttattaattgcaccctcaagttgacggacatttccgtaaacatgatctgctatataaaaagccatttcattaggaatatttaatcctttttgttcagctttatgctgtaaaatagcaactcgagtttctaaatcaggaactccaacgtgagcaacaagcccccactccattctagcaatgatccgttctgataatttaagttgtcctggaggcttgtcactagttacaacaatctgtttggacaagtggatcagagtttcgaaggtgttgcagaattcctcttcaaaattttggcggttttgcaaaaactggatatcgtcgacgagaagtaaatctaacgatcgataaaagtttttcattttatcgatagattttacacgtaaatgatgaaccaagtcattaataaaagcttcggttgtaatacagtgtatgcggagatttttatgatgttcgcgaacataatgtcctacagcatgaagcaaatgcgtcttacctaatccgactccaccatgaataaatagaggattatacgatcttcctggacgagcagcaattcctagagctgccgattttacaaattggttggatggaccttcaatgaaattatcgaaacgataagctccattaagcttaagctgaaaatctttattctcttcagaaacttctgtagcaggcttagcgatagacggagttactaaaggagaagagcgtttgatctctgcaacaacgaattctaaggcaggatttccttcggcatcgagaggcacaaaggagcaaagatcttttttatagttgtccaagaggtaactttgaacaaatatgttgggaatttctaatcgaattttttcgctagattcttctagtacttggataggagcaatccagttttcaaaggctgttttagagcagcgggttttaatataattaacgaactgctcccacgtgctgcaatcattgcaagttaacatcgcgttctctttatcgcttgaggaattaaggattcggtaatgcaccctcctcctggagaaaaaccgcaaatgtagcattgctattgataagcaatcaatacatttcgttcaaaaatacgcttaaggacaagaagtttttctatcaatttttcctgaaatcagaaacaaaattattaatactcaataatagaaggagaatctctcaagaagagactttttgcttctccccaggatgaaatgcattatcgaacagcaaccaaggggggttttacataactaagtagtaatgcttcggcatcgtctgcaatgataggatctggacacgacgttaagtaggaantatcgctgatgcttcttctatgcgtccgagacagaatagagctttagttttattgagcagggaagggaggtgatctccttgcatacgtaaagcttgatccaagacataaagagctttggtattttcgctaatctgcaaatagagtcctcctagtgtttggaaatcatatacacttagagggtctaagataacgagagcttcaaaaaaaagaattagcttttctgataatgcccttgacgaaggaacgaatatccagaaatgcggagctcttcgagttcttcgtctccccatcctaaaattgctttccactcattatctaacatatacgcttaaccttgtacgaattgaaaaatacgagaaataacataatcgataaggagattagaactcttgattccttgatccaatgctctaagcaatactgtgccttctcgtactaaaaacttcctcttctgcttcaagctcttcctgctcaaaatgttgtccatttctcttttgatcagaggagcgtttattttttcgtgaaagcgtgtcagctgttgagcggtaagaaaatttacctctagttagaacttttaaataggaagagattttttccatgtcttggtcttgtttatcaggagagccgagagatggtactaagtaaggagtggagaatcgttgtttatgaaaattggttggaggagaaaaggacgcccagcaagtttttttatttgtttgcatgagcgttgataacgcagaaggcttgggtgtcatatctaagatttgagcatgcttagctatgtcccgaatcctgcgccttccatttggatttctttacggaagtcattaacaagcttgttcgtagagctgtgtttctcgtataccgaggtactatagttaaaaatttcgaccataagtttcccttgagaggctcataatctcaatcataatcgggggagggaaaaagtcaagtatggtagaggggagaacgtaaagcaaaggtttttaaggtattagatgtaataagttgctgtttgaggtgtattgaaaagctgtgcttttaactaaacatgcgatacactgcaaccttctgctttagctacaagggaattttttgaaagctgtactttcgcagctaagcggcttattgtagtagtggatggataataacttttatgcagaaggttccccgtgaccgattcaattcctcatattcctgttttagtaaaagagagtctttcattattccgcggtcgtaatccagtagtcttttgtgatgtgactgttggtgcaggtggtcatgcagaagcttttttaaccgaatttccttcgatagagcggtatgacgggtcggatagagatctgtctgcgctggcgttatccgaaaatagattacttccttttaaggatcgcgtgcgcttgcgacatgcttcttttgaagaagtggatacactgacttctgatgggacgtatgatggagtgcttgctgatctaggagtatcctctatgcagttaaacaaccttgaacgtggatttagttttcaaggagaagatcatcctttggatatgcgaatggatacttctcgaggaatgactgcaagtgaagtgcttaattctttaagggaagaagagattggagaaatttttcgtaactacggagaagagcctctttggaggagtgctgcggcagctgtagtgcattttagaaaaaagaaaaagattttgaccgttaaagatctaaaagatgctacgtctggagtctttccttcctatcgattgcgaaagaaaattcatccactaacattgatattccaagctctgcgcatttatgttaatcaggaaggggctcaattaaaagttttgttagactctgctttccgttggttacgtcctggtgggcgtttagctgttatttctttttgtagtttagatgatcgtcctgttaagtgggcttttagagaagctgaggctagggggcttggtaagatattgactaaaaaagtgataatgccctcttaagaagaaaccaggatgaatcctcgatcacgttcagctaagttgcgttgttttgaaaagagttttgaagataagtaatgaataggtatcggttttcgcgactacttgtctgtttaagtcttttgtgttgcgctctttatcggtatatagataaacagaatgatcttacaaaacttcgtttggaaatcccttgtttatgggctcaattgcgtcagatagaacaagaaaatgttgcgcttagttttttactagagaaattagaaagccctgaacatttgttgcagatagcttttcttccagaataccagtatctagagtatcttagcgaagagaaaatcagtgttttagcttatgaatcaccgtagacaattaactctgatcgttgttggggttttgtctctatacgcgctcttaatagttcgttattacaaaattcaaatttgtgatggagagcggtgggctgtggaggcggcgaatcaacacgagtttcgcgttaaagatccttttcaaagaggaaccttttttgctaataccagtctgcgtaaaggcgaaaaagagcaatttcacccgttagctattgatatcactaaatttcatttatgcttagatgctgtcgttattccggaagagtatcgcgatgagattgctcgtatggttgttgttatggttggcgaaggggactatcagagtatccgtagtgaatttgatagaaaatcgcgttatcgcaaactgtacgtttctctagatgtttctattcgtgatcggattttaagttggtggaaaccttacgcagttaaacataaaattccgtcaaatgccttattctttattagtgattatcaacgttcttatccattcgggaaattgttaggacaggttttgcatacttcgggagataaaagatgaaaaatcaggagaagcattccctacaggaggtttagaggcttattttaatcgtttgttagaaggggaaaatggagaacgcaagttgttgcgttctcctttaaaccgtttagacgttgataaggtgactaaaatccctagggatgggagcgacatttatctaacaatagatgccaatgtacagacgattgcagaacaagagatagccctaggcgtgttagaagctaaagctcgtagtgggcgagctattgtactgaattcacatacaggagagatcttagctttagcgcaatatcccttttttaatccgagagagtatagggaatacttcaactgcaatgatcgcatagaagatacaaaagttaaggctgttagcgatgtgtttgagccgggctctattatgaaacccataactgttgctattgccttattagcaaatgaagagatgcaaaaacgtgctggagaaaatctttttgatccttatgaaccgttagatgttagtagacgagtatttccaggacggcaaaaaatgcctctaaaagacattgtcagtaatcgatacttaaatatgtacatggcgattcaaaagtcatccaatgtgtatatggctcaacttgcagatcgtatagtacaaaagttaggtgctgattggtatgaacagcgtttgcaagattttggttttggaaaaagaactggaattgaattgccggcagaagctgtaggattggttccttcacgaaaacgtttccataaaaacggatctcccgaatggtctttatcgacaccttattctttggcaatgggatacaatttgctggctacaagcatgcagatggttcaagcttatgcagtttttggtaatggagggtttttgatacgtccaaccttggttagaaagattgtttctccttcaggagaagaaaaaatactgtcttcaaacccaaagaaaattcgagttctttctgaaaaaatagttgcaggatgttgttcgtgctatgcgtttcacaacatgtttaggagggacggggattcgtgctgctactaagggatattctagtgcagggaaaacagggacaacagaaaaattagtcgatgggaagtatgataaaaaacggcacattgcttcatttatcgggcttactcctatagctgctttatcggatactgcagttcctttagttattcttgtttctatcgacgatcctgcttatggagtaagagaagacagaactaagaactatatgggaggacggtgtgctgctcctgtattttcgagaatagcttctcgagtgctgccttatttaggtgtgccattagacgagcaactacacacctatcgtgaagaagtttctcaattaaagctgctatatgaggaatggaatcgcaaatagtgagtttatttagatatgagtgaatgtgttgaggtctgttgctttgggatgagtgtgcagcctggcataaggaaagcgggagaggaaactaataataaagaaaagagcaatttcataattatatctcacaaacaaaacatttctttgctccatataagagttactttttttgtgaaagagtaaaaagacgagttctcttgtctttgctctttctctgacagatgacgtagttagtcgacaaagcttgacaacgaatatgtgtatagtaaactatttgagaacgctttttgaagcccttgtgtgcgtgtcttagggatctggtatgcatttagaccaacttcttcggaatattccggctaaaatttatgggaaagtcgagtctattcctgttagaaatttgactcgagattctcgttgtgttggagttggtgatattttcatcgctcgacaagggcagttttgcaatggcaatgactattcttctcaggctgttgcgaatggagcgattgcagttctctcttctctatacaatccttttttatcggttgttcagattatcgcagaagatcctatagcattggaagcctctttggcagcaaggttttataataatccttcaaagcatctggatgtaataggaattacaggaactaatgggaagacaacagtctcctgtttggttagagaacttatggagcgttcaggaataagaactggtcttattggaaccatagagcacattttaggtgagaataggattgttgatagctttaccactcctgatgcgattttattgcagaagtattttgctgaaatggttaagcagaacttatctgcagccgttatggaagtatcttctatagggatggctcttggtcgagttcgtgaaacagagttcttagctggagttttaactaacattacttcagatcatttagattttcatgggtctcttgaagaatatattgcagctaaaaagcagtttttcgcttccttgccagagaaaggtatagctgttgtcaatttggattgtgagtatgcgcccagctttttaaatggttctcaggcaagagcagtctcctatgcaatccatcaagaagctgattatcgagcagatagattgaagctgtattcatcaggatcttcttatgacatttggtatcaggggaaagttttcccttgtgagacatccttgataggagaacataatgtatataatgttttagcatctttagctgttgtccatcaatttttaggcggagactttgctgatttagtacgcgatgttcgtttcttatcagctcctaaaggacgtttggatccgattttattggggccattccctgtttatattgattatgcccatactccagatgcattggacaatgtatgcagaattttattacaactccttcctaaatatggtcggctaattattgtgtttgggtgtggtggagatagagatcgtgttaagcgtcctcttatggccaaagtatctgagcattacggtttttcttttgtgacttcagataatcctcggacagaagatccagaccagattattgctgatatatgtaaaggtttctcaactgatcattatgttgttgagagtgataggaagctagccatagagaaagcaatatcaatggcttcagataaagatattgtactagttgcgggaaagggacatgaggggtatcagatcttcaaacatcagacgattgtctttgatgatcgagaggttgtgtgtgaagccttggcagccctttgttaatttgacattattgctgttgctgcttactttaagtagtccagttagttgttttgctgatgctgcggggattcctaaggtaagtaggaatgaacttatagtcatagatcctggtcatggcggtaaagacgagggaactgcagataaggaattacggtacaaagagaaaactttggcgttgtcgatagctttaagcgtgcaaggatgtttgcgtcgcatggggtataagacgataatgacaagggctacggatgtatatgtcgatctaagtaagcgagctgcaatagcaaatcagaataaggctgatgtttttgttagtatccactgtaatcactcgtctaatacatctgctttaggaactgagatttatttttataatgataaaaacatattaaggactagaaaatcagagagcttaggtaagcgatcttggcttttatgcaaaaaaatggagctttacgcgaacgtaaagtgaaagaaggtaatttcgcggtaattcgagaaacaaccatgctgcggtccttgtggaaacagggtttctttccaattctaaagagcgagccgctcttttagatgctcgttatcgctcgcacttagccaaaggtattgcagaaggcatacatgcttttattttgaatcgacaagttgacaagactgtatcagtaagctcaggagcaaaaaaagtgcataaataatctgggggagggagggctttaacaagacctttaagtgctcgaaaggatattcgtagtggagaaggtttcggttgagtgcaactcgtgggtagattttgtgcgttcatggaaaagataaaaaaagtcttgaatccaaaggatgaatgcatattatacgcatatattgcggtatttagggacgcaagggttaccactttaactaggaggcaacaagctaccatggcaacgatgactaagaagaaactaatcagtacgatatctcaagatcataaaatacatcctaaccacgtgagaactgttatccaaaattttttagataagatgacagatgctctagttcaaggggatagattagagtttagagactttggagttctacaagttgtagagagaaagccaaaagttggtcgtaaccctaaaaatgcagcagtacctatccatattcctgctagaagagctgtgaagttcactcctggcaaaagaatgaaacgtttgattgaaacaccaacaaaatcttcttagtcttcttcccttttcccggctttgctttcgatcgtagagtcaggcttcagcgtaagcaagcttgactctaaatttcctcaagattattttttgccattggacgtctttttattaactatgctagtagaatcgcagttagggttagaggacgtattagaggcgttctctgagaggaattttgatattcaaagtaagagtctcatagagtctttccaggataagaagctgcgaagaaccgttatacagcgttttctacatcatccattgttacatattcatgatatcgctcgtgccgcttatttgctggcagctttggaagaaggggtagacttaggataccagttcctttgtatgcatcagacgcagtctggagcggctttattatttcgtcgagcaggttttttatggggaggccttccttatcctggggagcatgctgagatggctatgctgttgtctcgtattgcagagttttatgacacaagctacgagcaagttcaaaaaatgatagcttttcaacacgcattattttctcatgagagaaacattttccctgcattgtggagtcaagaaggctctagatccaaccaggaaaaaacagctgttagtaaattgttattttgccaaaaagaagcccgtatagaagatcagttcacgctaacagatatgtctcttggtttttggatgcgcagaacgccttctttttctgcttatgttagtggtagtggttgtaagagcggagtgggggcttttttgataggagatgtgggggttctcaactatggtccttgcgttggggatccaggagaatgtttgggatttggtttatgcggccaagtgaaagagttctcatgtcaagaaaaggacgaagaagtatcaatatcttttgcaggagctttgtcacagccttcttccaggagaacaggcttttcttatttgcaagatgctttgtttagcactaattcatgttatcgtatagacattactgagcaaaagtgtcatgttgcttcttctttggatagggaaaatcaggatgcgttttttgctatcttttgtaagggatcgcaatgtcaagtatgcaatggtccaaaattgcgtacaggatctccagactcttataaaggcccagcctatgacgtattgattaaaggagaaaaagagactgttcggattttatcttctagtccgcatatggaaattttttctttacaaggcaaagatcggttttggggaagtaattttttgatcaatcttccctacacacaaaatagtataaacattttatttgaaaaggcttgatttctttttaagagaaattaaaattgtttgcgtgaaacaaaggtcattataatcaaatagttggtttttggttgtttttgatcattgtttgtattaaaataactcttttttataagaagggagcgtgctacggtggaactacttcctcatgaaaaacaggttgtcgaatacgaaaaaacgatcgccgagtttaaagaaaaaaataaagaaaacagcctgctttcttcttcagagattcaaaaattggataagcgtttagatagattaaaagaaaaaatttattccgatctcaccccttgggaaagagtacaaatttgtcgacatccttcgagaccgagaacagtgaattatatcgaaggaatgtgcgaagagtttgtagaactttgtggagatcgaacgttccgagatgatcctgcagttgtcggaggttcgcaaagattcaangacagcgtttcatgcttatagggcaagaaaagggttgcgacacaaaatctcgtatgcatcgtaacttcgggatgctttgtcccgaaggctttagaaaggctctacgcttagctaaaatggcagagaaattcggtttgccaattatctttctcgttgatacccctggagctttccctggattaacagccgaagaaagaggtcaaggttgggctattgcgacaaacttatttgagttagctagattagctaccccaatcattgtaattgtgattggtgaaggatgttcaggaggcgctctaggaatggctataggagatgttgtagcgatgctagaacactcgtattattctgtaatttctcctgaagggtgtgcttctattttatggaaagatcctaaaaagaacagtgatgctgctgccatgttaaaaatgcatggagaggatcttaagggatttgctattgtggacgcagtgatcaaagaacccataggtggggctcatcacaatcctgcggccacatatcgtagtgttcaagaatatgtccttcaagaatgggttaaattgaaagatctaccggtagaagagttgctagaaaaacgatatcagaaattccgaacgataggtctatatgaaacttcttctgaaagcgattctgaggcataagaagcatttagttttattcggtttttctcttttatccatattagggctaacgataacgtctcaagcagaaattttttctctaggtcttattgctaagacaggtcctgatacgtttcttctttttgggaagcaggagggagcttccttagtcaaaaggaaagagctgtccaaagatcaacttcttgaacagtgggataatattgttggtgagggagacacgctatctttgcctcaagcgaatgcttatattgcgaaacattcaggaggctctcagtcaataacaaaaaggctttccgcctatctctctggttgttttgacttttctcgtttgcaatgcctcgcgctttttctagtagttgttgctattttgaaatcaacaacgctattttttcagaggtttttagcacaattaattgctattcgtgtgagctgctctttacgtaaagattacttcttagctttacaaacgctcccgatgacattctttcatgcacacgatatggggaatctaagtagtcgtgtgatagcagattcatctatgattgcattagctattaatgcccttatggtgaattacattcaggctcctatcactatgactttagccttagtagtgtgcttgtctatttcttggaaattttgtgcttgtgtttgtttagcgttccctatttttattttgccaattgttatcattgcaaagaaagttaaagcattggctaaacgaattcaaaagagtcaagatcattctgccgctgcgttattggattttcttttaggtattcttacagtaaaagtatttagaactgagcagttttcttttagtaagtattgtcagaaaaatgatgagattgctcgattggaagagcgcagtgctgtgtatagtttaattccaagacctcttctgcacactattgcctcgttgttctttgctttggtcattatgatcggtttgtatcattttcatatcccacctgaggagcttgtggtcttttgtggtcttttgtatctcatttatgatccgattaaaaagtttgctgatgaaaatgcgaatatcatgcggggatgcgctgctgcagaacggttttatgaagtattggatctagcaaagcagcagtccaatgtttctgaaaagttaaatgaattccagggattacaacatagtattcagttttgtaatgtatcctttggatatgtagaggatagtcccgtattatcggatttcaacttagtattaaaaaaaggggaggctatcggtattgttggtccaacaggatctgggaaatctaccatagcaaagttattgccaaggctttatgaagtctctcatggcgaactgttaattgattcacttccgatacaaagctactgcaaaaattctttaaggaaacatattggttgtgtgctgcagcatccatttttattctatgatacggtgtggaataacctgacttgtggcagaacctttttagaagaagaagtatttcatgctttaaagcaagctcatgcctacgaatttgtttctaaaatgcctcaaggcgtgcacagcttattagaggaatccggtaaaaatttatctggaggtcagcagcaacgtttgacaatagctagagcattgctgcataacacctccattctgttgctagatgaggcaacatcagcattggatgccattagcgaaaattatgttaaagagatagtcgggcagttaaaaggccgttgtacacaaattatcattgcccacaagctctccactctcgaatacgtagatcggattgtttacttggaacaagggaagaaaatagcagaaggaaccaaagaagagttattagactcttgcccagcttttcaaagaatgtgggtcttatcaggtgctaaggactgggaactcaatgccgtcgtaaaatgatggtccgtggaagggatgtgttaaacatcaataaacgaggaatatatcggaaagatagcctccgctaatttttgagagagcttgactttgttattttttaagaagtcttgtccttcccgcgtagtgtagtcagaagatactttaatcatagaacatgggcacgctactaacgaagcctgttttgctatgaaaaatccttccatatcgactagctgtaaatgttcatgaaacccatctctatacggagatctgactgatgtcaattgtgctagagggagtctagggatgggggttacttcaagttcttcttccacagaagttgttggagttaattcttttacagaggtaatcgtataagttttaagaagaggtatgtttggattggctgctccggcaaatcctgcatttatccacaggtcatatccacttggaggggggcttaatgcttgaacaactcctcggtaaccccatgtttttagtaccataacatctaacagaacgttttctgtatggtaggtataaaagttctccttattaagagaaaaaggaaacagagagagtgttctagcagcttctgccggatcagcaaaaataagaaggagcttaaacattacgacaagccgtccataatgtagaaaaagcttgccgtccgatagaagagaggttaaaggtttcttctgttacgtaggtatctataaaatgttgaatggtagttgggtttttatctcgagagtactcagaagctttttgaatagctaaagcagaatcagtcaaagatttttttagggattcttgaagagcatgacttaacagataagaatcgtcatcagatacctttttagagataacaatacatcctaagggtaagggaagatgccaagttttttcccaaagttgacctagatcttctactatgcatagatctttagggaaagagaagcgttcttcgtgaatcacagctccaccatctactcgattagaaagaatagctggaatgatttcatgatatttcataggaaccagttctgctcgagggtagaagaggcggcaaagagcgtgtgctgttgtcgtttcacctggggtagcaaggctttttaatggggaatcgagttgtttcgaaagaattaaaggcccgatcttgtatcccagagtagtgccaacatttaaaacatcataggaatcagcgatctgtgggtataagcttgcagaaattttaattaggggaaaacgagtctctaaagcgtaataatttaaagaagaaatatccgcgatcatgatttggcgtaacgaagggaatcctttatgtttttccaagaaagaccgaaaaagaaagatgtcattaggacagggtgagaacgctgctgaaaaagtcatttcaattgctgataggcctcaatggctgctttaatttctttattttctggttgtagcaagtaatcacctttttgtaaccaggcgatgtaactagaggggacttcagaaagaggtttccctttatacttaccgaaaggcattttaaatatgcgaggatgacaagtctcatttagtagatcataaatttgatcaggagacaaatctcccactaaagctgaaaatactctataaagagtgattacgtcatctaatgctcggtgcgcttgattttcttcgaatccgtatacctgacgaaggtattggagactatgctgaggcaagtcggttcgatatttttttgcccattttaacgaatctatagtacgaagctgaggctcagataagccgtgtctacgacattcacgaactaacagaggataatcgaaagcattgttattgtgagctacaagaatattatctgtaccacaaaattcgataaatttctgataagcttctgggaatctgggggcgtcggctacttccgcagtcgtaataccatgaattttagttgcctcagcaggtatagggatttcagggtttactagcgtttggaaagactcgctcgtagtcccgttgtaagcagctagctccactatacgatccttatctatctgcgtacctgtcgtttctgtatcataaaaaattaaagctggcacaagttcctctaanggctctagctgatcggattggttattttctagttttgcttgctttttcaattcatccagatccatgtttcctgtcgagatcaatcctattgcatggaagaagctatcacaaatcaacttgattgtatcaatgtaaacacgtagtaagtcctcattaatctcgccctttaggcaagggataactagacggtagaaaataatgttttgttcctcatccattccaaatcctggaatgtcgatgtcgcggttgacgagatgtaaaagccttgctgtggtatcacgttgattctgctgtatttgataagggaaatagcagacaagttgcaaaacttctccttcattacgaataacgaaaaagaggggaagctcatgttctcccgcagggactgtgatatagattaagccgctttctcgttctaaagaaggttctagctgagcatgggtcaggaattttgtaagattattgtgattcaaagtccacgttgtcattgtacgaatcctctaagtacgggttattaaaagggaggcaacttttgatacccaactatacttaagtgttgttttttcggcagagtaaaatacttctgtttgatggggggaagggagaataaaaatttcttcttcccatcttttggagatagaccctctttacacaaacttttttttgaaaaagaaacagattaacaacctttttatacagataaaagtttgctttcttttttaaaagaatctttgctatacctccgagaatcttaagcgattgatttatcaaccgtctatggaaattccttgggcggagagggcgtgatgattgttgcggatttcgaatactttggattgagtgatgttggtttagttaggcacaacaacgaagatttttggcaggtaaactatgattcgcagctcattgccattgcagacggaatgggaggtcatcgtgcaggagcagtagcttcttatgaggctgttggtaatcttatgcagcttgtcgatttacataaagtagatttggaacggtttggagatgagcagtataaagagtctataaagactatagtatcagaggtaaacttattaatttatcgccagggattgtcgaatgaggaattcaaaggtatgggaactactttgagttgtatgcaattccgaagaggtaaagcttggctatttcatgtgggagattgtcgggtttaccgattaagaaataagatgctagaaagattaactgaagaccattctcttgcgaatcacttagcttctcgatatgggctttcaaaacaaagtgtgaaaaggtatcctggaaggaacgttctgacaaatgttttgggaagtcgtccccatgtgtctcttgatattagagagatgtcttatgagaaagaagacctatttgttttttgttctgatggtctaactagtgctgtttctgatcatgacatgctagatatattaacgcagacgactactctggaagaaggtgggaatatccttatttccttagcaaacagtcggggcggtagagataatgctactgttatactggttcggatgcgttaatttttatgactatatacttagatacgaacgcttcagctcttttagagcctggcgtcttgatgtgtttacattctcttttcataggcgaaggtgggttcgggaatccttctagcgttcacagttttggaaagaaaaccaaaaaattggttaaagaaacttcaactcttatagaaaaagctctggggtttagtcattgtcgggtgatttatacttctggagcaacagaaagtcttaacctggcaattcaaaatattcctacaggaagccatgttattacttccagcatggaacatccagcagtgatcgaacctttaaagcaagcaaagctttccgtgacttacttggaccctattcctggagagtgcgttgtttctttagaacaaattaaagaagctgttcaatcagatacctcagccatcgttttgggatgggtgaatagtgaggttggtgtaagaattgatcttgaagctatagccgaatttgctaaagaacgccaactacttttgatagtggatgccacggctattgtaggaaaagaagttattcacattccagagggagtttcaatggttgctttttctggacacaagtttcacgctctttcgggaatcggagtccttcttacatctccaaaaatcaaaatatctccaataatttctggaggaggacaacaaggaggtattcgttcgggaacggagcatattcatggtattgcttccctgcgttatatttttagcaagttattagtcgagcagcctgccatagctcaaactatgcgttcttatagggatctatttgagtcgcgtatacaagaagctttccctgaatgtatcgtgcattgtcaagacaagcctcgagttagcaatctttctgcaatagctttccctggtttagagggagaagtgatgcaaatcgctttagatctagaaggggtggcttgtggttatggctctgcgtgttcttctggagcaactacagtttttaagtcattaacagtaatgaaagtgcctcaagatcttgcagtagctactctacgattttcttttagttatttactttcagaagaagaaattcttacagcagcacagagggtaattcgcgttgtaaaacacttacagcagtacgcgtaatcgttacagagtgtctttgatagcaacagttttgatgccgtacaaggaaatctcttttacctctaacagtaggtcgttgataatgatagaggcgcctacttctggaggagtatccagaagttttaacatgagttgctcaattgttgtacaatcattatccataaaaataatatcgagctcattttctatttcagacaaaggtgtgttcccagagaaagttcgttcaattaaagaagttggtttgggttttaattgggtgatatttcttgtgttgaataacgttttaaacaccgtatgtaagcctaaaactcccataggctcgccattattatttaaaacaatggcgattttagaactattcttgcggaattcttggatcgcatgaatgagcttagatttggctgttatgaaccagggagagcttaggtaagggacaacagggtcactgggatttcgattaatgaggttttttggaaaagctattcccactacattctttttaactttatggtaaacagggacaaaatctaaacgatggcgacgaacgagctggcaaacatctcgtacggaagcggtagctgaaagtatagggatttggtccaaatattgacatacttgctctacagaagttgcgcttaaagagaaaatatttgtagctatcacattgaaatcatgctcttcatgatgagtttctaatgtcttttgcaattcatctcggctaagcgttgagtggatcgtctcttccttaatattcagaataaagtagatcatattggtaatgccaccgacacattggatgagcggatagaaaagatagtgagcgaaatagaggataggggctccttttaaggcgattttttctggaattttacgagagatagctaaaggaattaattcagcaaaaatgacgactaaaataatttgcgttgcaggagcatattcaggagaaatccctaggagtttgtaacaagttcgtgatgactcagaccctatttgcaaagcaatatttactcccaacattacggttccaaataagcgataaggtcttctaataaggaagttaatgtaagaggcttttttattgcttttcgtaaggtagtattgcaaccgcacgcgattgaatgatacgcaagccatttccatcatggaaaagaacccttggacaaaaatacaaaggaggttcactcctaaccagaaaaagggagagttagtttccatgggttttccttatatacacccgtttcacacaattaggagccgcgtctagtatttggaatacaaattgtccccaagcgaattttgttcctgtttcagggatttctcctaattgttctgtcagccatccgcctatggtaacgcaattagctgtagtaggaagatcaactccaaacaggtcatagaaatcagaaagctcataggtgcctgcagcaataacaacattcttgtctgagtgagcgaattgtttaaaagatgggcgattatgagctacctcatcagagactattttaaatagatcattttgggtaatcaatccttctatagacccatattcatcaatgataatacctaaaccacagtcttctcctgctagatgatacaaagctgtcttagctgatactgtttcaggaatgtagtgaggtttacgaaggagaggcaagagttcttcggcagattgtaatttttctttgtagagaagaagcaattttgcagaacaaactcctaagagattttgtagaccacctttacaaactagaactttggaatagctttgtttaggtccagagaagagtttatataaattttcaatcggagtaaggacatcataaaaaatgatttcttgtttgggcgtcatgcgttctttaatgctaccttcttccatggatagatagccaaatagaagacgactttcctcatgatttacaactccgaaatctttacagcttcggaggacttcttttaattcttggggttgaataaaatcactttcttgacgggccaacattttctgaacgataaaattgatacccgagatagcccaatcaaatatagggcggaacttttagttgaggcaaagatgattggggttacaatctttgcaattcgtgcattgtaagggattgcgataaccttagggacaatttctcccaaaactagtgtcaaagcgaggggaactcctacggtaagcaatagagatgccgaatcgcctactaaggttgctatgcagttttgcactccaatattaatccctatgtcgaagaagactagggttatgagcaaatgattggggtaggccataagattggcaatttgtcggagctgcctattttttgagtgactgtaatgagcaataagggaagaagggagcgagaataaagctatatgcgataaagaaacaaaccccgagcacaagacaaaaattgcagttagaataacaattgctgaagaaaacattcgatttgggttattgtgagcggacccggattattctcattatgtataaaaaatactagaagaattccactttttctcttcggctacgggttcctcaactgtagcttaggattttccgcttgagagagggttttcatagtttttttattaactcttgcaccacccatttttttgaaggagtatgaattatggaagaaaaaggcatcttacaattggttgaaatttcgcgagcaatggctttacagggagtttgtccttggactaatttacagagtgtggagtctatgttgcagtatatagcaggggagtgtcaggagttggctgatgctgtacaagaaaataaagcttcgttggaaatcgcttcggaagccggagacgtacttactttagtattaaccttgtgcttcttgctagaaagagaaggaaagcttaaagctgaagaagtatttgtagaagccttggctaagttgcgtcgtcgatctcctcatgtttttgatcctcataatcaaatttctttagaacaggctgaagaatactgggctcgtataaaacagcaagaaaaaatttcttaataaggatttagggaaagagacttgagagaaaactgtatttatggtaccaaagatcccgtgagctggggacctcttaagatgagagacttctgaaccgggtcaggatcggaaggtagcagccctaaggataggccttttgtgctaggagttttctctggcttacttttttattctctatctatcctttttgtcacatccctcttttttttataaggacagtaacgctagttggcaactattgaacaggatatgcagggtcacaggagcggcgatatgccgtaccttctcgtaaataaagccagcgcataaagaaaagacaaacaaagttggcacaaagatgaagctacctaaagaagcttctatgtgcgtgatagcaaagatcaatgaacttgttacaacagctttacttctagaaaatgtatttttgaagaaagtttggagaattcctctaaaaaagatttcttcagcaataggaatcagcatagctatacagaaaatatagagaaggtccggtctagttgataggctgttctcgaatttcttccgtaatcacctgctcttgaaaaagttgtttgggcaaaatgagtggcaggacaagctgtaataatcgtgcaagtatttgtgtagcggtaatggtaataacccacatgcgagcaccagctcttatggcaagtaaccatgaagttgagctagttgttcttcctgcatacaaaatagattgggtgataggagccggtaatcccaatagtaaaaaaagaaaggcactaaagacaaagatgccgtgaaaagaggctttagaaatagaggaaagaggatctccggtggggagcagagccggtaaaagcaataacactgcccccaagcacactaagctgaatggtaaatgggtatgtttttcaggctttggccatacaaaaaacccgttcgcaaggaaaattgaaattccaacaaaaactaatagaagtcctagacccaccatatatcaagagtagtttgcgcagacatatccctctacgcgagcaacaatctctctaaataatctctgatgcatgaggcccatcggagtcgaatcgaagtttttcgaacgccagccataacgatgataatcgttgcttccagaggcgagagattgactcgcgtctaaaatctcttggtatatcatagagactttattgtgacgaatatcaaacactcgcacacgaacagatgctgaaatagaagggtttaaaacatcttccgttgttttctgttctaaaatttctgccgcaactacgaattccgcaggcaacagctgagtcgctaattcgggcgaaatattaggagtaggagaaaaaaattgtgcagcaacaccagctgaagcgtgntgnntgattaaaagtagtttatcagaagagtgcaaacgtctgctaatctcttcggaaaactctgcttgtaaattccaagggagtagttctgcagacttttctgttcgataaaaaacaggtagcatggcgacgactcctttagccttgctccctttagtgtatagtctagcattgtagctgccagaattagatacagcacagctagaaagagtagtcgtagttaaagacaaaaggccgaaagaagcaagtaaccagaattttcgcataacgcaactcagtgaaaaaattgattcgattttatgtccctagcaacactcttgtaagcttgcgcaaaagacctgaggaacttatgtattaaggagaactctagcatgagtattttcaaaaagcaactaatatagctgacgagagagaaaaccgtgcgaagatcttttttgcaagattgctagcaaaaaatttttggcatagtcttttttatttagaaaagtttttctttttgagagaggtgataaaaacgtgatacattgggaccagtctagaactctcttatctttcccgcgagttgggcttcatttatcgtggtacggaatcttattttctctaggaatttttttatcatctttttcgggcatcaagctggcaacagcattgtgtaaagacagggaggagaaaaaagaactccgaacaagtctggaaaattttgctttaggagctcttttagctatcatcattggagctaggcttgcttacgttcttttctatggagggagtttttattttgaaaatccttctgagattataaaaatatggaaaggagggctttctagtcatggagctgtgatctctgtggtgatttgggcagctgtattttcgcgacttcatattcgtaagttgcctatgctttcagtaacctacatttgcgatctttgtggagcagtgtttggttgtgcagctttgctgattcgcgtggggaactttatgaatcaggaaattctaggaacccctacatccatgccttggggagtgattttttcgaatggtggaggccaaatccctagacatcctgttcagctttacgaaggccttggttatttagtgctttcttgtattctgtgcaggctttggctatcgtggtgttatatcgtttgggttctggctatagtgcagcaggcgctttaattggggtagcagtaattcgtttttgcgctgaatttttcaaaacacaccaaggagcatggcttggcgaagaaaacatattaacaattgggcaatggttgtctattccgatggtttttctaggagttggaatcatttggattgctagtaaaaaaaaatgatgcaaagtctttgaatatatattgctagcgtccacatctgaaagcgactctacattaaactttttgatgtagagaggggggatggttattttccaagtgcatggaaaagacaccctctaataaaatgacgccaagttacatagtatgaagctccgttcggaagagcagagttgaatctcttgtaagcaaaagacgattctcgacaagaattggagaggttttgtctttctgcaaagtttttttgattagggaattaaagcaaccttgataggaacgaggcttccctccccatagggagaacccacctcggatgagaatgaataaacgaacgttattatttgtttccttggtaagcgcggcatttttgggctgccaaattttcttcggttatcgagacttgaagtcatgccaggatcttgcagaaaagcagcgagctatttctgagcaaatattagcttcaacagagcaattgagtgtagtaccttggacagcttctcttgaggagagcgaatcagtcaatcagtatgctattcgtttggggaatcgtttattgctgctgacaaaagggggatctcatcctgaagtctattccagaggaacttcttggagtctgatagaacagaccagtacttttggagggatccttgtttccctctatggagaaactgggcaagaagttttgtcgaaaggaagttctgtatatctccctaatcaaagagatgctttcccggttttagtagcagaatttcgtagcaatcaggagcctcttgttttcctaggagaatataaggatgggaagattgcgaataaagcgggcgctatctacggcacatcattagtttttctcaataccgggaatgaatttgtacctttaggtatttataattctaaagaagagtgtgttgagtctttagatctccctatggcacgggctgtagtctttgctgataaagaaaatcctacagcatctggtagctactacatgctctccaatgaatacatgcaaattgtagtttctcaagaaagtggagctatcgagggaattaatcttccttttgcttctgatcaagaagagaataaaagtattgttaatgagattgggtttgatagagagttagcaattaactctccttcagaagcctctttccccggagtcgaaactatcgattctcaacgtcaaaacatagcaaatgttgtgggaggctattatcctttactcagacgtggaacgctatctgatgttaaaaagagagtgcctgcacaatatcaagcttaaaatattgtttcaggaagagaattggcttctcctgttgctaccggctttcgtgttgtttcattcgataataaaactttaattttagagagcggggatggtggaattagaaaaacctactcgctgggagagcagccttacgcctttgagttagagattcaaactactcaaggacgagaagatttgtggatcacatctggcgttccagaagttgagattatgtccaacgcttttgttccagctgtgaagtatcacgctgtgaagaaaaataagagtgatctctttaatgtgaaattacctaaagctaaggattctttgctggtacggaacaacgcaactcctcaatggattttgaattctaatgggtactttggggtaattctaacccctcgaactcctattccagcgggctatgcttcttcttttattccagggaatgtagttcctacacggctttctcaacttcctccgaaagatcaagcttatcctgcttcgaaatatcctggctatacggcaatgctacctttgcctaaggaagctgggcgttatcaatttatggtatatgcagggcctctagccgaccctactttaaaaactttagatagactaacgcgaattctaaaggagaaactcctgagtatattgatgcgattgctttcagagggttctttagttttataactgagccttttgcagcattattatttgtcataatgaaattctttaaattcctcacaggctcttggggaatttctattatcttattaacgatcgtactgaagcttttactctatcctttgaatgcttggtctatccggtctatgcgtcgtatgcaaaagctttctccttatattcaggagattcagcagaaatataagcgtgagcctaagcgagctcaaatggaaattatggctttgtataagatgaataaagttaatccgataacgggttgtcttcctttgcttatacaaattccatttttgatagcgatgttcgatttattgaagtcatcgtttctattaaggggagctagctttatccctggatggatagataacttgacagctcctgatgttctcttttcttgggaaacacctatatggtttatcgggaaagagttccatcttcttcctattttgctaggtgtagtcatgtttgctcagcagaaaatttctgctgtgaaacgatctggtcctgcgtcagatcaacaacgtcagcaagaagctatgggaacaatgatggcgttgttatttactttcatgttttataatttcccttctgggttaaatatttactggttctcttctatgttactaggagttatccaacaatgggtaacaaacaaaattttagatgaacaacatctgcagcatgaagtaattatcaataagaagagatagagaataccgaaaaggtaagtagtactgttttttaattagaatagttttatcaaaactatttagctgagatagttttatgcgagcttgggaagagttccttttgcttcaagaaaaagaaattggagtggataccgtcaataaatggctgaggtccttgaaggtcctatgctttgatgcgtgcaacttatatttggaagcgaaagattcttttcaagtaacttggttcgaagagcatattcgtcataaagttaaagctagtttaattaataataatgggaagccaattcgcgtgcgcgtgacttccctagataaatctacaccgtttaaggatactcagatccagcaagaaaagactgcatacttcactatgaagtatggggacattgatccgaacatgtcttttgctaattttcttgtgactccggagaatgatctacctgtaagaattcttcaagaatttgctaaggtttctgaacaaggcaaaggttttccttttaaccctatttatctgtttggtcctgaaagctccggaaaaacacatctgatgcaggctgctgtgggaggacttcgtgaagctggtgtaaaaactctgtatgttacatcagagctatttacggaacacctggtgtcagctattcgttctggtgagatgcagcgtttccgagcgttttatcgtaatgtagaagctctgttcattgaagacatagaagtgctctcaggtaaaggagctactcaagaagagttcttccacacattcaantcgttgcatacagaaggcaagttgatcgtgatttcttctacctttgctccaggagatttaaaggctatggaagaacgattaattagtcgctttgagtgggggatttcgattcccgttagtcctttaacaagagaaggattaaaaagttttttagaaagaagaatagaaaaactgaatattcgtatagaggagactgctttagattttctaattcaggctctatcatcccatgtgaagtctttgttacacgcattaacaactttagctaagcgagttgcttataaaaagctttcacatcaaatgctttatcaaggagacatagaggctttattacatgatgtattgcaggctgccgagagtattcgtttaactccatccggtattgttcgtgctacagctcaatattatggcgtttctccggaaagtgttctaggtcgttctcagtccagagaatatgttttacctaggcaggtcgccatgtttttgtgtagacagaagctttctttgtcatatgtaaaaattggggaagtgttctctcgagaccactctacagtgatttcttccattcgagctatctcgcaaaaactagaagaagatgatagagagtgcgatgtttcttgtgcgatacaagaattaacaaagcgactttcatcagcttatcaaagtttagattttatagaagactagaggtaggaggcaggcaattgcgccgcctccttgtacaccgttcgggaattatactacgcctttgaagtaatcgaacaagtaggcacgtcgtgcttgaataggtcataaagtttaaaggcgagagcggctgcaaaagctatttgggtaaccataataagaatcgttgtagttccgagaggcagagttgcagctgccgcaataaatgtaacaatagaaaggataaatcctagtccaaagaggaatcctagtgcatagcgagcaacttttgctgcacattccgactttagaacagaggaagaagaagcagcggcgctctgatttgcttgctgcgtattcagatcttgtaaggtaaagacgttccctctacttccccaacagccataatcatgaggtttgatacccataaagcctccttaactaaaaaaggcgaacattttacttgattttttaccgaatatcaagaccctctgcagtatcgtctgttgagaatagaaatctttcttttaatattaatatttcttattcacaagcaaacaaactctttacatgagaagcctctatgtatttcgatcggacaaagatcaatgttgaatctatgaagcaagctatcctcgaaagggtatattgtggggtagtccagactcctcaatcggcatcaaccagagatatttttatagccgttgctaaaactgttttggaatggatggctaaagggtggttaaagacacaaagcagttattatgataacgatgtaaaacgagtgtactacatatccatggaatttttgctagggaggagtttaaaaagtaatcttttgaacttaggtcttctagatttagtgaaagaagccctctttgatttgggctacgatttcgatcaactggtagaaatggaacatgatgcgggtctcggtaatgggggattaggtcgacttgcggcatgttttcttgattctatggcaacactagagattccagcttatgggtatggccttcgttacgattacggtattttcgatcagaagatagagaatggttttcaagtcgagtcccccattgaatggttgcgttatggaaatccttgggagatttgtcgaggagaatacttatatcccgtacatttttatgggaaggtaaagcatagcatcgactcaagaggtagggatgttgcagagttagtggattcccaggaagttttagctatggcttatgatgttcctgttccaggtttcaataatgatacagtgaattctttacgcttgtggcaagcacaatcgcgtcatggatttgaatttagttattttaaccacgggaattacattcgagctatcgaagatatagctctagcaggaaatatcactcgcgtactttatcccaatgattctatttctgaaggacaagagttacgtctgaagcaagagtatttccttgtatctgctacgatacaagatattctgcgtcgttatactaaaacacatttatctctagataaattgtctgaaaaagtctcagttcagctgaatgatacgcatccagctttaggcattgcagaaatgatgcgtttattagttgatcgtgaagagctggattgggatgttgcctgggatgcaaccacaaaaatattcaattatactaatcatacgattcttcctgaagcattagagagatggtctttagatttattttctaaggttcttcctcgtcatttagaaattatttatgaaattaatgcacgttggctagcaaaagtatcgcagaaatatcctggagataatgataagcgtcgagctctttctattatcgaggaaggaagttctaaatttgtaaatatggcaaatctagcagttgttggaacgaataaggtaaatggagtatccacttttcattcgcaacttataaaaagtactctatttaaggattttgttgagtttttcccggataaatttatcaatgtcactaatgggattacacctagacgttggttggctctttccaataaaaagttaagttcgttattgaaccgaacgataggcacagaatatttaacgaatctcacgcatctacataaggtaattcctttagctgaagatagtgggttcagggaagagtggcgtaatattaaaatccagaataaagaggaactagcagctcgaatttataaagaacttggggtcactgtaaatcctcagtccatttttgattgccatattaagcggatacatgagtataaacgtcaactaacgaatattctccgcgtgatttatttttataatgaaatccgtaatggatctggagagattgttccgacaacggtcatttttggaggtaaagcggctcctggctatgctatggccaagctgatcataaaattgattaataatgtagcagctgttgttaaataatgatcctaaagtgaacgatcagctaaaagtcatcttttggccaaattacagagtttctttagcagaagctatcattcctgcaaccgatttatctgagcaaatttcaacagccggaatggaggcttctgggacagggaatatgaagtttgctttgaacggagccttgacaattggcactatggatggtgccaatatcgaaatggctgaacatatcgggaaagagcatatgttcatttttggtcttctagaagaggaaatctctgagctacgcaaagaatactatcctcaaggcatctgtaacgcaaatccaacaattcaagaaattcttgatatgattgcgcaagccaagttttctcaagaagataaggacttatttaaacctattgtaaaccgacttttaaatgagggagatccattctttgttcttgcagatttggaagcctatataaatacacagaaccgtgttgcaagcttattcaagcaacctgaagagtggacgaagaagtctatttacaatgtaggggggatagggttcttttcaagcgatagatcaatcgctgagtatgcatcgaatatttggnatgtttcccgaccaacttcttagaagaaagaagggaaacattcccttctttaattgagaagtaaaacagaaggagcttcgaggagtctctgcagtcgtttcatgaacatggctgcaggatatccatcaatcactctgtggtctaccgacaatgtcaacatacaggtcgagcctacagctagctctccatttaagactacaggttgttcctctacgcttcctacagctagaatagcagcttgtggaggattcaaaatagcagtgaaatcagagatccctgtcataccaagattagatacacagaaagaacctcctttgtattcttcttctgcaagagactgctgtttggctttagttgcaagtcctttgatttctgcagagatcataccaatattttttctatcagcacagcggacaataggagtgataactccatcaggaatagctacagcaatagagatatcaatcgtagaaaaccgaataatcttattgtcgacactattgaatccagaattaatttctgggaattctttcagagctaaagcacaggctcgtacaatacaatcattgatagagagcttaatattttgttcttgaagttcttttaataatgcaagaaggggggaagcgtaaatgcgctgccttacataaaagtgaggaataaaggttttagcagcttgcagacgtttagatatgacttctcgaacaggggaaagaggttcttctatataagatcccggattaacatttggagcttcagggtaaccaaacccagcaattcttaaaggaggagctttttccaaatctttctttatgatccgtcctccaggtccactaccagttactccagagaggtctagattttgctctttggccaatttttttgctaaaggagaagctaatactggatcgttggaatgtttaatagttagaggagtagctaaaggtggttccggacggaatcccatcatagttatggaagggccacttgtgtattgagaatctgtttgagcagagtcttttggcgatgcttctgtagctgcatctgtaacaacagtttcttccaaaggtaggagctgttttaaatcatattgagcattttgttctgttgaaaatacagcgataggagtgccaataggagttttggttccttctttaacaagaatttctaataaccaaccatcttcagaagctgtatgttctaaaacagctttatcagtagagatttctagtaatacatccccgaaatgaatttcatccccagcttttttgtgccatttaacaagaatccctatttccattgtaggggagagcttaggcatttttaacaaagaaaccacaacgttacctcataattttttcaatggcatccaggatgcggttaatatttgggagagtcgccatctctagagttttattatatggcataggcgtttctttttgacagactcgtagaggaggatgatctaggtagtcaaaaatatgttctgtaatcgtcgtaatcacttccgcagatataccacaaaaataatgcccttcttcaacgacaagacaattccctgtttttttgacagaagtgaggagagtggcaacatctaaaggtttgatcgttcgtaagtcaatggtttcaatagagagtccccatcgttgttttgctgttttagcagcttgctcaacgatagaaaccatgcggctatgcgaaatgattgttaaatcttttccttcttgaacgatacgagctttcccaatggggatcaggtattcttctgaagggacctctcccttaagattgtagtctaattcattttctaagaatagaacggggttgttatcccgaatagcagatttaagaagtccctttgcatcggctggagttgatggagcaatgacaattaagccaggaatattggcataaagagcttcaacacaatgagaatgttggcaagagacttgcgcagcagctccattagcgcctctaaaaacgataggcacagcaaatttccctccagtcatataatacatttttgctgcatgagaaatgatttgatcagcagcaactagagagaagttccagctcataaattcaataattgggcgaagtccagttagcgctgctccgattccaattccagagaaagcagcttcgctaatgggtgtatcaataactcgagtgggtccccatttatctaagaggtttttagtaactttataagcaccattatattcagcgacctcctctcctaggatacagacgttaggatctctggtcatttcttcatcaatagcttgtctaatagcctctcggatttcgagtgtaacaaaattaggcatagaccccctcttctaaagtagctacagctggttctggatcaagacgagcttgagcgactgcttctaggacagctgttttgcttgtttgacgcaaatctttaaaatcatcttcggataggacattcgcacgaatgagccattcttttgcaaaaaggataggatctcttttgagaagacattgcatttcctctttagagcgatataaattaggatcggaaatagagtgtcctctaaatcgagaacatagcgcctctacgataataggagaacctgtttgttgcatgtggtgataagcttctctaaatcctataagcgaattaaataaatcgaatccattcaaagtgatcgaaagaaagaccataagaaatcgcttgggattctgctataggctgtttagcaatggctctatgtaaggctgttcccatactccatccattgttttcaataatgagcattaagggaagggagtgaagcgctacaaaatttaatgtttcatgaaagactccttgagctacagctccatctccaataaaacacatagatatagaagatgagttttggtacttcatagaaaatgctgcacctgcagccagaggaatttgtccaccaacgataccaaaacctccaggaagacgatcaccacacatatgcatagatccgcctcgtcctaaagcacaccctgtttctttccctagaagttctgctgccagttgtcgtaaagggatattccagcagcagagctactccgtgacaacgataagaggaaaaaaaccagtggtctttccctgtgcaagcaatagctgctgtagcaacagcttcttgaccgatataagagtgataaaatcctccaacaaggccttctaaataggcctcttctccgcgaatctcaaattcgcgaatgagtagcatttttttcaaaaggtcaatgcagaaagcatttccgaagttttcaataacatgaaaaactcnggcttctgtagtttcctcagaagctatgttgagagtcagaggatgcatagattctcttggataaagggttcctgaaaaattctagaatgtctttcaaataaatcttttgaatttcactctggctatgcaaggccggcgcgaaaaagtaaccggaaaggtccggccttcgcaaatataatatatactgctgggcgccaagtctatgctacaaaaaaaaacttttcggcactacccagaaaaatggatagagatgaagttggtttgaagttttgaaatttcattttccttgttcagaaggccttataagggggttttctatagagttcctttgttgcattttaacagataaaaaaatacaatatccgctcaaaaattttatttgtgtggagttcatagtgaattctttctttggtatcctacctcgagggattcctaatgtaggcggattatcggaagtcgctggagaaaataaacaatctttggaagaaagagagcaagataaagaattaaaattagagaaaaaacttttagctatccggaaaagaatcaaatgtttttgtcctcaacagcccgaaatctcggtgcaggcagcaccattaaagcatacgggaacttttccttgttccgaagaagaattacgagatattagtgatttattctcctctttaaagtcttttagacaacagttagcacaactgtttttctatacgcctcctttgaatttagaatgggaagatttcttaaagtttttctttgcttttgagaaaagggagttgggcggtattttgttttctgccggaccttttgaatcgttcgatagatatttatatcaggtgaataaggcaagacctgttcccgtattgatagctacaacggtttcctatgcgctgcaggcctattgttcatacatcaatcgggcaccttttcaagagaaagaaaatttttttcaacttggagaagctgttggcatttttcttaaagaacgaaaggtgtctattgctctgatgtataaggaaattttagatttagataacaaacagtattccgaattgtgtcgagggcttcagaaatcacaaattgttcaaggagaggtgtttcattcttctactcaagaacgggatggtttaaatcctatttccgttaactatgatcttatggggaccatagcagccttgtcagtaaacatagatagatcttgtttaagattctctgggagccatattttccatgatgatgaaatggctatagaaaccctacataaagggggagacgttttcacgttctcgtcgttagctgaatttcaatttagcgagaagcgtttattgcatctagtctctacagggagagtgtgtccggaaattatccggaaaaagcttattaaggtattattgctgaaaaaaagagctctctgtaagcctttttgcaggcatatccaaattacatcagagacagctcaattaaattaatgttgttctgagagagcttctaatttctggactagtttctcaagtgctgcgatacgttcttcgagtcgtggaaggttgcgtactttggctacttggcgatgaatttcttgatatggacgagcaggcgctccgccatagatccctggagaagtaatagatttagtgacgccagtctgagccatcataatgacatgatctgcaatgcaaatatgtccggttatgccggcttgtccaccgataattacatgattgccaatctttgtagaacctgcaattccagcttgagctacaatcatgctgtgttgaccgacctccacctgatgggcaatttgcacaagattatcaattttcgaaccttcacgcacaacactgtgtttaaaccggcctctgtcgatagttgtatttgcgccgatctctacgtcgtcttcaataatgactttcccgaggtgttttaaatgtttgtgctgtccaaaagcactagtaacatacccgaacccacaagagcctataacagctcctggttgaataattactcgtttcccaatagagactcgttctctaataactactcgaggatggatataagagtgttgtccaacggttgaataagctccaatgacgctacccgacccaatatggcaagcagatccaacatgagcatgctgacaaactacagcatagggctcaatacaaacatgatcttcaataatcgcagttggatggataacggctgtcggatgaatacctgggaatcctgagtcaacaggagtaatgaataattctaaacacttttgaaaaactagggaaggagactcagaagtgataagaaagtttttattcaagtctcgatatttttgaaactgtgttcgagatatgatgatagcgccagcttccgatgattttaaatgtttagcatatttttcattatctaagaatgtgatgtgtgccgtttttgcttcctcgatctcttcaactccggaaagaagagtagctccatttccttgaaactcgactttcaaaaaatcagctaattgttcaagagaataagtggattgagacatacggcactcctcggctagttcgcatgttaattattttgaaaagaatcatcaagaactttaataacagcatcggttttatctgccgaactatcgatagataagacaatatcttcgttaagaaggactgacaagccttcttgaatacgcacagtttcagaagcttttttcacttcttccataatcttttgcatgcgcttgagattactttggtttaatatttggtaatactgcccttgagctgtgttgtattctgcagatagatcttcgaatttttttcttaattcggcagctgcggtctcggatagaccttccatgtaatcgtcgtcttggagcttggaatagatagaagacagttcttcctccatcttccccatgctgttagagaattggtttttcatcttttcgaattcagcagattcttttttcccaagagcagactcttctaggcagcgacgtaaattaacgattccaattgtgcctgtagaattagctgcaaatgtaggtagagatgacaaagacattaagctaagtaataagaactttttcataattctttcctataaaaaataccaataggtgaaaggagaaggatgctctccttctcctttcggattctagaatactcctcccaaggcaaagaagaatctttgagatacatcaattttttcattattgaggatttctgttgggcggaacggccaaccccagcctagcataattggcacattattcatcatatcaaagcgtagaccaaatccagcgctactgcaaaggtctttcaggcgaatagtgtgctcttctatcccaatgaatccggaatctagaaatacaaaggcattaatgcaaggttgagaaatcaaaggatattgaaattcttctgttaatagtagggaagacaagcctccttgtggttcagtaggagaaaacttcggtccaataataaaaggtttgtaaccgcgaacagtggtttcacctcctaagaagaaccgttcgctgacaggaatgccttgtgcagttgttgttccgaaaggtttgataaactnagcttctgcacggnctttcaaaacaccttttttagttaataagcgatagatagaaccactagctgttagtttagtaaattggtaagttccgcctaaaccagataattcanagtttaagaagctgcggattcccatagtaggttttctaggattatcaatagaatcatagagaacattgagtcccgctgcggaaacgaatcctttattactgtctaaatctggtccaagtctattagagctggacgtttttttgcgcaaacttaagcttgtttggctaccacggtaatacatcccatattttaacttatcgttaagaatgtaggtggtactgatattccctccataggtatccacagagtagtcttttgataaagctttattaattgatttatctaattctactccaagaatccaaggggtatttaagaagtgtggtttcgtccatttaacagtgtaatcggtgaccttatctcctaaattagcttttaggaagaggtattctccaccacctcttaaagatttgaatccttttttgagaaagtttcgggctccaaataaatcaaagttgctttctgcaatttctgctcctccaaataaatggtcaatggagctgaatcctaagaatagcccaagatttcctgtttcagtctctttgacttcaatgaaaacatctcgataaaggtcgttagaatcgagaggatctaattgggaacgaaccgtatagacacttacacttttaaagtagccggtgttgcgtaaacgagtctctgtatcttctagttttaatctataaaaagtgtctccagggaaaagactagtctcatgcaaaatcacatcatgcttagtatgagtgttccctttgattttaattaacccgattttgtagggagatccttcactcactcgataggtaacatcgtaaacaggtagagtggggtgcgctgagaaggagacatcaacgttagtgttcacgtagccatatctagcgtatgcgctacgaatcttttgtgctccagtccaaattttatctgggcaatataaggagttaggtccaaccaatagttgtttatcgagcagtcttttggataacgctgtgaatccttctatatgtacgtgacctaatgtgtataaaggtcctttgtctacaacgataagcaaagtaatgtttcctttagcatctgtagagacctctttgcttactttagcatcagcatatcctttattttggaagtaatttgtgatagcaaataagtcttgctctaccatgtccggatgatacactccggcaccagtgaaccagctcgttgttgtggagtattgtttagttaaaacaatgtcacctaagtctgatgcttctgttcgcgtaattcccgaaatcgttaatttttttatgcgaccgtgacgtccttctttaatctcgatggaaatatcgataaagccctctttctcattatgattatgagaataggagagttgagaatcgtagtaccctcgtttcaaataaagagttcttagcgcatcaaaatttttaaagaataattcccgatcaaaaagatcatttttataaagctctaaagttttcagaattttatgagtggggatagcttcatttcctgaaatattgatctctctgataacagattttgccgtcagaatcagagagatcacagcttgtccattacgaaactctacgataggctctactcgatcaaaatttttcgaaagtgttcttagatcttcatcaaaatctgcttgagagaacaacgtcccttgctttgtttttattttaggaatagctcgtttattttgagtattctctccttgagtcgtaatggtgatagactctacgaccatacgtccttctgaagttgaacagaaagaactttgtgaaaaggtgagcaacagtaaaacagcgagttgcagaatcgtttttttgcgtattccaagcattattacttcctttatctagaaaagtctgcgctagggatgaagttttattcttactctttctgggaagagcaccattcttatttggtcagaagccaatctcataggcgtccccacatattaggaagagactactcaagacctatccaattacaatagagaatcgaggataatttgactagccctacaaatataggaagaaaagagaacagagagaactttgaaaacaacgaaaaaaagcccgaaaagcaacccctctagcaggttcgggggagaactcagaggggtgctggtcactagcaaaaactagataaaccgcctcaaatatactccaaaggtctttttttgaaaaacagtttcgcttttgagagggtgcttaaaagcaatttcttcctgaaaaagctcgagctaaagtattagcatcaacaaaatcaaaggagagaccgacaggcattccaagagctaatctagagatttttattggaaggtaagaaaattcttgtttcaaaaacaatgcagttgcatctccttccaaagttgcgtcaagagctatgatcatttctttaggggaacaagcttcaattcgctgcttaagaatagctaatttttccaaagacaaatgctttccagtgatgggagaaagtaagtttcctaaaacgaaatagtgccctttgaagatcttagatttctccagagcgaaaacatccttaggagttgcaacgatacataaggaagaagaatctcgagattcactgcaaaagttacaaggggaagtttgagagatttttaaacaaaaacagtttgagcaagttgcatgcgaagtagagaactcttgtaatgctagagccatagcctcaatttgagatggatcccattctaataattcaaaagctattttttctgctgatttaaagccaattcctggaagcttttttaaaaatgaaatgagtttcgaaatgtaatcaggatattttaacatgtcttttaagcctatttaggtctagcacctagataatcgattatgaggatagatgcaaaataaaggttagggtataaacctccctagcagtatacttggttttttctttttgtttgcgggtgcgtgtgaaaaaagatgtgagagcttcgatctggggaactggttcgtatttgcctaagaaaattttgacaaacgctgatttggaaaaaatagttgaaacttctgacgaatggatttcgactagaactggaatcaaggagcgtagaatagcttctgctgaggagttttcgtcttttatgggggctaaggcggcagaaaaggctatagaagcggctaaaatctctaaaagtcaagtggactgtattgtattttctactgccgcgcctgattatattttcccttccagtgctgccttagctcaagcctatttgggaattaaggaaattccagcctttgattgcttggccgcgtgtacagggtttctttacggattgtccatagccaaggcatatgtcgaatctgggatgtatcagtgtgtgcttgtgattgcggccgacaaattgtcttcctttgttaactatcaggatcgtaatacttgtgtgttattcggggatggagggtctgcatgtattgttggtcattctagaccaggagctttagaaatctctaaagtgaatttaggagcggatggaaaacaaggagatcttttacggttgccagcaggaggtagtcgttgtccggcttctcaggataccgtacagaatcatcaacatttcattactatggaaggtaaagaagtgtttaagcacgcagtgcgacgaatggagtttgctgccaagacttgcattacagaagctgggctgcaagaaaaagatatagattggttagttcctcatcaggcaaatgagcgtattatcgatgctattgcaaaacgttttgctgttaaagactctcgggtatttaaaactcttgctaagtatggtaacacagcagcctcttctgtggggattgctttagacgaactcttacgtacacatgatatccatgttgcggagcggttgttgttagtagcttttgggggaggcttatcttggggagcagtgattttacagcaagtgtaacagaggagactgtgtgatggatcgtgtgggcttattgttccctgggcaagggagccagttcgtaggcatgggaagagatctctatcaacaatcctcggaagtcgcaaggttgttttctcaggctgatgagtttctagggttttctttatcttctattatgttcgaaggacctgaagaagttctattaaagacatcgaatagtcagttagccatttatctacatagtttagctgttttagaagttttatctacacactgtcctttcgagcctattttagtttcaggccttagtttaggcgaatatactgctttaacagcatcaaaacgtattagcttagaagacgggcttcgcatcgtacaaaagagagcggagctgatgaatgctgcttgtgaagagtcttcgggagcaatggctgcagttttaggattaactgcggatgttgtattacctgctttggagtctttaggagaggggatttgggtggcaaattacaatgctcccaagcagatcgtaattgctgggattagaaataaggtggaagaggcttctgtaattcttcgagaactaggggctaaaaaagtagttatgttaaaggttgctggagcttttcatacaccgcttatgcaaactgctcaggacgaattagctccttatctgtaccagttagcaattaaagattctaatgtagcttttgcttctaatgtaataggggagttagtgtatgagagcgaggctatccgttctttantggtcagacaaatgacttctccaacgttatggtaccaaacctgttttcaaattgatcctaaagtagatttattccttgagctgggtccagggaatgttctcacagggctgagccgatctataggactgagttccccttgtaaacatttagggtctatggaagatatagaaaatttttgtcgganttgtgaatgantggtttattggtaaacaagactgcaattgtgactggcggttctagaggcatagggttcagtatagcgaagttattcgctgagcaaggggctaatgtccaaatctggggaattaatggggaagcggggcaggcggctgctcagactctctctgagcaaactggaagacaagtatcctttgctcttgttgatgtcagcaagaatgatatggtttccgcacaagttcagaactttctttcggagtataacactatcgatgttatagttaacaatgcggggattacgcgtgatgctcttcttatgcgaatgtctgaagaagaatggtcttcggtgattaacaccaacttaggttctatatacaacgtttgctcagcagttataagacctatgattaaagctagatctggggcaattattaatattagttctattgtaggacttagaggaagcccaggtcagacgaattatgcagcagctaaggctggaattattggattcagtaaagcgttatccaaagaagttggaagtaagaatatacgagtcaattgtattgctcctggtttcatagatactgatatgaccaagagcttgaatgataatttgaaaaatgagtggttgaaaggagttcctttgggaagagttggtatgcctgaagaaattgctaaggccgctttgttcttancttctgacggatcttcgtacatcacagggcaagttttgagtgttgacggaggtatggcttaagtagttggggaaaggttatcttgaaaaattaagttttttcatggtaacttcctctctatcttcgcgagcggtttatgcttctcgccctaagcccttctgagtttttgatttagaaggcatttcgttggctgtatatacagtcgagatatagtagctgtgcaggatgctcagtatgctaaaacccttacgcatagaatgtgcgaaagagtagacttgtagggattggttactctagttttatttaaagctagattttttttgctatagactctgcgagaaacccaatggcccattttaaatggccataagtcgaccgtctgcttaagatggaaggcgcttcattttgaaatgaaagtaaggatcataggatgagtttagaagatgatgtaaaggcaattatagttgatcagctcggagtaagtcctgaggatgtcaaagtagactcttctttcatagaagatctaaatgcagacagcttggatttgacagagttgattatgactttagaagagaaatttgcttttgaaatttctgaagatgatgccgagcaactccgcacagtcggtgacgtgattaaatacatccaagagcatcaaaactaaaatctctgcaacaaagagtttaggcccacagttcccatccaaaggtaactgtgggtttttttattgatctcgaaagactatctgttttgagtagaactctaagagaaccaatgaaacggaaggacattcctcgataatgcttagaaactgtcctttattcaatatcaacgttttcactagggtaatcgcttctgctgaatattcccgaactttattattgaaaaagctttcttccccaaagcagtctagaggtttaagtcgtacattaatagtgggttcttttgcaaaaattctcacacatccttctgctattacatataggctgaaacttggttgcccttccgaaaagatttcagagccagctttaaagagcatgacctcagatttatctgctatagaaagcaaaacatccatgtctaaggatgcaaataaganagtttttttcaggagaaaggctttgtctataaggttcaaggaagtccctcctactaaggatttaaagctaggaactagttatgtattcccgggacaatatagaggttttttgtttcttagcaaagctttgtagagcagaagagaactctgcatcgcaaagagaaagctccttcttttagttgctgagctataagcttactgaaaagaaaaggggtttgttcgagacgattcagaagttcttcaatagccaatggttccacaccttttttcatataatatttctcgtcggaagtatgcttatcgcgatatacaaaaggtgtgacaagagtaaacaagtggttctcgcaatctttttctagagattctaaagcttgagctctagcttttaggtttttccctgtaagagatctaattaaaacatctgcataatctgatgagccgacgatggctaaaaaggctaacataaaattgacttcagcttggtaatttgcttccaggctttcaataagcagatggagatcgtagcgagggtagcgtttttggataaagtttttatggtagtcgtagaataaagctttagcagccttagactttaaaattttcaaagctaaacgttttagttgacgactatctatgtggctcaaagcctttgctgccataatgcggcagctattgtgtagagaatgatccgcgaccatttcaattaaaattggaatacattctttaggaagagaggcatcaatcgtttctgctagtttgcgtaagacagatttgagttgaactgaggcaagaacgaactcatagactagggatgcatccaagagggcagctagagtgttcagtaaagcttgtgcagcttgtgtgtcttttgtctttttcagtgtattgagaaccgtccgcccgtattgagcatattgtttatctgcacaagtttctagagataagcaggcttgtagaaatacttgttcattaggatgcgtcaagaaggggaggataatagggaagtttgaagggcttctttccaaagctaagatagaaagacctttaattattaactccggatcctcagattctagaatttctgagagatgtttttcggcaagagcttggtattctccaccaggcttatgttttcttacgatgagaacagctgtaaatagacggtctccagactgatcataaagatcatcggcaatatcggaaacataaagaaagtcatgctctacaaaatagaggtgaagagctgctgctatggtcggatgttggggaaggctgctccaacgttttaatagttcgagagtgaggaaatctttcgcccatacgctattttttaacatattcaaggtttttaatttccctgataagcccaacttgttcatgtgaagaagtaggttggggagtactgcgcgattttttaggttcaacaagtgttggaacgcaaacatttggttgcgttcttgagggttttttaaatgcgttacagaaaggatttcagcttggcgtttttcagtgtcattcatatccgcaaaccattcgcgtatagaacgtctacgatgtattgattctagagagagatttctaagaatggcttttgaatagtgagtgcgtanaatattgctaaaagaatacacacggcggaaatgataatacagagtacgtattggtgcgggatgaataaacatagtagtgcgcagatgaacatccccgcagctcaacaaaagattctatcgcgatccgcacctgatttcggattttattagggatgccatagattaataactgtagattattatcatccaaagcataagcaagcccttctctagcgatcattcccattgttgctatgaagacagaagttttaattgaccaacaacagaataggctaaagaagcagatgggagcgaagagaatgatgttattgattccaaatcttgtgattactcggctataagcaaataaggcaaagaacatatttcctaaggaaatccaggaggagtacttagtgaaattctctgttaactcacaagtctcagcgtttccaaactgtgcatcaaagatttttaaataattgaactctgtgaatacgacaagaagctgcataagaaaataaaaactaaccaagtaaaaggtgtatttatccttcaaacacagctttaaagtttgtttggtagaagggggatagccagtatcaaggaagagatcgtgatcttctgaaagctcttttagtgacgatgaaatgtagtgtaccagagggaatatgaaagtaattacgacaataaaagcgagaagaattagctcggctccgagatactgaatctggttgacgatacgtgcccctaaaaaatctccacaaaatgtaatggcattaaaaatgcaaaaatgacgtttggcatcttggatattaaaaaattgatctataaacccccaaaaattggcataacaaagaattgtcagcccccatataaggatcctatagagaaaagtcggagtgccagaaacacccttgtgtatggctagatgccaaaaaaggtaaaggttgcagattagaacgcaagatatgaacgaaagaaagagagcctttggagagactcgcttccgagagaggttatagagaattaaacacgaaatgaagcaaagaaaaaaggatgctcccaaataggcaaagggcagcttctcagctccaatttcttctaagaacangctctcccccagagcaagggaaccgtagcaggcgacgctccagatgagccccaatagaagaaataatagagctcgcttttcctctccgcgacgcaaactaagcaaaaaacgcaaggctcgcaacgatccgcttcctttacagaaaagaagcatgctaatagatttaattgttaatttcaagaaattttagaattaaatctaattcaaaaattagcttacatataaagtttgaggatcagatcccttatcacattttgctaagaagatgcaggcaatggaaacgcaacaaatcagtgtagtgatggaggcgctcacaatagcccaaattgcattagttgacccagccagacaaacgaggacaaaaggaagaacaccgccaagccctaaggaagcaagtacgataacagctactgcaaggattgtcgcagcaactaagcatgccgctaaaaactgcgggccgagtcctaaagatccgcgtgtctgactagactgaactaattttttcttgagagcagaaacctctgtttgcaatgtaaaaaggttgttttgcattgcagcgagttgttgtggataaacagggacagtgaagaaggggcctggcccccatgtagagaaattagctccctctaaagagcccacggcagaaggagattgtgggggaaaggatcctcgttttcttgatggagcgggagacgtgggattagaaatatcaaatttgtgtgctatatcggacatagagtacgtcataacgttgccttatctttatgtgcttaatcagtgagtcttcccgcttcgttcagctcattttctgctgagcgacgaccctatttcttgaggttttgttgggctgaattgagtggagagggtcaatacttgcggtctggcctaggagttcgatattacggagacaaagaagtaataacgttgtagctatgcaagtaaatatcggcaaggatacgcatgcaccaatagttacggtgttaagtgcagcaagaagaaaaggaaaccctccacaaactgtaacgatggaaaggactattgctgcaatggctgtgagtgcaaaaagagtcattatcgcaatcattacttttttgctggttggaatctgactgggttgaatagagacttggctaaaaccttctggagccaatgaattgtatacagaatgaaccatatttccctccgtgaatcacaataaagagcctttaatgaattagaagaccccgatcggccaaggagtatatcatgcaaaagacttacaagcaactcagttaaaatctagttgttcaagtaaaattttgtgtatagcttgcggttaagaagaaagagaacccctccgcctaatccccactgcatgagtaaacttgaaatgttataggaaacaaaaggattccaccaatatgcttgaggaagcattgctccttcatagaaataccacgctaacagtaagactccttctaaagggagtaaaaattttaccaacatgtcgaagtaagtttttaatttataatcacccggaacagaattgataacatcttgtcttaagcgcttaattccgtagctcaatgcggaataaataaaaatcatgccattgagaataagagcgattccccagactatgtcttggttatcaaaaaattgtaaattcaacgcagaaggaactccgataagaaacgcagcaatggttgcagaagattctgcaatatgttttttgatgccaaattcagttaatgtttgcgacagaaggaacagcatcgagatcatcgaagatagggccgccatagagaaggctaagaagaagattgcgctaaaaaatgtagagagaatgtgggcatgagggagccgagtaaatagttctgggagataaataaaagccattcctatattggatgcgccgacgccttctcgtaatcctaacatttccgttgaatctaacgatgcgcaagcggagaacactattacagccatgagaaaagaaataaaattatttgtgatagctgtaatggctccgttggtgactaagctggtttgttttgaagcgaatcccgcgtatacaagaagaagcccccaaccagctcctgtatcccaagcattttgggttaaagcttctatccatactttgtaatcgcacagagaagctttgttaaatacaaagagtaggcgaatgccctcccaagcatgaggcagggataccgccctagctaatagaacaagagcgcaaatgaaaaagaacgggatcaaaatcttattacaagtttctattccgttaacgattcctttccgaatgatacaataagcgagaaatagagctaaacagtggcaacttagaggcatccagctttgacagtgatgtgcccaaagttgaggaaagtggttccctgggacaattttcccggatagggaataaaagaagtagctaaatccccatcccacaatattggagtagtatccaagtatgcatgttgctacaagaacaataaatcctcctagccaagcagatttagggcccgcggttcgaatcagagcgccgatgggagcttttctagtgagtttccctatagagagttcaacgataattaaaggaatcgaccaaataattagaaacagtaaccaaagaagaataaaggttccgccgccattttgagctaccattctaggaaatcgccaaatattcccggctccgatagcaactcccatcatcgacaaaatgaatcctagtcttgatgagaatactgtattttttttattcataaatcattctcttttagagtagtcatagaaggagtggacctgtgcagtcaacaatcctttcaaacgaaaagatctcgtgattaagacgaatagctcttcgatggtagctcaacaattatttcatctctacctctaatagaagcgatgtttttgagctgataaagacctgtatctcaaggctcgctattcattggtgtaagagcagggcgggagatcttctgtttcagaaaattttttattaattacagaaacaatgcagcaatcagaccaaacgttaatcaaagtttctagcatatctaacaaggcatatgcaggaagaataaggccaagaagacctagagggacattcatagaggctagcaatgatgaagttagaaagtagcatcccataggaacgcctgcatttcctacggcagctaaagttgcaataaagacccagctaatcagtgataaaggagaaaagacgattccgttagagactcctacgaacagcactgtggtgagaatgaatgcggcgcaggcgttcatattaataacagagcacagagggaaaacaaaacgggagattgttggtcggatgtgtaagttttcctcggcaacttccatggtcaaaggcagagtaactgcagaagatttggagaaaaacgcagttgctagggggcgagacatgagcttaaacgtacgcaaaggagagattcccttcatcttgagaagaaggggaagaactaggaatccttgaaggcagttagctgtgacaatacaaaacaggtattctccaaaagatgaaagttccaaattacctgttcgcatttctctgacaaaaagaagagagaaggcaaatgtggctagtgggagcatttttagaatgcccttagagatgctaagaagcaaggagaatagagtattgaaagcgtttcgaacgaataagcgctcgttttctggcagggaaagcgagaaagttgctagcaaggcagacaaaaaggcggcagcgatcacattgctttccaggaaaggttccaaaatatttccgggtatcgtttttgataagacggagaggtagcctgtcgcattggtttctgtagcggcattaaacccggacaacggaacagaaggcttaataaagataaatagaactagagctatggcagccgaaataagagttgtcaatagggtatagtagagagaggatctcacgacagagaccatggatttttagattgttaatcgaagtgattgtcgaacctatagcaaaaaaatacaagaggcagactaagaagtctcagcagctttaaaaaaacagccgaaatgacttctgcactaagagaaacgaaagatagatgcggccatcccagaagcaaaccaagcagtatgcttaagccaagcatcatattgcttttttcaggagagaataaaagtttcaggggtgagcgcataaaacctcagtttttctgagagggggtatatcttttgagactaaatgtaagaaaggagagattttttttgcaagaaaggagctctctaataggggatgttaagaaaaattgttaaaaagttaattttgtcaattctagctttcattatttagttatttaaaaatggctattatgttataatcttttgccaagttttgtttaggcattaagttttaggggaaataaatgagctgttctaatgttaattcaggtgcacctgctactcttttcgcaaaaggagcagctgccatatccagtcgcgttgatacaatgcgacaaatgtgttccgcaagagtaggatcaaaaacttgtgggatagctttaattattataggacttttagttgctactgcgggggttgtgattgcagcagtaggaatcgggaccccagcttctttagctgctggtatgatcttagttatggttggttcccttcttttaggattaggccttgctagagcacgaagtcgtcgtgtagagattgagcgtcagttagaagttgtctctatgcaaatagaggagctttgaggaagaatataaagctctttctgaggtttaccgagcgaaccttgaagctcgtcgagctgtaagtaagtattgccaagagttggaagaaaaaatattagatttgtgtaagcgtcatgccgcaacaatttgctccattgaagaggatgctaaacaagaaattcgtcatcagacagaaaggtttaaacagcggttgcaacaaaatcagaacacttgcagtcagataacagcagagttgtgtaaattgagatctgagaataaggcattatcggagcggctgcaggtgcaggcatcccgtcgtaaaaaataattaaagactcctcagatattgcatctgagagttaggggttccttttgcttacggcgctttagttctgcatgttgcggatttatagtgatttgcgagtaaagcgccgttctgatacagtttttccgctttaaaaataaaaaggtggaaaaatgagtactactattagcggagacgcttcttctttaccgttgccaacagcttcctgcgtagagacaaaatctacttcgtcttcaacaaaagggaatacttgttccaaaattttggatatagctttagctatcgtaggcgctttagttgttgtcgctggggtattagctttggttttgtgcgctacaatgtcatatttactgtaataggtattcctgcattaattattggatctgcttgtgtgggtgcgggaatatctcgtcttatgtatcgatcctcttatgctagcttagaagcaaaaaatgttttggctgagcaacgtttgcgtaatctttcagaagagaaggacgctttggcctccgtctctttcattaataagatgtttctgcgaggtcttacggacgatctccaagctttggaagctaaggtaatggaatttgagattgattgtttggacagattagagaaaaatgagcaagctttattgtccgatgtgcgcttagttttatctagctacacaagatggttggatagtgctgaaaaggaaaaagctgctcttaaagcatctatagacgctaaccaagcttcttagattcctctattcagtcttttcacaaaagacgtctatatgttgctttggtatggataggacgttctctaacatatccctggaagacttgttttgataatccgggaccgtgtggaggtttgtttccaaacatagcagataaactgaaccttgctttcgcatcttgttttacactctagtctcacgcgatgaaaggagggttaaggttttctatgtcaaaaatatttgtgtatttttaccatctcgcgtattatcgcggcctttttttggtccggagtcgacaatgtcttatcttttttgttcctcttgcgctccaactctggagagccccgcagagttgtgtctgtataagacgcatatttattgcaaacgaagaggaaatatagaatttgccgtttccttaggaatttttgctattttaagttgtgtagccttgctttgtttgctttgcaggggatcgtcgcttgtgtttgccggtttaggtattggagcgattatgattggttctgtggctttaggagtagggttaacgtttctctattggtcttgtagtcggggattgcaaaatagaattagaacaaacattttggctagttctgactcttcgagtctatcttcttctaaatccgatttttcattagaatttgagctgaatgaagcagatgtgactataagtgtctcatgataatataaatacgattatttttttgtcatttagacatcttttggttgggtagattaggtatttaactaccattgaaatatataaaaatttttactttaattagctttcctgtagcatgtcggccttttttgcgaaatagaggcgccatgtttaatatttctttttgttgcaattccagcaaaccattgcgtgccgatcatactgaaactatcggtgctcagactactacaagccgtaaagagcaattgttggcaataggtgccctggtattaggggtactagcagttttaggtggtgctcttctgcttcttttttcaggaagtgtgctctctctttttgctcctattcttagcttattagcaatgacactgggttctgcctgtataggaggaagtctagtttatatgtatgggttttctttaaaaccgacgagactcccttcagagtcatctgggttagctccagaggccgtgactcctggattagtgttatcttatcaagaacttctatatgaagcagaagaagatttgaaagaagttgaaggattgcttgctcaaaagagcaaagatttagagcttgctcagaaaaaaatagagcagcttcaaagtgggttgaaatgtgtattggaagaaagtctgagataattattaatggtttccaagtagagtaattatgaacgtttggcgtcctaccaattttttagggaattgttgttcagcaaaaactgaggtacagtgaaaatgtggctaacaactcctttattcaccgttctaaaagataccagttatttgtagttgttctaacaagtttgcttgcagctttaggaggagtttttctttgtctcgggggagtctattcttccttagttttaggagtagtgggaggagctgcaattattggttcttgtataggagcttttggattagtttcttacctgttatctgtgatacgcaattcagatcagctattacaagaagccaaggaaagtgatcggaaaatttccagccattatagggttttagagactcagaaaaatagggaaataggccttttagaagagcgtgtgaatatgttggatggtttttatgctaaatttcatgggtgggattaaggaaagcaagactttttagatctataaaagagttgacgatacgcttttctatttagagaaaagcttctcttttgataaccgatctcttttaccttaagtgggatgccatgagttttgttggagatagtgtacctcttagaagttatatgccagaggctcctttggtggatagcgcttctaaagcgagagtttcttgttgtagcgaacgtattgctgtgcttgcgctcggtattcttagtattttattcatagttacaggagcagccttatttattggggcaggttggactacgcttcctatgattaacgtagtggttaccctggttgtttttggatctgtgatgctaggtgctgttcttactagaatttctggctatggtggagagccaaaaaaagtttctctggacagatttgtattggaaaatgagagacaaggctttttggataagcagagacttgcagatatctctaaagaagaaatcgcgttagctaagcaacaaatagaggaagagaaagaggctattctacactcaatttttcccaatgattaggggtatttatctgtttgcattgctatttggtcgagacagattgcagtgcgccccttctcgtaaagctctatgatccaattcttttatatgtttttatcaagcttgctgtgttcattttagaagttttttgcatttgaattagtgcgtgtggatcagtctgttcgagccattgtgttgtctgttcgattttaagattcttagtgcaatgtatttataataaaaacagcttctcaatgctctctggaacgatggcaagacaaagttttatcctaatcattccttctgtttttgatataaatggcctgatatctgcctgcaaatggcttttttgatttctttaaaaaaatgtttatgtacaatttctctcctgttttaacggaaaggaggaaaaatggtgagtttagcattagggacttctaatagagtagaagcgaataacggaattaatgatctatcgccagcacctgaagcaaaaaaaaccggttttgggttgtgttataaaattagtgctgtcgctgcgttggttttagggcttttagcagctgctggtggtgctgttgtattggctttattctgtacctttacgccgcctctcttcttctatgcaggagtcgctctggttgctttgggagctgttattttaggggtaggagtttcgaatacatgtagttgttgcttgagatctaaaagaatagaagctcgcgagcaactcctccttcagcaaaaagaagaaatctcacaattagagcaacaattggctaaagctctaggagaattggatactaagtgtgcaagtcttttagagagacgtgatttacgagaaaatttaaaggcgtggcaagcttattgtctgaatcttgaagaagatgtgcgagatcttctaaagaagctggaggggtatcaagaaagactaaaagtcctgcctgctaaagagaaacagatagaagagctgaaagctatgttagagcactactctcgtatttgttacgaacgaggagatctcattaggatgctaaaaacggctaataaaaagctatcgaaggaatgtgagaagcttttgttaaactataaggctcatctcgacgtttgtctcggagaaaaggttctggcgaaatcggttaatctcatagacctggatctgaaatcggatagcagtgatggcgatgattatgatttcaattacggctctcgggtgtagtttgccgagcaaaagcctcttcttatgaagaggcttttttttctctcttaatctttgggaacgtctaaatgtttccgaagtagcaagttgttggtaatctgtgattaatgaattcactacgtacagaaattgaggagcgatatgcgttgctgttgtgttcgtacaaattgtgaagaagtaagatcgtcgagtacgggagatcaggtagtttcagcggtcaaagaaagaaagtgtgatagttctcttcgtagaaagattgcgtctgtagcatttacattgattggagcacttctattgggaataggtatggtgttatcttttgcccttttaggaagttctgcaggtttgataggtgttggagttttatctgccttaggcgctgtttgtttgagtttagggctttataaactatttttgcgtatgaagcgagtgtctttggataaagctgaacaaaagatgcttgaggatcaagtagaattgttacggcaagaaaaccaagaattaaaagcaattagtgtattccactgaacattttagaacgctatgctcaacaagtgtccgatatgcatgctgcacaagagaaaagtcttcttgctaatgagaatttagttaaagagcaagaagctgttgtatcgcgattagagaacttattgagcagaggaaaaagagcagtcgattgttcaactttctgctaaagagtcgagggcttttagggctttattggattttttgaaaaaaattgcgttctgaacaaaaaacagttgtatttaaagtatttattctgatagagtcctcgtctagtcttttggatgcgtagctcagcggttagagcacctgtcttacacacagggggtcataggttcaaatcctgtcgtgtccaaaattgcgcgggagtagttcaactggttagagcaccgccctgtcaaggcggaagttgcgggttcgagccccgtctctcgcgagcttcaaccaagggggtgaacaatggctcataccatacgtttcacaaaatttagtttccctctatatttttctaagactcttagttggtttatcataggtggatttttagccgcttgcgttgttcatatgattctcgctcccaacgatttaatcgatggtgggatcgttgggttatctatgatagcagctcattctttcgggcatcagttccttccagtgtttttagtgttgtttaacttgccattcatcattttggcttataagcgcatagggaagtacttcgttgtacagatgataactgcggttattatcttttcttgctggttatggcttatagaagttttgcctgagtggctgggaatacaaccctttatttttgacggttcagaaatagaaactattgtccttggtggagttgtgttgggagccggaggcggattgattattcgtcacggaggagcaactgacggaacggaaatcttagggatcatcgtaaataagaagagaggatatactgtcgggcaagtcatcttgtttgtaaacttcttcatcttttccttgggcggcattgtttaccgcaattggcatacagcttttatgtctttgctaacgtatgctgtggctattaaagttatggatatggtgattttaggattcgaagacactaagtctgtaactatcattacctcttctcctagaaaattaggaaacattcttatggagactttaggggtagggttgacttatttgcatgcagaaggtggtttttctggggagcctcgaaatcttctttatatcgttgtcgaacggttgcagctttcccagcttaaagagattgtgcacagagaagaccctagcgccttcattgctattgaaaatttacatgaagtaatcaacgaaaagagaacctcccattagcgggggttctcccatctttttataaggggactatctagctgtaaaatggctaagatttttcccacaatatcattggatatatcttctgcagtctgaggtttaaagtaccaaataggcataggagggagtattacagctccattctgtgctagcttgagtaagttttctaaatgtattgcggatagaggagcctctcgtggtacaagaatcagaggtcttttttctttcagagcaacatcagcgactcttcttaaaagattatcggccaaaccacatgagattgctgcaacagtagctacgctgcaaggaactataatagttgcatctacagtattcgagcctgatgatacagaactttctatagaggatatatggtgaagaacaatctggttatggaaattttgagggattgtagataaaaaagacttggtatctagctcataataaagagttttttgtgcggatggcgatatgatgacatcaatatgatgtcctaatctggcaagttcagaaactaatgtgactgccaatncaataccagatgctccggaaatacccaccacgtagcgcttcataagattcctcttagtaaaaatagtccaatcatattagcaaaaaacgcgatacctagggaaaggttcccaagaaagaaattttgttgaagagtagacttagctcttgggtcaataagagaatagtgcttaattgtgcgaagaataccggttaaaggcacaagcgagcatagatagaagatggttttattcggaacaaaataaccaataagaaggtaagctattgcgctanctattaaattagctgaagcaattgtaatagcttgtttcgttccaaatcgagcaggaatgctaaacaggccttctttttgatcaaactctacgtcttgcagtgcataaatgatatcatttgctgcaatgatcataccaaaggaaattcctaataaagaactcatgcaaaatagagagaaagaaggagtctcaatgatggcaaaaaagttcatgagtattgctagatagtataccagccccaaaatccagtgacaaagaaacgtaaaacgctttgtgtaagggtagataatcataattagggtagataagactgcgagagaaaagcaaagaggattgaatagccaacaagtgcttagaaacaggataagacagagagtcagaagcagcatggaatgtttaattgaaagaagctctgcaggaagtacccgtgattgggtgcgagggttgcgtttatcaatagcacagtccacaacttggtttacgatcattcctaaagcgcgggcgataaaaaatgcacttccacctagagagatcgtttttatagagcctaaggaaaagagagaaaaaggggtgcaagggagagaaaagcagaacaatgtagaagatgcaagaaatagtgctgcaaacaaagcatatttgcatttgataagctgctgaatcaatacaatcctagacataaacccttcgaatattatgggattataggtgtaaaagatcttgtattgtaatcagaaggagcttttcttgctgaaaaaagtacgttgaagttcgtttcaacatacagataactaagccagatcttcttctaagtttaaagaagctttccacaacacagattgttcgaaagagtcttttaggaaagctagttcttcttcggaaagggttgctcgaggggtatttttagaaactagtggagccgcactaatatagttatttgctaaagcaagatactcttcagagaactcttcggatactttatctcgcatatcatagagcgtatagtaacgacgatttccttccgtacggactaatcttgggataccgaataagaattcatttccagaaagtgtgaaacgaattcctttccatggagaatcgtccgcgctagcggggaaatttacattaagtcctaagggatcggtgtgcttataggcaacggtaaactcgcataaggaacgaattagggaggccatatgagcttcttggaaaaaagcgatattctcactttgagaaagactatcgcaggaattccatggagattcgcttctcttatagctcctacagtggcagagtaataaaggcagcgtccggaatttttcccattattaatacccgataaaataagatccagagcgttctctttaaagagttctcctatagctaatttcacgcagtcaacaggagtgccggtgacagcccaagcttcttggactctttgaggataatcaaaaggctcaagggcagttggctctactaatgagaaagccatacttctcccagactgttcttctaaaggggctactacataaagatcggcgaagtcagcttcacggagtagagaaatcagcagactgattcctttggctttgataccgtcatcattggtaataagaatgcgaagtcgtcgtgtctctgtcatgagccccctcttatacttttcattgcgcataaaaacctgcgcaatgagctattagatctttttaaaataataagaaaaataaaccaagtattatgattaatataaatttttatttaaatctaggaaaagactaggtttctgttaataaggagtcgtattgttctacgcgatttgctttggaaagtcctgtttctcgaacagccaaagcaatattatgtcttgcttgagggaaaatcgtttccaaggtttttaaagcttcttcagtttttgttcgtaaggaaataacggggcaacgacaagtgattcgagcaaagccgctttccttagcaaatttacggatcaggtcttcgggaatgaaaataagagggcgtaggattgtaatcccaaagttaaccatgtcaacgacaggaagcatgcccgcaaattccgctttatggagaagattcattagtgttgtttggacaacatcatctcggtgatgtccgaatgcgacagcggtcgctcctaccgctttagctgtatcaaaaagaaggcgacgtctaatacgagaacaggtatagcactcaggattctctgtttcataaggggaggggatagaaataagagggacttggatcttatcacaaatagaagagagataattcccgctgacggccgctccgcaagaatatttccctccaatatggatagcatggatagttagttctgggaatcctcttccagaaatggcttttagcatgagtagcaaagacaagctgtctttaccgccactcaaggcaacagcaatacgcgtatgcttttgtaacatagcatgcgtatacacgctttgcgcactaaactttcaacacgtttccctaattttgtccatggaggactacattgtagtgtaaacatgagggaaattttaaagatttgcgaattagaaatccaggtaagtcttagaaagaaaagagcttctttacaaagcccttttctgtgcaaaagaatttatttaattaatttcttgtgagaatagtacattccaaaaggaatacaacagttaatgacaaaagctaaaagcagaagagctgtgtagccaaaattgccgcccatggttgaaaaagagactacttcttgaggggggaggaaactaattcccaaagcaaataggcaagaaagaatccctaaggtagacagaacacacattccaacaagttttcctggtacagaataaagtctttgagctttaggctcttttattcggagtacaggaccgactatgaacaaacaaatatacatgactagatacatttgcaagcttaacgcgcttaaaatccagtaagctaggtctgcagagtctacataaacaaatatgaatgtgaatagggtaaccacgatcgcttggaaaagcatgaggtttgtgggaacatccctagagtttgttttcttaaagatcttcggtaggcaatcattctgagtagagatgaacagccccttggttcccgcaaacatccaggcattaagttctcctagagagccggcaatcgtcatagctacgatgatacctgtcatccaagaaaggttgtatttctcaaagaaaagagaaaaagctcgaatgagtccagaaactaaactaatttcttcttttggaattacgatagcaatagctaatgatcctagtaccaaaatggcaagagtggatacagctcctatgaaaacggctttgggatagtttcttttaggatcttccatatccgaagccaaattggcattcgcttccaacccgcataatgctagtagcattccggatagtagaacaaacgaggaaggagaagagaaatctggaagcagttcactccaagaaaagttaatggcgatagggttgcctccttggatccagtaagcagcaaaagcaactaagatggctccggggattagagttcctacaattacacagatagaactaaatagtgctgatgttcctattcccagaaagttaaagaaggtaagcccccaaaaacccaagagaataacggatgacaaatacagtcgattattggcaagatctggactgatttggtaaacaagtgtgctagcaatgaaagctaacatagcgggataccaagtcatattatgaaaccactgcatccatatagcaaagaatccccagcgttttcctaaggcatctcgtgtccaaacataaataccttgtggtttgaatgaagctaattctgctgcaatcagtgcgtaaggaatcataaaacaggctacagcgacagataaaagaatagagtagataagccatgttttgctgttaaaggaaggtttcgtaaactgataactactgcaagggataacatccctacagtaaaagtacccaatggggtagaagatttgcgatgatgcatgagtccctctaaattatgatatggagattgtcggatctaaataaatatcttgaattaaattgagtaaccggacgccttcagagaggggtctctggaaagcttttctccctaaaatcagtcccatgccaccagctcgtttattaattactgctgttttagctgcttcagcaaagtcatcttgcccagaagggctccggagttaattagaccaacctttccacagtaactattaagtacctggtaccgacagaggtcaatagggtggtttgatgaaagctccgagtacacaagatcatcagtcttgctgaaattaattgttttaaatcctccttgaagagttgggagcttttgcttaacgatatcagctcctaaagttgctccaagatggtccgcttgccctgttaaatcggcagcagtgtggtaatccacattattcacaacaaaatgtggattccttaaatagcaccataacactgtagccaagccaagctctctagctcttgcaaaagcttcggcaacagcaacaatttcttcagaagaagactctgatccaaagtaaatcgttgctccgacagcaacagctcccatattataggcatcttcaacttgactgaagaagatttggtgatatgttgtcgggtaggatagcagttcgttgtggtttagtttaagtaaaaaaggaattttatgagcatatcgtctagccaatatacttaacacgccataggaagaagctacagcggaacagccagcttccatagccagacgcacgatattttctggatcaaagtacataggattcttggcaaacgatgcgcctgcagtatgttcgacaccttggtcaacagggagaatagagaggtatcctgttccgcctaagcgtccataactgaacatctgttgaagggaacggagcacccgattatttctgtctgattctgcaaaaactcgtgatacgaagtctccagaaggaagcgttaaagcttctttttttataacacacttgtggttaaggagatagtcggcgtctttaccaagaagatcaaaaatcgttgtcattcgaagatgctcctattttaaatatggtgaaaacccaaaaaagcgcaacacgctctccgtcagagcggatgcgacatggcagattgtctataaatctttcttagcatgcaaacatttatttcgtaggagaaaacctcaagataaacgatctttcctggagtctttagttaagatctttgagaagatgaggtaaagaaaatgaaagactctgcgatttttccccgttctaaagatcagttatattaaaataaccttggtattcaatgtgtgtagaataaaaattaaaaagagaaaatagtttttatgcgaacagactctcctctcaatcctcccgactctactagaggagtttttcagtttttagagactcagtgtgatcgagccatggctcggtccagacaaagccaatttatagggttagtctctgctgtagcagctgcagcattattattgttgcttgtggtcgctctatctgttcccggattcccagttgcagcttcaattgttgtaggggttctctttgctttatcgatcgtagcattaacagcttcgtttttggtatatatagctaatgctaagcttgttgcaatacgaattaaattcttgagtagtggtctgcaagatcacttttcggagtcacctattttagggactctccgtaaaggacgtggtgctagtattccgcttatttccggacaagcagatgattctctccctaatcggattgggatcaaaaaaagcgctgaaatgcgtgttcttcaaaaaggaattgggacagattataaaaaatataagcagcatcttgatagagtgaataatgatttcacttttgtctgtgaggggattagcgctttaattcctacagaaaaagatgctccattccctatagaaccttctcatttagcaggtgtttttttagtatcattttcaccagacaagaatccgattctaaagattacgcgtcatgctgagaagatgttacagcctcctcaaggcggattccctaacgggctggtttggttgtgtggagctctttctgatcctaagaaatttgcagctccctttctatctttgattgagaagactcaccaagggattttggtgagtaaagacttgaaagacaataaggaaagaaagctagctctagaggcttcccttctttcattgaatattttcttttccggttggtgtttggggaatccggagtacaatcagtatatcacaactgctgtagctgagaaatataaggatgtctctgtaagaaatcgtatttatgatttcctggatacagggaatgtgatttcagctcttgctttagcaagtanttattcacaagattccgcttgggctgcagggttgcagaaagttttacgtgaagaagataaaaagactaagaaaaagtcacgtgaagaagtctcttgtttgtatcgtgatatagatccaggctgttgtttaagagctcttcctaagcgatttgaatccaagtcttcaggtagtcaaggtagtcctaaagagcagttaagctctttgttgaaagctttagaccagaaaattccttcaggggttttaggattgattgcaaaagcttcttctgcagatctcaaggctgattttgcaggtatgcttgaagttattaagcaattacaagctttattcgattcttacccacctttatgcgaagacaatattctcttgtggttaagcgcttctttagaacaagtaggcttgcagaagaaattgagaacctttttaccttcatcagaaaaaaaactcttagaacgagttctctctacatttttattaggtttgtatactcgaggagtcttttctgtagggcaagtgaatcagctagctactatttgtaatactcaggactctacagaattctgccagagagtaagtgacctttcgttaattaaacgagctctacctgcattatttggttaagtcttgataaagctttgaaggaatcttgaagaggttgtaggattactgtttgaggaatagaagccctccttttttagattcttttgagaggtttatgtctaaacaacccgagaactctttttcttccgacaaatttttccctatcaagcagaaactagcgctagaggcagtagctttggtggagccaggaatgtgtgtggggttagggagcggctcgacggctagagagttcattttggctttaggagatcgtgttcggacagaacgtttggtaatcacagcggtagcctcttcaaggatatctcagctattagctgaagcagtggggattcctttattggatcattctttattgcaagatgtagacttggtcgtggatggagcggatgaagttgatccttgcttacgtatgatcaaaggaggagggggagctcttttccgagaaaaaattcttcttcagagcgggaagcgcaatgttattctagtagatgaaaggaaacttgttcccacattagggaagttttcattgcctatagagattgctccttttggttgctcttctgtacagaggatattgaataaacagggatactttggagaatggagagaaacttctgcaggagaacgttttatcacggataatggcaattatatttacgatgtgcgtacacccgattcctatgcgaatcccgaagaggatatgattagactattacaaattcgtggcattattgatgtcgggtttgttatagcaaaagccgaggtgtgggtaggttacgccgacggttctattgtccgaaaaaaagaacataatgaatattgatcgagaaatcataagcgacacttcactaattttaattaatttttataaattagtaagtttccgcaactatgcagggattattttaggaacggacgagaaacagttcgccatctatggtcacgcttcaatggataccgctttcaaaaaacgtgaagatctggcagcagaagaagagcgctcacgtccttcaacacatgacgttctcaactttgtattaacaagctttgatctatctgtcgtgagagtagtcattacagaatacaaggataatgtcttttattcacgattgtttttagagcagaagcggggagaccgtttgtacatagctgacatagatgctcgtcccagtgatagcattcctttagcaattaagtatcaagtccctattctctgtgtgaagtccatttttgatgaagctatcccatacgaagattagattgttacaataagatgttatgacaaaacttccttacgcccttttagacaaaggttctttgcttgtagcttctccagatgttaatggaggcattttttcgagaagtgtggttttgctttgtgagcatagtccaaatggatcttttgggttaattcttaacaaaattctagaaattgattcgccagaagaaatttttcctttagatcattttgatgagtcaaaggttcgcttttgtatgggaggccctctgcaagcgaatcagattatgttgttgcatacgagcccagatagtgcgaattcttctatagaaatttgtccgtccgtatttctcggaggagatttttcttttgctggtgaaaaagaggggcgaactcgtgacgacaagatgctcttatgttttggatacagtggttggcaaggtggccagttagaaaaagagtttttagaggggttgtggttcttagctccttcgagtcaggaaattatttttactgatgctccagaaagaatgtggtccgatgttctccaacatcttggagggcgttttgcttcgttatcgacaattcctgaaaatctactactaaactaaagaaaagacttgttccaagctttctatcaatgcagtttgggcgtaatctaaactttccatagagtgagctgcggataaaaagctggcttcaaaaggagaaggagacagatatactccttttgagaaagcagattgataaaacttttgaaaagcttcgatatcgctaagttgtgcatccgcaagattgttaggcctatttgggttaaagaaaaaggaaaagaggcttccatatcgcaccaatgtaacagggattcctgtagttcgaatcatgtgttcaataggggataaaaagtttttgctcaatagttgcgagttgtgtgtaaaaaccttgttcccgacataagttgacagatactttccctgcgatcatagccaaaggatttcctgaaagtgttccagcttggaagatttttcttcgggtgccagatggtccataatgtctttaggtgcaacaactgctgatgcaggtaagcctccacctaaaattttcccaaaaacaagaatatcaggtttcacatgatacaaagccgcagctccaccttgtgcgacccggaatcccgtcaccacttcatccataatggaaaaagatccggtctgctggcaggtttggataactccttcaataaaatcagggacggggagaatcacccccatattcgcacatacaggctcaaaaatgactccagcgaccttatgccccaagctattcataacagtttgaaataaggggaaatcattgaagggtagagagagggtaagaggatgagcgaggtctaaagtgtctagcgaagtatgggaaaagggtttttcttgaagaaaagtatctgcatggccgtggtagcatcccaaaaacttaatgataataggtcgtcctgtgatacctctagcaagtcgaacagcagtcatagttgcttccgatcccgtggacatgaagcgaattttgtagtttgtctctaatcccaaatacgaaaaaatttcttcggcaaagagaatttcttgttcggacgtgaggccataagaacttcctcgttctaagccctgtcggatagctgcacaaatcttagggtgactatgtccatggataagagatccccatgatccacaaaagtctataaacgttttatccagagaatctataaaaacctctttagaggcacgagctactataggaggagtgatattaacggctcgacacgctctaacaggggaattaactcctcctggaaaatattgacaggctttagagaagaggtgggacataagcagagatctctgtaaagattggggaaagggaagtgtataccaggatcgcattaaaaaaaagatgatggattcgcagactggagaggacttgatttcgatctcagacatagtgtatgtttgacgcttatttctctctaagtgcaaggcggttgtaaggagagaaaaccttaaaaataacaacaggttaggtgctatgcgctatgatcccggtctcatagaagaaaaatggcaaaagttttggaagaacgagcaagtttttaaggctgaggaggatgaaactaaaacaaaatactatgttttagatatgtttccttatccatctggggcagggttgcacgtggggcatctaattggctatacagcaacagatattgtcgcaaggtgtaagcgagcccaggggttttcagttttacatcctatgggttgggatagttttgggttgcctgcagagcagtatgctatacgcacggggacacacccaagagagaccacagagaaaaacatcgctaatttcaagaaacagttaactgcaatggggttctcttacgacgaaagtcgagagttcgctacttcagatccagaatattataaatggactcaaaagctttttttaatcctttatgagaaaggattagcctatatggccgatatggctgttaactattgtcctgagttggggactgttttatcgaatgaagagattgaaaacggattttctgttgatggggggtatcctgttgaaaggagaatgcttcgccaatgggtgctgcgtattacagcattcgcggatcagctcctagaaggactagatgagctggattggccagaaagtgtcaaacaattgcagaagaattggattgggaagtcttcaggagcttctgttaattttgccacagaacatggagcaatagaagtcttcacaacaagaccggacactttgataggagtttcttttttagccttagctcctgaacatcccttggtcgatctcctcacttctgatgagcaaaaggctgttgtggcacagtatattaaagaaacacaaagtaaaagcgaaagagatcgcatcagcgagatgaaaactaagagtggggtctttacgggatcttacgcaaaacatcctgtcactcacgaacttatccctatctggatcgcagattatgtattaatgggctttggttcaggagctgtcatgggagttcctgctcatgacgaacgtgatttgctttttgccgaacagtttaatttacctgtagtctccgtgcttaatgaagaaggtgtctgtattaatagctgttgtgaagggttccatttggatggattgtccggagaagaagctaagcaatatgtgattaactttttagaagagaatcatcttggagcagcaaaaatcgcttataagttgcgagactggctattctcgcgtcaacgttattggggggagcctataccgattatccattttgaagatggctcttgtcgtcctttaagagacgatgaacttccattgttacctccggaaattcaagattatcgaccagaaggggtcggacaaggacctttggctaaggtgcgagagtgggtacaagttttcgacacggagacacaacgagctgggaaacgtgaaacacataccatgcctcaatgggcaggctcttgctggtactatttacgtttttgcgatgcccacaactcggccgctccctgggcaaaggaaaaggaacaatattggatgccagtagatctgtatattggaggtgcagaacatgctgtactgcacttactttatgcgcgtttctggcatcaggttttctatgaagctgggattgtttcaacacccgagccttttaagaagcttgtcaatcaaggcttggtattggcgacatcttatcgcattcctgggaaaggatatatatatcctgaaacagcaaaagaagaaaacgggaaatgggttgctccttcgggagaagagttggatgtccgtcaagaaaagatgtcgaaatccaaattaaatggggtggatcctcagatcttgatagatgaatttggactgacgctgttcggatgtacgcaatgttttcagggcctttagataaaaataaactctggtctaaccaaggagttgctggttgcagacgatttttgaatcgtttttatgaaatggtctcttctgatcgagttaaggaagataacaattttgaaggcttatcattagcgcataagcttgtgcagcgagtaacagatgctattgaaaaattgtctttgaatacgataccgtcctcttttatggagtttatcaatgactttgtgaagctcgctgtatatccgaagagtgctgtagaaatggctgttcgggctttggctccaattgctcctcacattagtgaagagttgtgggtgttgttaggcaattctcctggtgttcagaagtccggatggccgagtgttttgcctgagtatttagaagaacagacagttactattgtagttcaggtaaatggtaaacttcgagctcgactagatattatgaaggatgcttctaaagaagaagtcctagcgttagcaagggaatctgcatctaagtacttagaggggtgtgaagtgaaaaaggctatttttgttcctgctcgactggtaaactttgttgtatgataagacgttggttaacatctcgtctctatgatgcgtttttagtttgcgctttttttgtttcggcgccacgtattttttacaaagtgtttttccatgggaaatatattgactcttggaaaattcggtttggggtacagaaacctttcgtgaaaggggaaggccctttagtttggtttcatggagcttctgtgggggaagtcagtctgttggctccccttcttaatcgatggagagaagagtttccagaatggcggtttgttgttacaacgtgttctgaagctggtgtgcacaccgctcgtcgtttgtatgaatctcttggcgctactgtatttgttttacctctggatttaagttgtattattaaatccgtggttcgcaagcttgctcctgatatcgtgatcttttcagaaggagactgttggttacattttttgacagaatccaaacgtttaggggcaaaagcctttttgattaatggcaaactttcggaacattcttgtaagcgtttttcttttttaaagcggttaggaaggaattattttgctccgttagatttattgatactacaagacgagctgtataaacaacggtttatgcagataggtatttcctcggataagattcatgtcactggaaacatgaaaacgtttatagaatcctctcttgccacaaatcgccgagatttttggagagcaaaattacaaatatcttctcaggatcgcttaattgtattgggttctatgcatcctaaagatgtagaggtatgggctgaagtggtttcacatttccacaattcttctacaaaaattttatgggttcctagacatcttgagaagttaaaggagcatgctaagctactagaaaaggctgggattttatttggattatggagtcaaggtgcttctttccggcaatataattctttaattatggacgctatgggggtattaaaagatatttactctgcagcagatattgcatttgtaggaggaactttcgatccatctgtaggagggcataatttattagagcctcttcaaaaagaggcgcctcttatgtttggaccttatatttattctcaatctgttcttgctgaaaggttgcgggaaaaagaagcaggactttctgtgaacaaagaaactcttttagatgtagttacagatcttcttcaaaacgaaaaaaaccgccaagcttatattgaaaaggggaaatcttttttgaagcaggaagaaaatagctttcaacagacatgggaaatattaaagagccaaattacttgcatgaaaatctaagaatgtgataatcttagactttctaccgcgggatagagtagtggtcatctcgttgggctcataacccaaaggtcggaggttcgaatccttctcccgctaattttttagattgtttgaggcggtatagctcaggtggttagagcagcggaatcataatccgcgtgtcgttggttcaagtccgactaccgctatctcctcgtttctatgattcttctagctttcaccgacagtttcctgttgttttcttagaattttgtcgcgttattctccgataattttcctttttcccaaagtaatgttagtggacgctgatcaacaagagcttgttcttcgaaatattgtaacggtccggggaatcggtacgaatcttctaataaacagatctctttcattttatgtaaatattttgccataggggcatctggagatacagaatctgttttgattactggagtctcttgattgaaccgtttttctaagtgcatcattttgtataaaggagtcgctgcgatggtccattcggtataagtttctgctagattgcctatcgtgaccatataccctgttttccctcttactaagaagagagaagcagctattcctaatgctaaaccataattggaatcaaaattagaagggaaacttgctcgagattcgtatcctagaaaatgtgttacaggagaaaaggacattgtaggttcaagcttagagatttctttgctaactaaagaagctaaaagctcttcaatggcaattttagatacccgaatattcccataagaatctcgatctagaagtaattggtctcgaatattttctggaagagaagagaaagtttcgatagccattggggataattgttggtccaaattatgaacagaaaattgttcttcagcaattaaagtgttcaattcttggattaatcgttttgtatcagggatttgtttgattaagccttcaggaatgagaatagtactgtagtctttccctctatgaaagcgctcgatcaacccttgagcaatactgagacttaagctttgtaaagaggcatgttgaacagcaacttcttctcctattagggtaatattaggcagtgtctgaagaccgcattccaacgtactgtgagaagcttgttcacccatcaatttgacaaaatgatggtatttgcgagtagaaagaacatctttttccaaatttccgatcatttcagaataagtgcggcaagatgtatgaaatcctaaaggagtttctatccaagcgttttttaaatccccatcgatagtcttagggacaccaataactgctgtagggcaattatgctcgataaaatattctgctagcattgcagtgtctgtattggagttatctcctcctacaatgagcagaccgtggagtttcattttttttactgtagcaagaatagcgctcttctgttcttttgttttgattttttctctgctagaagagagcatatcaaaccctccagcattgtaataatcatagataacagagatatctagatccttatataatcctcgaataagtccaagagggcctttaataaaaccgaagagctttgtttctttattaaaggcgcgtaatccttcaaataatccgatgactacgttatgaccgccaggagcctgtcctcctgacagtaaaactccgatacgtaaaggctcagaagaagaaggagcatctttttgaagagtgaggtctgggagagcacataggtgaggaatatgcttagctagcaaatctgaagccggttcggaagaaggcttttcctgaatatgcatcgaacacaagctattcaatagactcagagtatctggacgatagtgtagtctttgtagttcaaagtagctcttatttacagagagtagctccatggtgtgcccaataattgatgttttagccaatcgacaaggtcttgaaaagcttcggagtatatgcaaagctgatgagtcattttaggatatgtgcgataggaagctttgcctgtgaaagtttttgcaaaaagagcttgatgacgtaaggatacaacggcatcgtcttcgccttgtaagtaaagaatagaaacttcttgcgtgattttggaaagcgcatctacggtatcgagctcgataaattgtgagcagaattttttcccaagaggaataccttgataagaaaaattatcaggggggagttggagagagggcgacatagactgcatagtgtcttctaaccataaagccccttggattgtaggagtccaaatagcagcatgttgaatctctgggaagtagggaaggttcagtagggataagctgcctcctaaagacgagccaaacaaggcaacagaatgattggcttgaggcagagaaagaccaaactgaatgattttttgagaggcttgaatataatcggtaagggaaaattcatggataaatccttccgaatcaccatgccctgggagatcaactcgtaatactccgataccttcttgtactagttgattagctagatggagataggaacgtttggttccaattttgctagaagctaacccatgcaacacgataacaagaggaaaggttttttcttgagagtgaggaatatgcagaacccctagagaagtcacattatctaatagaggtatttcaaagatcttttttgaatgngggaagtaatgaggttgttgcatcataatgaagggaagctctttagttatgtccattgagatggttaataatcctgatcggggatttctaaacaaatagaacagcgtttttgccattcattatgattcaaaaacaaaattaaaggaggaaaatcatcagaatgagcatcctccggagaatgtatttgtaatggccctacaaagcgataggagtcttctaaagcccagattttccgatacagtgagaacttattaaaaacaggactagcaatatctaccaatcttttttttatcagaggataatgtttactgtctttcccctgcttggtcgtcaacattcgaacaatgggtaaagcgcgcaatcgccatttttcaatagggctagttagaccttcgatcgtggataaatacccattacagcggttaaaaacgagaaccccagcaccatatcctaagttatagctatacacattatcaaaatgtgtaggagttcctgaacgcccttcataacctaaaaaatgggcaganncattgaagggaacttgtctaaaatgtgtttctaaatgttgacgaactagatgaatcagaagtttatcaacactaatttttgatacatagacgttgccatgagcatctctattatacaagagctgatggcaaatatcttccggaaattggcataaaagttgctgagaagataaggataaagcttggtaaagattctcctgctctggaatggattcaatttctttaaccagagactgtatttcaggaataaactcaatgactccttcagggatgagaataacgccatggtatttccccatagcagctcgatctgctattatttcacaaatatcatggattaatgtttctaaggagatgcttttttctgcaatctcttcgcctataagagcaatatttgggtgagtctgtagtgcgcattctagcgtgatatgagaagaagaccggcccattagtttaataaaatgatagtggcctttacacgataatgcgtctctagaaatgttgctgatgatggatgaataaaatttagtagcagtatcaaacccaaatgtgaggtctaaaaataggtgctgcaaatctccatcaatagttttaggaacaccaactaataccgtttttgcttgatgcttagcaaaatattcagcaagaatcgccgtggctgtattcgaaccatcgcctccaataatcactaatccatctaaatcgagttcatttgctgtttgtaaacagcgcgctttgttttcttcggttatgatattagtgcgacctgttcctatgcaattaaagcctccagagttacgaaactcttcaatgaattcatctgtgatttctacagtattattattgagaagtccttctccattgcgaataaatcctaaaagctgactatccggatggagctttttaatactgtgtagcaatcctaagatgacattgtgcccaccaggagctgggcctccagaaagcataacgcccactttaaggggaaaggtctcagcggaaagatcggacttcgaaataaatttgtagtagggagagttataagtgcatggaaatagttctgcaacagagtcaatgcgttcattaagaagagctttaaaccttatgtcttctgttaatagaagagcaggagctttttgaagctcccgacacaaagaaggcgtcttttgacaaagagaagcatgtttattcgacgacataagcttttgctcaaacacgttagcgaattaatcctaaacagtaccaccaccaacttcctaatcccaaccaaatggttagattgactatgctaagaataaagccagagcgccaccattcttgcacggagacgaaatgggatccaaagtataacggagctggaccagatccgtagtgtgtgagtcctccgaataaattactagcaaaagctaaggctaaggcagcaaacataggattcgcgcctaaggagatggatactgtaagaaagatagggtacatggctgcaatatgtgctgtattactcgcaaatagatagtgagagtagaaataaataagaaagagtatagggaaccctattttccaagatagaccttgaacgctcccaataacagaatctcctacaaaatgaataaacccaaaagcgcttaggaaggaagccatcataattaaagctccgaaccagacaaaggtttcccatgcagtagtgttagaaagaacatctttttgccaatcaagaatattcgtaagaatgagtagggatagtcctataaatgttgtggttgttgctgagatgccgatggaatctccgaaagtccataaagatattaaaagagaaaagattaaaagaataatgcgttcgccttgatttaaagggcccatttcttttaagcgagttttggcagttgctacagcttcttcacagctagttatttgtggtgggaatagtttaaagagtacaaaaggcatacaggctaagctaataatccctggaaggattgcggctttagcccaaattgcccatgttaacgttactccagaatgacttgctaaggcagaaataatagggttcccagccatagcagttaaaaacatagcacttgtaattacagagctttgataagctactttgattaaaaaagatccgagaagtttttccgtgcctttttctacagaactaccgaaagactctgataatcccataacgacagggaaaagaatgcctccagcgcgagctgtcaaactagggattgccggtgctaataaaaagtctgtaagaactaagccatagctcaatcctaaaggacttttacccaatatttttacaaagaagtaagcaactcgctctccaagacctgttttaatcacgccttttgctatggaaaacgaaagaaatacaagccaagcaatagggctatgaaatccggacaaagcttgatctagagttaatgttttggtcacaagcagaagagaaatgcccatgataacaatggctcccataggagcgggttgtacaatgattccgataatagtcgtagtaaatatcgcaaataagtgccacgctttggagtcgatgagatcagaatgcgggcagaaccaaattccgagaaggataaatgttaagagtacgagcgataagaagcgtttgtgtttattcatggctccctataattttatctggataaaaactatgactcaaaaggaaatctttctaaccatttctccatctcttctaaagtgtcgttgataagatctgtggaggagaagacttcttttaagcaagaatcaatggattcttcgtgaataatggtttctacatcttccatactgataaaagatgtatctatcagaccagctgaaaaagctttgctaataggataaaaaagttctttaggataaagagcgcaaatggaagcaacaagactatcccaagcaaaggaaggctttttttctagccgataattaagtaattctccgaaataacgaatagctgtttctctggaaagcttgtggacgccgacgagagccactaaactagaaatggctgcggcttgcacataaggatttacgtgaggggtttcaatgagttcttggataagagcaacgtcatcacaaacactggctaagattcgggagagatcttctgtaagcacatccccagcaattgcatgagggatatcctgctcaaaagagaataacttaataatgagcggaagagcacgagtttctcgaaattgcgctaaaaggtacatagcataaagatggccttgatagcagtcgtcatcaatgatatcagacacatgatcaataccttcttccaaaatcttgagtaaataaggagtgatttggtgatgcttgacgatcgcagcttctatggcttctctaggaagaaccccgttgtcgtaaacgagatcttccaaaatatgggagatttccatcgtcaaagttactccagttctgaagatttgtgaataatcgattgtttcctggtcgtagcatgccaaaaatcttctgtcaacaactctatatgagtgcaaaccttcaagcctttcacggaaggaaggactctcagaaaacgagcaggccgtagcgagcaacgaccatggagctcggagtctaagcagataaggcgaatctaaaccacattaagttgacacgcaaaagataacagttcgagagcgtgcagcgctattatagatttatgacaaaaaaaagcattaacaaagagctacaggataacgatagattatcaaaaagagaaagtaaaagctggaatagcatcaagaagctcacgagtttttatgtgtttaggtgaggaaaagatctcttgtttagaagctatttctactaaatatccacggtccataacagctattttgtcagctaaagtgtaagcagcagacatatcgtgagtgatgaataaaaaagcattgttatattgattcttaatcgtttgaaataaatcaagaatcaatttttggttcatagtatctaatgcggatagaggttcatcgcagataattaattccggtttacacaccaaagcctttgctatagctatgcgttgccgttgccctccgcttagtttaatagggcgtaaagataaaaatgatttaggaagatgaaccagtttcaatgcatgagcaatttcttcttgctgtnggcttttagaaagaccccccatgatgtgtagtggttcggcaatgatttcttgaatagtcatcatgggattgagactgctatagacatcttgccaaatcatctgcaccgctttagttcttggagtttttggaggaagatgaaaatcgatcgagtcttgagcatctggaggcagtaatcccaaaatcgctaaagctagagaggttttcccagatccacttgctccgactattgttaggcattctcctcgacatatttcaagatgcacgtttctcaaaataggttgtttgcgaatagtaagagaaagatctttaatagaaactaacgtagacatagctaattaaaaggttaatacgcggttgttgcaagaggttctgtaggtgaaagatagctaggactaggaattctaggaatagcgcggatcagttgctgggtataaggatgagacggagagtgcagtagctcttgcacaggaccttgctcaacgatctccccatagcgtataatggccatttcttcacacagttcagatactaaagctaaattatgagtgatgagtagtagagctgtagaatggttttggtgaatttgtgtcagtacacgcaatacctgagcctgggatatagaatctagcgctgttgaaggttcatctgcaataatgagttccggattggttgccagagcaatagcaatgctaactcgttgacacatgccaccgctaagctcaaagggatataattgtaggcatcgatcaggggattcgatgtgtacactctcaagcagttctcttgctttagagaaagcttcttctttagacatatcgaaatgatgtcttagggtttctacaatttgagctcctacacgcatagaaggagtcagggttcccatggcattttggaaaatagttgcgattttcttcccgcggattgtttgaagttgtctacgagataagcgtgtaatatctgtgctggagtaaaggattcttccagattggatgtaacaattatcggggagaaaccccaaaactgctttagaaacggttgttttccccgaaccattttctcctacaagtgccatactttggcatcgcttgatagtgagcgacaagtgattgactaatcgttgattggaattttttacggagacgactagattgtcaatttttaataaatcttcagacaagggtattttcctctaacaatttggtttgtagaccttctcctatacaattaaaacttacagagacaatgatcataaaaaacgaaggtataaagaagagccaaggatggtaagctaaagaatgaatgccttcttttacaagagtccccagactggcgtaaggaggttgnnttcccagtccaaggaaactgatgaaagcttctgtgtatacagcattagggattgtaaaaattaaagtagaaataattggccctagagaattgggaaggagatgttttcttaaaatatgaaacgttgatgcttgtaaagctcgagcagacaacacaaactctttattttctaacagtaaaaactgaccataaataatacgagctataggaatccagccagttattgtcattgctaaaataaggggaaggattccgtgattaaaaataactaataaaagaataatgacaggaatgcgcggaatggaaaacaaaatttctgtaatccggctcataatatctgccactttttttccactggcaagagctagtgtagaccacagtagtcccaagcatacgtcaataattgtagcagagactgcgatgagcaaagagagccggatgccttgaagagttcgagccaacatgcatcggcctaaattatctgttccaaaaggaaacgccttgctcggagactgaagagcatgttcgggaaaagttctttcgtaatcaggataaaggtagggaagaaatgttgcggctaggaccaaaacagctaaagttagacagcccaatacaagcattttgtttgtacgaatgtagcgccaagtatgagacgaactagatcgaaacatgagtttgttttagaaatcctttattaaattattatttagaacgttctttcccataagaataacgaatttgtggatctatccacgcttgcagaaggtcgcaacaaagtgaagttagcatgaaaaaggctccataaaacacagaaagtcctaaggtgatagggtagtctctttgtttaatactgcaaatgaaccatttcccaagaccggggatgcagaaaaggttttctatagagaaggttccagtcattaaagttgttataagaaaagctgagtacgaaatcacagggaataaagcgtagggcaaaatgtgttttattaacaccttaaaaggagaaagtcctttagcgtaagctaataagacgtanctttttttaaattggcggaaacagaggcataggttagctgagtaatgaatgccataggagtaattgctaaagctattgagggcaataaggtgtgagagaaattcccccagcaagctatgggtagacaagaatattttatagcaaaaacatattgtaaaaaggctcctataacaaaggcgggtactgatatctgaatcacagaagaaaagaaaatagttcggccgcagctttttttatagaaagctgccagaattccaagagtaatgcctccgaagagggataaacacaagctttcaagtccaagaatagcggaagatggaagagcggcagcaataatactgatcacagtacgatctttgtagataagagattccccgaaatctagtgttagcagacatttcaaatagataagatactgggtgaataaaggcttatctaacccgtaacgattctttaatagtgctaaagtttctggcgaaaggatgtttccgttttcatcattaaaaggatctccggggatcgtcttaataataaaaaacgttagagtcactactacccataaagaaagcaaattaaacaacagccgcctctttatgtagctgagcatagtagattcctttgtatattgtattgcgatctaatcacagataacaagttgaaaacataaaaggcctttgccaagagtgataatttaacactctctagacaagacctctccgcattttaaagagagaatcttttctacgcacggagtaaaaacatcttttaagagtttttagcataccgcatatcaactaggcctgaaggatgtagtctaacaaaagaaagtttattatttgttgtataatggaacacgtcgtgatagaggggttctatgacgttttgtctttctatgtatagagaagcttcggaaattaaagctgagcgtttttgagggtttttttccgtttctatagagagaatcagttgatcaaattgaggatcttgtaaagcataaggtttgactcctttcgaggagaaaatggaaagaaacgctaaagggtcagaaaagtcggcaaaccagccacctatagacataaagaaagtattgcctattagatcgttttgcaacaaagcatattctttcccgcagatagggaaagtaattcctaaacttcttcgccactgatcgcgcaacatctgagctatctgtgagttcacagtagacgttgcggaaaaggtaagaggatatttctctagatccttaatagtcatgttaagctcagtcagagcttcttctagtaaagatttagctaaagtgatggcctcttgttgcttataagaaggctgctctgggtaggtgtgcaaatgtgcaggaaggagatgttttgcaggnttnaacaaaagccaaggaggcaagagcttctttgtttaaaactagactcaaagcttggcgaagcttggaatgactaaaaggctttttggcagtgttaaatgtaagccaggaagtaccagatatatcaaatgattggggagctcgtcgtttgtttgctgtggctaaagtttcttgcggaatactatgtccccaagggagaccttgccaatctagcttcccttggttgaataaagcagaagcagtttgttgatcaggaatgatgtgtatacagatctcctgtacagctacctggtctttattatagtagtaagggctcttctctagctttaaccatcttcggtctttcttctcttttaagaaaaaagctccagtagatatcggaagagatttttcttctttccatatctgatgctgcgaatgcacaggataaaatacggggagggtaagcagctttagaaaatgtggagttggagtgaggagattgataacaagagtatgatcatctttggcaaaaaatccagaatccttattcacgtcaatagggagaaaggcgaaagaataaatactagcgacacgattttgtaacacatcattccaggaacgaacaaaatcatgagcggtaataagatctccattgctccaaaaagcttttttcaagttgaaagtataagtttttttatcttcggataagaagaaactctccgctaaagcagggaagacttctccagaaggagtttcttgtaccaatccttcatagagatgatgaatcaaattgatatcagaaagaaggcgaacctctcgaggatcaaatgtgcgaggatcatcttttacgcttacagcaactgtgtgagtagctggagaccgatgggttgcgttagaggaggattttgaacatccagaagttgctaatgctaggagcaagcagattcccactgatatcttgcgcatggaatgacctccttagaaacatgtgtgcgattgcaaaacagtctctctcctaacccagctatcattgcagcgttgtctgaacataactgcgaagaagggaagtatatcggaagagagcatatttgatttagcaagcgacggaagtaactgttgtttgctacgcccccaccaacaatcaaagactcgcaagaaaacgcttttacaatatcaggaagtttttgagcaatagtcataaaaacagctttttgaaacgatgctgcaatgtttcgtttctgtgtttcagagacttcaggaaaaggtgcttttgctgagctgttgttgccttttaaagcatataagacggctgtttttagtccactgaaagagaaatcataaccagaaactcgagctggagaaaaggcaaatgcatctgcatcaccttctcgagctaattcttctaatttttgtcctcctgggtaaggcaagccgagaaaacgagctactttatcaaaagtctcgccaatagcatcatctcgagtctttcctattaaaaggaaagttgtggcatcaggcatgagaaatagagatgtatgggcaccagaaatagcaagccctagagcagggaattgagtggcgggagcttccatgcaagcggcatataaatgcgcttctacatggttcactcctatgagaggtcttttcagcccacttgccaacccttttgcaaagtttacaccgatagatagggctccaataagaccaggagtattagctaccgaaattaattcgatatcttccaaagagactcccgcgctttgcgttgctgcagtcagcagttctgggaatgtttgtagatgagcgcgagaagctaattcagggatcactcctccataagaagcatgaatgtcttgagaagcaattttatttgctaagattttcccgttctggacaagagaacaggatgtttcatcgcaagaactttctaagcctagtgtcaacatagcgaacacttaaaaaagagggaaacattttggaaggagaggatcgtatcatgagattgttaatcaagcaaggcgttaatcgcaagagatatgcagaagagttgagcctttagattgagtgacagagaagagagggcgtttaaagctgcgcataaacccgccccggcgataaccaaagtaactcccagagaaagaaagtagcttgctgcaatagagggtatagtcgtaatcacacctgttaagattagagctcctaataatagtgcaaaaatatcctacaagaagcggaatcaaaagtttgagatgattaaaaaaagaatgagcagctaacgtagctgaggaaaccattttctcacaaaaaggaagagagtaattaggattaactgttgttgccataaaggttttaaagtccaaattaatttaaagtagagagtttttgcaaaagaaatgaaatagcattataactagttgggttttattaaaccagcggttgatatttcttgattagtcgacttagaaataaaacggttttttttaattagtaaaatctagtctaatacttgagacaaaagaatggcttcaactttgtaaaagtaaaatttttagaaggttagaattaaaatggtttctatgtctctaaatctccctcctgcggaggttagattgcgtcccgtgaccgcgaaatctttccctaatagctcagcttggagagctactcagaaacgtataaccgggtgtagtttaaacgcttcttcttatcgaccatcttcggctcgtgttattagttttgttgtaggggttcttgttgttttagggtggatttgttgtcggatagcctatctagctaattcaagagtgctgacctttcctaaaatgtttgctatagcgattcttccctttattttatttggaggggggctagctattctttttagaatcgctggtaaagtggatgttttatacgggaagaagatacaaccttttatctctcggcaatgggagcgggttatcctgtgtgaaaaagaaggagaatttatccggccgatccaagagcccgatatgtatatggatgtttcgcttttagatagaacagggtcagggattgcacccgtttatacatatcctcccatggacgctcggaccgttatttgcgtcgttaccagtattctattacctatcttttccatagtgcggatgctgtacaatattttccgctttttcattgttcccttctatatcctattccagatggtgcgtcaaaactatcagacagacatccctaaagaggaaaggtttgtttgttctgatatcgttcgagaaatgactcgctctttgttgcaggctgttaaggcccctttttacggagcagcctgttatttagcgaacttatatgggttgctaaatcctttgtcaggtagagtggttttagccagtttggaacgagattggaataatgacgtgattcgttcgcgaggagtttgggggattttttgtgaaaaaaattatatgttcgagggaggggggacgcgctccgggttagggcaaaatgcttggtatttgcttggttgtttccagccggcacaactgtttcttctgaaagatggggtaatcatctctggagcacggccatcaatacaatctttccccgaaagtaaagagtatctggcatcatttttatatggggctgttccaggaaggttggccagcttttagttttaaactgctaaagtttttagcaggtaaagcgattttgcttgcagatctacagtaaaatcttcatcatgtagtcgaggattaggcggaggatccgaggcatgggtgtctgacgactaattccttgttttcatttgtcagaagaaacgaagcttacagtgacnaaataatttagggtcgctgcctaagtgtatctgtttgtaaagtatctttttatagtgaaggactcttgtttaagagtctcggaagactttttgtcgttttcgtaaaaaaatctcttaatanntagtctgaggtattagatttggcgagactttagaccgaatgtgtcgctaatagacgacttttaagagtctttanatgnaanaanngagaagggcgtggaaagagcnaaatngaaacgaagaaaagttggatgttgcgctaacttccggaaatcttatggattctaaaactagtcatctagatgatgaactatgttttaaactagaagaagcttttgataccctaacagcaggggaacattcgcaagatttaacatcaatagtcagtgtatataatcctattgacttagcgtatgcggtatcatgtctaccttcggattcacgctctattctttataagaatctcgatagtatagcttccaagattgcttttattattaatacggattccgcttcgcgatgggctattttccgcaatctatcggatggagaaatttgcgctcttatagaacaaatgcctccagacgaagcgatttgggttcttgatgatattcctgaccgaagatatcgaagaattttagatttaatcgacgttaagaaagccttaaagattcgtgatttacaaaagcatggaaggaatacagctgggcgactcatgaccaatgagttttttgcctttttaatggaaacaaccgttaaagaagttgccacctgcatacgcaataatcctggcattgatttgacccgactagtttttgtcttagactttaaaggggagttgcagggttttgtaacagatagaagtttaattattgcttcgccagaaatgcccttaaagcaaatcatgcgtcctatagaacataaggtattagctgatacaactagagaagaagttgtggaccttgtggagcggtataaagtcgctgttttacctgtagtggacgaagaaaactttttgataggggctatcacatatgaagatgtggttgaaacaatagaagatatcgcagacgaaacaattgctagaatggcggggacgacagaagatgttggatatcacgactgccatgttgtgcaacgattcttattgcgggcaccttggttacttattaccttatgtgcgggacttgtcagcgcttcggtaatggcatattttcaaaaaattgcccctactcttttagccatggtcattttcttcattcctttagtgaatggtctttcgggaaacgtgggagtgcagtgcagcacgattcttgttcgtagtatggcaacaggaacgctttcttttggtagaagaagagagaccattcttaaagaaatgagcattggattgttaacaggggttgctttagggattctttgtggtctagttgtctgttgtatgggatgcttgggacttgggttgtttgctacgggaggagtccagttaggggttaccgtttctgtggggatactcggtgcttcgttaactgctactactctaggagttctttctcctttcttctttgcaaaaatcggcgttgatccggctttagcttctggtccgattgttacagctcttaacgatatcgtgtcgatggtcatcttcctattgatcaccggcactctaaatgttttatttcttcaaatagtgggtgagtccgaagacaaaggttttcttcgggcttttttcactatgtcttttctccccctctctttagaatgatttatgaattttattatttttttagaattcgcttagataaaggagtggatttgtggctttacgttttgagattctgcatcaatcaaaaaaatctagggctagagtaggtcggatagagacggcgcatgggtatattgatacaccggcttttgttcctgtggctacaaatggagctctaaaaggagttttagatcatagcaatatcccgctaatgttttgcaatacctatcatctgatagtgcatccgggagcagaagctattgctgctatgggtggattacaccaatttattggtcgcaatgcgcctattattacagattccgggggatttcaaatttttagcttggcatatggttctgtagctgaagagattaaaagttgcgggaagaaaaaaggaggaaacaccatcattaaagttaatgatgacggggtacactttaaatcctaccgagatggccgtaagctatttctttctccagaaatttctgtacaagcgcagaaagatttgggcgctgatatcattcttcctttagatgagctgctgccctttcatgcagatcccacatattttcaccagtcatctcaacgcacttacgtttgggagaaacgttctttggattatcatttaaaaaatcctggaattcagtccatgtacggagtcattcatggggggactttccctgatcaaagaaaacttggctgtaaattcgtagaagatttgcctttcgatggctctgctattggaggcagtttggggaaaaatcttcaagatatcgtagaggtggtgggcgttaccgctgcaaatctttcagcagaaagacctagacatctgctagggataggagatttgccctctatttgggccactgttggtttcggaatagattcttttgatagctcttaccccacaaaagccgcccgccatggcagcgggattttgacatcacaaggccctctaaaaattaataatcaacggtactcttctgacctaaatcctatagagcctgggtgttcatgtcttgcatgctctcaaggcataacgcgcgcctacttaagacatttgtttaaagtacatgagccaaatgcgggtatctgggcgtccattcacaacatgcatcatatgtaaaagtcatgcgagaaattcgagagggaattttaaatgatcgtatatcaaacggcgcgattatgagattctttttgtgtttttatcgggtttagtataaaacctttcgccgtctacttgtttgatctcaaaaaaacaggaaaggaggagtttgtgcaatcggttggacaagaagcttcacagaatacattgtcttggacaattcgaccgcgaatacccagtataattcaaggtagtaaagaggtctcgttagctttatttgtgctgggcacagttttggctattgttggagcgtgtgctgcagctgttggtggagctttttctgtttgtttgggagctttgtttcttggtggggttgtattagccaccgggcttctattagctgttttagaattttgtcacatccgaagcagcagggaaaaatacgtgattctaacaaaacaggatctgtttaaagaacctgttatccaagaagagcaggcgactcctcttattgaagaagcttcttatacttgtgagccagggattcccttgtctggtccggaggaagtccaacaagagcgtccagtcattctgcagaaagatttagatcttagtcatgttcctaaatacatcgctgtgggcagccatgtagttgaactagtcaaagctggtaaaataggccgtaatggagaactgctgttagaagaaggaatcgatacggatcaaaattttgttcgccgtgccaaggaagcagggagcatacgacaaagacgtgaagtggttcgtttagatggtttctgttgtaaagttttgcctaagacatctaaaagtgagtcgattaatgatttagtttccaatgattgttaatcagttaactacccattttaagaatccaaggatttactagaacttagcgctaatactttgacttttttagttcgcaacaagtataagagccttcttcctgngccttctgcgaaggaaggtgtgcttgcgcatatcgaaggagcgttgtgtctttttatcctcaaaatctacctagttttcgtcgtagaaaaccaagtcgaacagattctcccattaagcatgcaaaacattttctccgagaccatttgtctcatttgcgaaaaattcttgcgggcaagccacaagaggtcatagaggcgtggtatgaaattctaggaaagaagtataatgggatgactcaggctatagggcttaaggacggaattttatcgattaaagtccgcaatgcttcgttatatgctgtattaaaacaaagctctcaaaaagagttgatatcccgaattcattcagcagttcccggtgccaaagttaaagagatacgctttttattaggatagttatggacgcacaagaaaagaaatacgacgcatcagccatcaccgttttagaaggattgcaagctgttcgtgagcgtcctggaatgtacattggtgatacaggagttaccggattgcatcacttggtttatgaagtggtggataacagtatcgatgaggcaatggcgggtttttgtaccgaggtcgttgttcgcatattggaagacggaggtatttctatttcggataacggtcgaggaatccctattcagattcacgaaaaagaatctgccaagcaaggacgcgaaatttccgctttagaggtggttcttaccgtactacatgcgggaggtaaatttgataaagacagttataaggtttctggaggcttgnatggagtaggagtttcgtgcgttaatgctctgtccgaaaaattcattgcaaaagtatttaaagatggacaagcgtatagcatggagttttcaagaggcgctccgttaacgactttacaggtgcttggtcctacagacaaacgaggtacagaagttctcttttatccagatccagctatattctctacgtgcgtttttgatcgcgcgattttaatgaagcgtttgcgagaattagcatttttaaatcgtggagccacgattgtttttgaagatgaccgtgatacgggatttgataaagtcgttttcttctatgaaggcggaattcaatcattcgtcagttacctcaaccaaaataaagaaattcttttcccaaatcctatttatattcagggatcgagacctggagatgatggggatatagaatttgaggctgctttacagtggaattctggttactccgaattaatctattcttacgctaataatattcctacaagacaaggcggaactcatttaacaggattttctacggctcttactcgggcagtaaactcctatattaaagctcataatctatctaaaagtgacaagttgtctttgactggagaagacatcaaagaggggctagtagcaattgtttccgttaaagtgcccaatcctcagtttgaagggcaaacaaaacaaaaacttggaaatagtgatgtcggatcggtttctcagcaaattagtggtgaggtgttaaccacattttttgaagaaaatactcaaattgctaaaacgattgtagacaaggtgttcgttgcagcccaagctagagaagctgctaagagagctagagagctaacttttcggaaaagtgctttagatagcgctcgcttaccaggtaagttaattgactgcttggaaaaagatcctgaaaaatgtgaaatgtatattgtggaaggagactctgcgggaggttcagctaagcagggacgagatcgtcgttttcaagcaattcttcctattcgtggtaagatcctgaatgttgagaaagctcgtttacaaaaagttttccaaaaccaggaaattggaagcattatagcagctttaggatgtggaattgggaaggataatttcaacctcagcaaattgcgttataaacgtattattattatgacagatgctgacgtggacggttctcatattcgaaccttgttgctaacattcttctatagacatatgtccgctttgatagaaaatgaatgcgtctatattgcgcaacctcctttatatcgagtgagcaagaaaaaagatttccgttacattctctcagaaaaagagatggatggctatttgctgaacttaggaacaaaagaaagccagatagtttttgatgacaccttaagggatctgagaggggaagctttggaaacgttcgttaatcttattctagaggtcgaaagttttattgtttctttagagaaaaaagcgattccattttctgaattcttggatatgttccgagacggagcttatcctttgtattactatcctccagaaagtgggaagcagggaggcagttatctctattctcatgaagagaaggaagcagctattgctgccaatgaagaatctgcttcgcggattttagagttatataaaggttctgttctcgaagaacttcagcgcgatttaggtgattacggttacgatatccggaattacctccatccaaaaggatctggtattacagtttctacagaagatccgaaaatatctccgtatgtttgttacaccttgaaagaggtaatagactacttaaaaggccttggaagaaaaggaattgagattcaacggtataaaggtcttggagagatgaatgcagatcagttgtgggatacaacaatgaatcctgagcaaaggactctcgttagagtctctttaaaggatgcggtcgaagcagaccatatctttacaatgttaatgggagaagaggtacctccaagacgtgagttcattaagagtcacgctttatccattcggatgaataatttagatatttaggagacagaactaccatgctaaataaagaagaaatcatcgtccctaaaaatcttgaagaggaaatgaaggagagctaccttcgttattccatgtcggtaattatttcccgcgctttgcctgatgctagggacggattaaaaccttctcagcgacgtattttatacgctatgaaacaattaaatctgactccaggagtaaagcacagaaaatgcgcaaaaatttgcggtgatacttccggagattatcacccccatggagaaagtgtcatttatcctactttagtaaggatggcacaggattgggccatgcgataccctcttgttgatggtcaagggaattttggatccatcgacggggatccagctgctgccatgcgatatacagaggctcgcctgactcacagcgctatctttttgttagaggacctagataaagatactgtagatatggtccctaactacgatgaaactaaatatgaacctgtagtttttccttcaaaattccctaatttactttgtaatggctcctcaggcatcgcggtagggatggcaacaaatattccaccgcataatttaggggaattaattgaggctacgctattagttttggctaacagtcaaacctctattgaagatattttggaggtaatgcctggcccagatttccctacaggagggattatttgtggtacagaagggattcgttctacctattatacaggaagaggaaagttacgtttgcgcgctcgtatgcacgtagaggagaactcggacaagcaacgagaaaatattattctcacagagatgccttacaacgtaaataaatcaccattaattgagcagatagcggagttaatcaacgaaaagaccttaacaggaatatcggatgtccgcgatgagtctgacaaagacgggaatcgtgttgtgctggagctgaaaaaaggagaatcctctgaagttgttatcaatcgtctgtataaattcacagatgtgcaggtgacatttggagctaatatgttggctctagataaaaatcttccgcgcactatgaatattcatagaatgatttctgcttggattcgtcatcgtatggacgttatccgaagaagaactcgttatgagttaaataaagcggaagctcgtgcgcatatactagaaggcttcttaaaagcactttcttgtatggacgaagtagtaaaaaccattcgagaaagttcaaataaagaacacgcaaaacaacagctggttgaactatttagtttttcagaagcacaagcattagctattcttgaattgcgattgtaccaactcaccggtttagaagcagataaagtacaaaaagagtatagcgagctgttagaaaagattacttattatcgtaaggttctagctgaagaagagttagttaaagatatcattcgtgaagaactgcaagaattacataaagttcataagacgcctcgtcgtactaaaattgaaatggacacaggagatgttcgggacatagaagatattatttcagatgagtctgtaatcatcacaatttctggggatgattatgtgaagcgtatgccagttaaagttttccgcgaacaaaaacgcggcgggcaaggagtcactggattcgatatgaagaaaggttccgactttttgaaagctgtttactccgcatccacgaaagattacttactgatcttcaccaacttcggtcagtgttactggttgaaagtatggcagcttcctgaaggagaacgtagagcaaaagggaaacctattattaatttcctggaaggaatccgtcccggagaacaagttgctgcggtgcttaatgtaaaacggttcgagcaaggagaatacctctttttagctaccaagaagggtgttgtcaagaaagtctccttagatgcctttggcagccctcgtaaaaaaggaatacgagctctcgagatcgatgatggggatgagcttatagctgctcgtcatatagcgaacgatgaagagaaagttatgctatttacacgtcttggaatggcagttcgcttccctcatgataaggttcgtccaatgggacgagctgctagaggagtgcgaggtgtttctctaaaaaatgaacaagattttgtagtcagctgtcaagttgtaactgaagatcaaagcgttctagttgtgtgtgataatggatttgggaaacgttcgctagtttgtgatttccgagaaacaaatcgcggaagtgttggtgttcgttcaatcgtgattaaccaaagaaatggagatgtattaggagctatttcggtaacggattgtgatagtatcctacttatgtctgctcaaggacaagcaatccgaattaacatgcaagatgtgcgggtaatgggacgagccacacaaggtgttcgtcttgtcaatcttcgagaaggagatacgcttgttgctatggaaaaactatccataaatacagaatcagtggaaacggaagaaaatcttgcagcaagtgttcaatctgggcaggatacaatagaggaatagcgtgtttattgtagtagaaggcggagaaggtgctgggaaaactcagtttatacaagcgctttctaagcgtttaatagaagaaggcagagaaattgtcactacgagagagccagggggatgctctcttggagacagtgttcgaggccttcttctggatccagaacaaaaaatatctccatatgcagaattgttgttgtttttagcagctcgtgcacaacacattcaggaaaagatcatacctgctcttaagtctgggaagacggttataagcgatcgttttcacgattctactattgtatatcaaggaattgctggaggcttaggggagagttttgttacgaacttatgttatcatgttgtgggagataagccgttcttgccagacatcatattcttattggatatcccagcaagagaaggattactacgaaaggctcgtcagaaacatctggataaatttgagcaaaaaccacaaattttccaccagtctgtcagagaaggatttcttgctttagcagaaaaagctccagataggtacaaggttttagatgccctcttgccaacagaggcttctgttgaccaagctctcttacagattcgtgcattgatatagacagggggaggtaatggagagtgctgcttgggaggctcttatacagagagtgcgtgatcagaagcttccttctgctatcattttacatgggcaggatttatccaatttatcagctcgagcttatgaatatgcttctctaattatcaaagaaaccttacccgaagctgcttacaaattagctaataaactgcatccagacatacacgagtactctcctcaggggaaaggacgtcttcatacgattgagacaccccgtgcaattagaaaggatatttggattcatccttatgaaagcccatataaaatttatattatttatgaggccgatagaataacactagatgcgatctcagcttttttgaagcttttagaggatccaccacagtacggtatgtttatactagtatccgctttgcctcagagactgcctcctactattcgatctagatgtgtgtcatttcatattcctatggaggaaaagactttagttagtaaaaaggatatcgcgtttttgattggtttagcacagggtaaggagtctgtgacacgcataggctctcaagtaaaaggaacagctgatgaagataaacaggtgctgcgagacaaaaccaaggctatgctaacggtccttctacaactattcagggatcggtttcttttagcaaaaaaggtgccagtatcattacttgcatatccggatctcctaaacgaaatcaagaccatgccagtctatcctttagaagaagtcttgtctatcatcactcgtgctgtgcaagcgttggattcctattcttctgcaccaagttgtcttgaatggatttgcctgcaactatggtcttttaaaaatcgacaacagatggctattcgtaatcgaagaagaagttagaacatctctaatttacaatcggccggaatatctgctagatccgtttttctacaactatcagaagatagtacccactgcacaggatttagaggagttcctactcgttctataggaaaggtatccctacctaaagggtgcacaagtttatggaaaagatcttgtttattctcaccttgaacgtaggccacaagatgccgcgcttgtcgaacaatcggaaatgttaaagtcattcggcgggtatgtaattgggggacttcattaaagactacaaaacgctctttttcttccagagcttgtgtttctggaaagagagaaagcgtgtgaccatcttcaccaactccaagcattaccatatcaaaaatagcatctggaacatacttctgaatcaacgcttcataagcctcatcccctttgggatctgcggtatccatacgaaagatttgatcttctggaatgcgcaatccttttaagatatccatagcctttagatagttacttccagcttccacatcttcgtttgcgcgctcatctccccaaaataccacaattttagaacagtctgaaatagccgcgcgcttcttcacaatttcttggaaaatttgcaaaggagtttttcctccagaaagagcgacatagaatgcaccgcgtttgtgaatcgctttatttgctgtagagatccaatcataacatgcgatttgtaaaaactcttcttgagagtcagcgataagcattctattcgcatcatttaggctaataagggtagccatgtatataacctcttgcaaaacaaattaatagggccgccaagcttttccatctctagataatagttcatcagcttcttgaggacgtaaagatccggccatatagttagggaatatagggtgtacttgagaccatttttctaatagaggagaaaatagttcccaagatgctaagacttcttcattgctagtgaatagcgttctgtccccaaggatacagtcgcacagtaaccgttcataagcttcgggagtaacagtattaaaatagctgtcgtaacggaagtccatttttacaggacgtacgagcttatttgttcctggaaccttgcagttaaattgtagcgcaacaccttcatccggttgaatacgaataataagtaaatcattatctaacggacacaaaggacaattctctgcattgaataaattgtagctggattttttaaagatcacagcgatatctgttgttcttttaggaagacgtttccctgcttgtaagtaaaagggaacccctttccagcgaggattgtcgataaataattttnatgcaacgtaggtttctactgaagaattcggatcgacattttcttcctcccgatagcccagaactgaaacatcttgcacaatcccttcaccatattggccacgaacagcatcttcttcgcggataggaagaattttctttagaattttaattttttctttttttatttcttcggaagaaaattcagaaggaggttccatagtcagtagacatagcagctgcgtcaaatgattctgtaccatgtctcgtagcatgcccgacttttcgaagaaattccctcgagatcctataccaattgattcgctaacgctgatttgcacatgatctatgtactgagaattccagcaagactcaaagagagtattagcaaaacgaatagtcagaatgttttgaaccgtttcttttcctaaataatggtctattcgataaaccgactcttcatcaatattggcatcaatgcattgttgaagctctcgagctgtttctaaattaactccaaaaggcttttctataattagccgagaccaaggctgttgtgctccttgttcatgatagaatagctgatgccgatttaaattgcggatgatttcctggaaataatctggtggtgttgataaataaaaaagacgattcccttgtgttccatattgttgatctagttgctccaaataagctttcagagcagagtagccttcggcatcagaaaaattagcttggtggtaaaagattctattttccagactttcccaaactcgaatatctatttccgatgagtgagagaaatgctgaacggcaagcttcatttcttcgcgaaattgctcatgagacttaggtcgcctagcaaacccaacacaaacaaagttttcggatagacgtccttcctttgttaaattgtataaagcaggaaagagcttcctagaggtcaagtctcctgtagcaccaaaaataaccacgatacagggagggcaggctggtaatgtggggccaaagtctttaatttcttccaaggtacaacctagtatagagtgttaattttttaagagagagcccacaataccaaaaaaacgaatatgtgcctaaaaagatttctctctcataaaacatggctttgccatgaggggtcctagtatagttttcgagaatctaaaaagctagaaaggattaaagtggcagctagactatccgaagaatttttccgctgttttcgattaagcccacaatcgctttttaacatgcgttctgcttgtgctgaagatagccgctcatcccaaagaatgacttctatagcagtcatttcttggatgagtgcggctagttcttgaatttctgattgcacgcttgaagcataagctttttgcataggtaatggattccccgaaaactactgtcgtaacagcacgctctttgataatagagacgagcgcttgagctgtcaaagtaagagaggaacgggcttctacattccctataggcaaagggatcagaagaggggaactggcaaaagctaggccaatacgttttttcccataatcgatccctaaaaaagcttgttgttgcttagcgatgttcatgattcgctttctccaaagaataggctttagcagcgcgaatgaattctataaatagtggatgaggcttagctaattttgataaaaattcaggatgaaactgtacgccaagcatccatctatgattggggatttcaacaatttcgcaaagctctcctaaaggacagaccccagctatttttaatccatgttcttctaaacgttctatataagaaggatttacttcatatcgatggcggtgacgttcttgtacaagatccgtcttataagcagcagaggctaaagatccgggagcaattcggcaaggataagctcctaatctcatagtgccccctttaacgacagaatcttgtccttccatcatgcagacgactggatctggagtctctggattcatttccatagaattggcaagaggtttgtccaaaacatttcttgcatattcgactactaaagcctgcattcctaaacagattccgaaacaggggatattctgttctcggcaataacgagctgctgagattttcccttcccaacttcttgtgccaaaacctccaggaattaaacatccatcgcactgagacagttgttctaaaagatcttctgattcaggagcaataggaacaagttccaaagagcagtttgctggcacagacgcatggaaaagagcttcgaatacagatttatatgcgtctttatgttctaggtattttccaacaagccctatgcgaacatgttggcgctccttatcacataaagcctccacaagatcttgccaatctgaaagatccaaaggtttaggtgaaaaaccaagtttatttaacaagaagtctgagatattttctttagccaataacaagggcatttcgtaaatggagcgctctaagtctatcgcgttaaaaactgcatgttctggcacattacaaaacaggctgatttttctttttacttccgtgctaagtggagcttcagaacggcacaaaattacatcaggagaaattccaatgctgcgcaagttctgtacggaatgttgagtaggtttggttttaatttcttttgcagctcttagataagggacatatgtcatgtgaatgctaaggcaatcctgaggatgttcgcagcggaattgtcgtacagcttctagaaaaggtagcgattctatatctccaattgtccctccgatttccacaataaggatatcaggcttatggtgatctgcgcacgattgaatgacattaataatctcattagttacgtgagggataacctgaactgtactgccaagaaattccccattacgttccttagtgagcaccttagtataaatttgtccagaagtggcgatggagtatttagacagttgtacagaagaaaagcgatgataatggccaagatcgagatcagtttctacgccatcgtcggtcacgtatacttctccatgctcataaggattcatggtccctggatctacgtttaaataggggtccaacttgagcatggcaactttcaagtcttgtctctctagtagaagagctagagaggctgcggtaagtcctttacctaaagaagaaactacgcctccagtcaaaaagatgcttttgaaagacataataaatactgctccactttggttatatcttcgggataatcaacagaagggcccgttgcattctgaacaacatgaacgtagatagaacgacctgtttctaatactcgtaattgttcaagatcttcggctaggcttaacgaggaaggaggaattttaacatattcacttagaaaagcttttctaaaagcataaacaccaatatgcagataaataggtgttggatgtttaaagttgtgaggaatagcgcttctgctaaagtaaagagctttgccattcttatcgaaaacacacttcactttgtgatctgtcaatatcgcttcggggtctgttgtttctgtaacaggtgtgaccatatctgcagcaggattgttctctagcgtgctcacaagcccatctatgacggtaggagataaacagggctcgtctccttggatgttcacaacaatctctgcttgaggaaaatgtcgagacacaacctcttctactcgctcagttccgttagcgcaagatgtgctagtcatgacacagagccccccaaattcaacaacatggtcaaaaattcgttgatcatctgttgccacaacaacacaatctagagattgactgcttaaggcattttcataggatctttgaacaagggttttccctagaatttttgctagaggttttccagggaagcgggagcttccccatctagaggggagaatgccgacttttttgctggttaaaaacgcaaacatcgcacccccattaatgacgtcccacctaagaagcaaaacttcttatacagtaggcccttaccaaacatattcatataactagggatctagtacacagaacccggccatcctaacaaggagatcgttaacaatcaagattattcacagagctactagctttcttaacttattggataatctatttgattatttttcacgaatgaaacgcggaaggtgtcgaatataggaacgaagagagcctatgagaaggcttgtaaatatctagaagtgtatgatttatgattttatttactatttttcttataacaaaaaacctcatgcgaggttatcataaagtaacgaaaagcttttatattttataattattatgctttcaaagttctgcaaactttctttatctgctatccttttaattaatactttggctccttcagaagctttttctgaagaaggaacctcagggtttttagggaggatgaagtcctggatcttaaaggacaagactattctctctaccacagaggaatctcaaacctctgctatcgaaaaggtttcggatctcttgtcttggaagcgttatgattacacacaggaaagcggttttgctatccaatttcctgagtctcccgaacattcggagcaagtgatagaagtccctcaatcagatttggctattcgttacgatacctatgtagcagaaactcctagtgatagcacagtttatgtagtgtctgttttgggaatatccagagaaaattgatatcagtagaccggaattgaaccttcaagaaggttttgcaggaatgttatacgcacttcctgaatcgcaagttctatatcttaaagcaacagctctacaaggacacaaagctttggaattttggatcgcatgcgacgatgtgtattttcgaggaatgcttgtctctgttaatcacacgctgtaccaagttttcatggtgtataagggacgttccccagaaattttagataaggaatacagcacctttattcaatctttcaaagtcactaaggtgcgaaactccaaaaaaatggacataagaaagcgtgtatctttatagatttttttctttcgcacagaaaaaatccatttttgataatcttttcttgtgcttaaaatcgctcttggattaagatagcgctttgttactgagaatcttcggtaacagccgctctcaaggggacttagcttagttggtagagcatctgatttgcattcagaaggtcaggagttcgaatctcctagtctccatccctgcggttatagctcagttggttagagcgcgacactgataatgtcgaggtcccaagttcaagtcttggtaaccgcaagtccagaaatatttcttatttcgttcgtgttttcccatgctagacgtaaaatctctgtattattctcatgcatcgcactctgtttttgaagatgcatcagctggctttgcttctggtcagatttctatggttctgggggcttctggaagtggtaagactacattatttaggatcatagtaggtcttctctcttgttctttaggagaaattctctggaaagggcaacctatacagcaggagcagatagcctacatgcagcaaaaggaagctttgttaccctggcgcaccgttagaaaaaatattttattgttaacggagttaggatcgcgcaaacagaaaacaactattgaagaagaatgtttctacaatgttgtgcattctttcgggctatcttcattgttagatcgatttccagatgaattatctggaggacagcgtcaacgtgttgtgtttgctatgcaaagcttatctccaaagcctattttgctgttagatgagcctttcacgtctttggatcccattacgaaaganattttataccaagatgtgaaaagattagccaaagaagaaggaaagacgatcatactagcttcgcatgatgtgcaagattgtttgggagttggggaagcctttttcgcgatcaagaatcagaaactccattcaattgccttaaataaagaacaaggaatcgctgggttattgcagcaaatgaaggaccacctagtttgacgatacctcctttaaaacttgtacaggcagcacgtcctctttatgatcagcaattacataagctttcaagagaggaaaagctctctttacagggtgaaattcgcactcatgaagtcaggagcgtccctctagtcttttttgctatgcttgcagcggtaggagcttttttagctttgtgcataggtggtgtactgtgctgtattgacaatgtagtctttctttcagagatctttcttccattcattcttccaggaattttatcgttacttccaattgctttactgcttcgtttggcatggaaagaacaaaagcttgcagcccaaaagcaacagagaattgcagcgagctgttatttcgaatccctagctctttgtagaacctataaatcgggcgcaccttctgtaaaaggtctcgtgaactttattcaaagcgagattctcccttcagggttttctaaaagatttaaatttgctgtattgacacaagcaaaaccttctttgttaactaaaaaaatccagcttacgaaaacaccttttgatgaaactatagaaaccgctttttcccatattcgagaagggctctatctatcagaatcggaacaacgagatcacgacaagaaattanntaangaagcaaatacttctcccaaaggttagactataggcgtcccatagataaaataataaaagcaatacccgatactattatagacaatagagtagaggcttccagtggaaggtgaaaaatgactggagaaagaataatccctgcagcaaacaataaactcaaccaacggagatgacgcaagctttctgcgaatgaaaaaatagataacacaagaataaaccagcaggcgctatttacaaagaagcggcatgtgtcaggaatagataagtttacattcagttgcacgaaaaaaatagagaatatgcaggcaaaaataagattcaaagggaaagataatcccgcaaaagcctgcttacacgcttgggagaatggtaatacagaacgctcttcccagaacaaagattccttatagtattcagacccgtaaaaggctgttatggctagctgttttctatttgagtaattttgggaaagataattccatgttgctcgaatttcatcataaaaaaatgctaaagaaaacaccggagctactgtcagacacacaccttcataatttgtcagaaatagttgagataaaagaatagctgctagagttagccctatagctatgaataatagaattgctgtaatgaaaactactttgggttgagtatgccagcgacgctctccgccagtcaaagacaacacgataagcatggagtaaataaccatcagtgtagaggaaaaaaacaaggagcaggaggtgtctgcatcagcaatattgagtgctgcggaagttaagtagcgactttgtaaccatcctacaaaagcaaaaataagaaccgcagctcttttccctccggaagaaggattataatggcaagtttctggaatagtaggaccaacttctagatcttcaggacgattagggattagaaaaataatagctagtgtagcaaaacctagtagcgaatcatgagcaaatactaaaggaagtaggtcggaagaacaagaaaagaaagaaacccagagcccaataaaaatgcctagttgcaaaataacaggattataaaaggataaagctgataataaaattaaaaggacgccgcaaattttatctgataaaataacagaagaatccaaatagttaagaatattaggagtaaaaaatagccagagtccgagaagagctggaagtatacttaatttaaaaaaacggtaacggaaatgacgataaacattttctaaaaaatccttctccatacaccaagactagttgagtttcttgactcataagaagtctgagagaaaagaaaaagttttttttaataaagaagcttcttttatttcagcaagaaaacggtttcgttttttttatttttgtcttatctcaatccttaacggaaggatggatacgagaactcccttgagaaagaagatccttattatttctacggcactaggatttgttttgtgtgtaggattaatgatacacactaagcgttcgattatgccaccaaagacgcatattccaaccacagcaaagtatttccctacgataggggatccttatgcacctattaatatcaccgtttttgaagaaccatcttgttctgcctgtgaagagttttcttcggaagtatttcctttgattaaaaaacattttgttgacactggtgaagcttctctgactttagttcctgtatgttttattcgtggctcaatgcctgctgcacaagcattactgtgcgtttaccatcacgatccgaagcgtccagatccagaagcatatatggaatatttccacagaattctcacatataaaaaaacgaaaggatcacactgggcaactcctgaagtacttgcaaaattagcagaaaagatccctacgcattccggaagagaaattaatcccaaaggtttaatacagtgcataaattctcaaagatttacggagcagcttaaaaagaacaatatctatggatctcaaatcatgggtgggcaacttgcaacacctactgcagtcgtaggagattatcttattgaagatcccacttttgatgagatcgagagagtgattactcaactgcgtcatctacaagcgatagaagaggaagtccggtgatcaaacacttacgttcttattgtttatatcttgcttggctgttttcttgtataggaacgcttatgagtgtttattacagctatattctgaatgtagagccatgtcttctttgctattaccaaagaatctgcttgtttcctttagttgtaattctaggtattgccgcatatcgtgaagatatttcaattaagatatatacgcttccattggctcttgttggtttcggcattgctatttatcaagtgtgcttgcaggaaatacctgggatgactctcgatatttgcggtaaagtatcttgctctacgaagctatttctattaggtttcatcacaatgcctatggcttcagctgcagccttttgcgctattgcttgtctgcttgtgttagcaacgaaatcaaaataatacatctcgttgctatcttgggacgtctatccttcagctaatgaaactctttttaaatcaatttctccaagagaagaggtttggagatcagacacccgaggctgtttcgcatacacataatcgaggtggtatagaggaataagaggactttctttaagcaacaactgctctgccataagctgtaggtcgcttgattcttgaatcagaagttgagcaactatatttgtgtacttttggttctgccagttaatcaattgaaagtctttatatcttgtcccattacctaggacagacaggaaagcactagcttgatgatagtctgcaatccaattaccagttgctaaggagaattctcctctggaacgtttgtctaaaaaacaatgatattctaatcctaatgtagaaattttaaatcccagtacatcaaataattgttggcgaatttcttgaacaacggctcgtaagcaaacagattctataggataaattaatgtaattttttctaaatcttcttgagataaagtctttaaagcttcggtcaagtagccttttgctaaagcaatccgctcatcttgagacaaagtagtagcaggtatctgagataattgtgggtgaacaaagctcgtagcgctacagcctttacctgctagttttaataaagtttctcgattgattgctaaagagagggctgttctcagcgaaggattatttaaaggtgtttgatgaatgttacagaataaaacagagcaactcaatacaggataatcaaataatttttctctagggagatttctttgttcttctaaagaaaaggaggagctccagggtaacccaactaaatcgatatgatttttttggaataactgcatagctgtatggatatcaggaactatctgcaaacataccgaatttaacagaacatcgtgcttggcatgatacagagggtttttgttgattagtaaatatctttgcggctcataacattgaatcgcaaaaggaccattagaaatcatcgggaaaacgcgtttgttacgcttatctttgtaatattctcgtaaagaggtgtgcaccggataaaaaaccgggtgcgccaatatctctagaaaataaggaaacgggttttctaaaacaatttctagagatttcgcattcaaagctctaacacctaaatcttcaacagggagagctcctgttaaaacagcatgagaatttttaattaatgcaagagagcgtaacgaagggttatcaatttctcggaaataaatttgtttaatagactcttcaaaatcatatgctgttacaacatctccgttgctccagaatgtattttttagaaaaaaagtataaacacaaccatcatcagattgatgatatctttctgccaaagctagctggaacgcagcttctttttcccggactaacccttcatagagagcttttacaatagaaacatctttgcttaaaaaaacctgacgcggatctaaagacattggatcatgacagatcgcaatccgcaaaacatcttttggttcttctttttgatgataacaagatgttagcccaaaagctaaacttacgaaagcaatggaaactgctaaaaacttcctgtgatgcatagagtttcagcaaacaatcaaataatgttgtagtactttcaataacgtcaattacctggccaggngattgtacaaaaaaccatagcaaaaagccaaaactgtttttctgttaccaataaaaaanaagaaaaaccttaacaattattcaacctctctataggatgctgggcatttttttcataaagggggtgtaaatgcttatttttttcgataaatcacaatcaggtgcgctacctgatagactagaacgcgctgggaatcttctgagatttgctgtaatagggggatggcctctcaaataaaagtaacttctgctcagtctgggcatatctcttatcagagaaatccaaaacaatttgatcaagccatcttagacatgctccggctattttgtttaggatatttccctcagttattcgaaaaacaaaaaaatctattagaagatcttatttacaataaactgtttgtagaaaaaaccgtagtaatgggtgagggagcatgtgttgtcaatctagcaatagggggggggtagactattttactttaaaacctctaccgaatttggttgagaaaaatgaattatcacaacactgtttgtaaaaaccagcatgtttttcttggcaaaaagactagttcagttaaataaaaatcctttcttactcaaaaagttttcagaaacaacggttctttttatattcgaacgacaacttaaaatgtgggaaggttattctatagacgagaataattatatatctgattataacatggaatttgggcgacctttattacaaaaactagcaaatccagtatgcaaagctttgttgcaaaaacagctcgaagccgagcaagcaatgacgttatccaatcaagtcactgttggagatatagtgcttatgcgttctccaattttcgaaaaatctgtattattagaagctttgatcaacgagattatttatcaagaatcgttatttttgtttaagaaaccagaaaattgttcaatgtccgaagatgagtttcgagcacgatgcacacgaaatcttgttgaagatctttttgacggtctcatgaatctatgggttcaaataaagctcatcaaaggatatgattccatgcaagactatcaagagtgacggtactgtcgcatattcttttagacaagttttgttcgaaaagagaagcctcgtaaggggctttttataaaaaacaaaaggtctgataatatttattatgttgaattaggagagttgttatcttctaatctatacagacaactatgaagcccagatatcgatgcctgggcttcatattcatattcataaattatccaggaataactgtttgtgcaagtgcagtcagagtctctaccgaagaatccattgttgtttgatgaacaaacgctgttttcacaatgaaaccatctgaataattcagcacatgtgcagcttcttttttatcacaaatatctcttctatctacaattggaagatcaaaatgttctctgacttttcgaaattcttctttgatacctacttcagaatctctcgtagcttcatatgggatataatacagaaagcctcttgcgtattcttgtattaaagacatccgttccggcgttgtccctgcagaaataagcaaaataggatccaatcctacagctaaaagatcttcaaaaaatggagatttttctccgtgtgataaaggtgctggaagatctataacgcacacaccatttattcccgcgtcttttagtctgcgtagataatctaagtccctttgtagaagcggattgtagtagctatataagatcaatgggacttcttgattaaaagctcggataccttctacgatctctaacaaagtttctgacgtcagattttctgctaaagcccgatcatgagatacttgaatttctggattatctgcaacaggatcagaaaaaggaaatcctagttccagaatatcaacacctccttgaatcagagcttttgccgcctcaatagtataactagtaccgccatcaccagcggttagatagccaatacatggcttagtttgtttaaaaacttgggttaatttactcataaattcctctgtttctgcggatgatttgtggaagatccttatcacctcttccagataagttaacgatgacgatttgttcctttggtagagaaggagcaatcgaaactaaatgtgcgagagcatgtgaagactccaatgcaggaataatcccctcatttctagtaagcaggaaaaaagctcgtaacgcctcttcatcggtggctaatgtataaaaggctcgtcctgactcatgcatttcggcatgatctggcccaactgaaggataatctaatccagcggaaatggagtgagtttgtaatacttgtccatcgtcatcttgaagaagatacgaataaaatccgtggaatactccaggtcgccctgttgcaaaacgtgctgcatgttttcctgaagaaatgcccagtcctcccccttccactccaattaattggacttttggattcgggataaaatgatggaaaaatccaatagcgttggagccacctccgatacatgcaatcagaatatcaggatctcttcctgcaactgcatggatttgctctttcacttcagcgcttataacagactgaaaaaatcgaacgatatcgggataaggtaaaggtcctaaggccgatcctaagcaatagtgagtaaatgagtgtgttgttgcccaatcttgtagagcttgattaactgcatctttgagtccacaagatccttttgttacagaaacgacttcagcacctaaaaagcgcattttctctacatttggtttctgtcgttccacatcttttgctcccatgtatactacacaatctaatcctagataagcacacgctgttgctgttgctactccatgttgtcccgcacctgtttcagctacaacacgtgttttcccaagatatttagcaagcaaacactgaccaagagcattattcagtttatgtgctcctgtatgcaaaagatcttcgcgtttaagaaatactctagggccatcaatagctccgagcaaaattcttaacttcagtcagaggagtttgtctccccgcatagtttttcaaaatacaatctagttcagataaaaaactttgctgagttttgagaatctcccattccgcttttagattctgtataggggctaatagttcttcgggaaggaacgctcccccaaaaggatgtttatgtttgaacatcttttctccataaaattatagtgttaaaatcatagaaaaaactggcgacagaataatcctgcgcaaaaaagacgctcttacttctataagaacatctcttaatcaaataaaaggcttcttaattaggcctatcgccaagtagataagcgccagctttcaaaagaaagccaggcacgctgtaagaggatgaatttttgaatatcttggaagcaatcagcttgaaaagctgatttgcatggcatgctgcagctatacttacgtaccaaaactgctaaaacagaatatttgttcattaacaacgcgtgcatacaaatactttcaatcttatttgtattttacaaaagaagatcagatctctttttgtaaaaactctttaaattgaggatctgatcctttaagggcattagatcctctggtaatttgtgcgatactgactccgtatttctctgctatctctctttgagtgagctccccttctaaaagagctcgaatgatatgatagcgagaagcgacatctttacgttcgccaaaagacaaaaacagcgaaaaaaggtcttgtaaaaacttttctttttgcattttagagcataatgtcagaaaagcttgccagccagactcctcttgatttttcatatcgcacctttttgtaatgctatagtattacaacatttcataaatatatgctaccttattttcttttcttagaattctcccctccaggaataaggatcacgttcttatctgctcgcaacctacgctcttcttccgtcgctaaatctaaaaccacataaattcgtttctgttggtagtcgctttcatccacatctttgaccgttaacactagtcttcagtaatgtcgcatagcatatctccaggagcttggtgtggttgcactttcccttctaatccgtaaatactatagaagacttggaaccctcctcgtctattctgccgagcaaagtatcctgtttgcgttgtaatcaacgacacctgaatgcttcgtgcagggagctgaatgagagatcctcttcttagagactttttcacccaatgctctacccaagaacggtaataagcaaatgcaaattgcaagaatccttcagggattttccagtgaggcttcccagctgtatccaaggacatacaagcttcagaaggtaattatcataagccttcgctctcttcgactctcctcttgctctatcccgaagattccaaagcatgaatgcagtgtaagtatagaatttcattgcttaggaaaacttctttatcaactggatttcaataaaaccttagtggataggaatcatactttcgaccgcaaatgtcattgtggttgtagatatagtaatctcgcagactgaaagtatgtccgtccacattactcttacctctaattaagaagtattacacatgctgcatagaaaacgttcggagaatctaccataaagcaagagttttcagaagaaaaaaccatttcgacctgataatataggattagcaggcccagaatctttggaatgagaaagttcgattagccaaaacagattccctctattttggatccaacaagaactactccacagctcatacaactactacttataaccaaacaaggcatagtcataggaaccctaagcaataggagcaaggagctaatcattagcagcaaaagcccaatagctaccaacgctatagatgtaacccgatacgtcttcacaggctctttgtttgtttctctaaactgaaaacaagaactacttttagaaggtgttgttgtggaggatatcgtcataactcaaaaaagtatatcgtatcgaaatagagaaaacctctcaagtgatgatctaataacgaatgcgacaatactgcccttcaaaaaaatcatccatagaatcataagaataaatatttcctgttgctactagctcttccattactgcacgtaaacatagagaagcaagcgcctcgctgatttctttctcctctggaagcaactgcaatttcttgtttaataattctgggagatttttaatgaagatgcttttccggaagataggagatcgacacatgataaaagtccctgaagaatttactcgtttagcctcttcagtatgagactgatagatgtttgtagaaacttgctcgagtaacgatgacgtaacctgggagctaatagccaaccattgcttatccgaaatagcactcaaccgctctcgaatatctggagataacagaacattgagtgctccatttaatcgaatagcagcttttaaaatatcaaaaattttcagtgagaatctccatacttctagatgaagataaggggcacaattacgcaatggcgttacgcttttttgggaacaaaaatctggatgccctagcatatgttcaaaaaaagcaagccctttctctacagaacgctcgacctcctttgtagagaaagggatttgtagttttttcgcctctgtcatgagaagctctttagacataggaaacatcacagctagttcttctacggggcatggatgtggagaccaagaaaaagtttctagatcgaccagtcctatacgcccttctggagagccatcttttccttcttgaataaataaaggtaaattatcgtatcgtgggcatacccaatagttgtgtactttcacggctaaggggaaatcgtctgttggagactctgtttctacaacaaaatccctgaaatgcacttctttaaatagaaataagagttctttgatcgcctcatcgaaagcttgtggattttctttatagagacacattgaatctacagaaattcgtgaaacaggaagtttttcttcgaatagaaagttttctactaaagaaggaaactgttttgaaatatatacaagagaccgtccttctgggacccttgggaatttttctccttctaatagtttttgcccccattgcttacacgttgttaaagtttcttggttgagcaaatgatttctaactagaaatcctctacaaaacttctgaagcgtaatgactttttcttccctatcacggtattcatctaaagcttgcttttgttcatatttataacgaaagcgttcttgtaaagaagtctggtaagtagaagaaaacctatacgctaataatcctaacacagtggccaataacatcagaggccctgtgagaatacagatcacaatgtttgcaatacgacgacaacacgaaatctctttatgtgagaaatagcatgaaggatagttagggatttgtttcacacgatataaaacattgatccctcttgccacacaatggagaagaaagtttcctgtcctttcaaaaaaatcggggacatccgctctgcaacgggatttatcgaacgacacaaacatttcaaggccctctgactaaaaattctggtcaattttggacccaaaaaacaaattttgttaaggattttttaaattaaaaacatctaaaaaaaacttattttgtgtttgtaacttaaagagttacattccccgcctctaaaaaattcataaaaaaattaaaaaatgcttaacaacaacactcttacctaacctcttttccctttttacaaaccgcaatagagaaacactcatgatcgtaacatttgataaatacttggcgccggagctcggccctgacccattggagcgcttagggaacgttcttctctatccaatcattcgaggatttgggtctcttgtatctgttaaaactttaggagaaaaacgattcctctgtttttcagacaaagtggtgtctttgtgtgtaaacgcattctttgtgtggtatgcaatattctcgcagcacctattacgtgtttgctcgctttgtgagggctaattgcctacaaatgtttaacgacctatcaaactacacgaactatttttgatcgttttgttaaaacgcgaaacgcggctaaggtcgctttccaagaacaacgctcccccattatcactctacaaaaatatctacgtggctagaaaacctttagtagatagagatcatttccccaagtatcggactatttgtgatgctattatggaaggaaatcttgaaaatattcgtttcagtgataaaacaggcgaatcagtgtattcttccaaagaactaccttccgtattgttcaaaagaattgggcaaaagaatgctaaacaaagggtgcttaataacatcgcgctaaacgcttatcttgcgaaaacaggcgtagatggtttacaagtactatccgctagcacttacaaagatttcttaatcgaagacaaaccttttggtaaaggtgctcttgatacccttatagcttatcgattgaatccatctttattcgacagagctgtcaagagtctgtgcaagctatttagcttttaccattgcccggatctattcgtaaaatccggtgatttgctaaaagattcccctcattcgaaactcctattaggtttcaaagaaaacaatgagtctcttgctgcagaatcggcgactcttcagcccattctttatctcacagggatccaatgtattcttgaagagcctactccagatttagaagcaaaactctcttctctattcccgtatcataaaacattaattcaacaggaattaagcaaactgcgagtttctaaaccgaaagtagaagcctctaaagaacctactcctccatctacttatgatgagcgcttaaaaagctctccccctacagaaatggaaaatttttatgactgagcaacctcatcgactttctgaagaggcgcgatcgatagccaatgaagcaaaagaacgactactcaagctaaatgacaagcctgagctgtctcgtccttatcttgtaaaaggctttctaagcaaaatatctcgagggatttccgataaagaggctgcgtctaaattctctaaagctatagttacatctctactaggatatctctggaaccacatcctccagaacaaagaacgtatcctttcagcagatgctcgcgatttggaagcacactccgcgctcttagatacgaaagaaattctcgccctttgcaagtattttgctatcaatcgttgcacgtggctttcctcatctagcactcaagaagaagaaaacttgatctgtcaagatatagctaaagaaatgttttcttctctttacatgctcttgtggaacaacagtggatcagaggatatgatctttcagtaaataacggatcctcttataaacttttcttctaagttctctcggaggcagaccatccctctgcctctttctctcacaatagagcgcaaagcttccaattaacgtctgtataatagaagcataaaggtctttaaaaagatcccattctttttatctaggtcgttataaacaaataaaagaacgtatttttttattatttaaaaacaaaagcacatttagtctaaaacgtttagacgtcgaaaaaaaagcttcttttttagtatgagcgttaacagaaatcacaataattttcctccctacggagagaacgaaactcctcctccagaatctcaaccaactgatggtcccgaagatccttctatgcagggagcttactacattgctcctgaggatcttcctcagcatcagttagctgctgctgtagaaggactgcatatcggttccacactcaatccaaccgcaccagaattcactcccggagctgtttctcatcacttcgagacattcactccttctttccctccagcgcctcaacagccttaggctgtattagacccttacgctacatacccttatggggttcaatccccctatcttgagtatgctcctcctgccgttgtacaagagccttacactacaactggacaacaaggcctttcttcctatccagaagccgctcctcaacctccagctctacaacaaccagaatctctccctcaagctactgccagagatagaggggatttagaaaaagaagctaacaacacgaactcttttgcaacccaagctatagaaacaactccttccaacatctctccatgtttcaatttacatggagaggctatacaactcttctctacagaatctggaccatctcctcttcgagctattcttcaagcgattaagcaggcaaaataccatatttatatacaaatctataggtttacttctgaagagattgctgcagctcttctagagcgagcgaataacggcgtacggatccattacaatatcaatacatctgctgcccaaaagcccttattcgacatcctaacgtgcaaattcaaagctactaaccaggcgcgactacactgtaaaaatatagtagttgacggaagcctagtgattacaggctccgcgaatttctctgacgccgcattctctcgtgacatcaacctagttgctatcatccgcaatccatctcttggccaattggtcgtctcccaacaatctggctggattaccggtggctcgcagcaaatagaatactgtagtctatactgccacaatcatcaaggagttgatgaagttgttaaagcggtacaatctgcagtaaaaaccatccgcgttgctatgcttgttctctctcacgaagaggtccttcacgctcttcatcaagcggcgcagagaggggttgaagtaacggtgcttgtcaaccctcacaataaagccgttctattctatgccttgcaagatctcaactcaaaagtcaaacttcgtgacgtggtagtggaagagaatgcactcctccattgcaaagtcggtttaatcgataccaacctccttatcacaggttctgcgaactggactgtccgaggtcttcaatacaatatagaagaccttatcttcatccatcaaccgacacctagccagctttctgccttctttaatttgtgggaacaagctatgtccctaagccgcgaagtcacagctaaaaaaataaaaaagtcagctcgtgcacaacataaatacgacgatgaataaaaagtaactcatcttgtttataaaggattttttctttttctaactttttagaaaaaaaagacaattatcttataatctttcttatttaggtctctttcttttctagccaggaccttaatgttatgagtgtacaaggcttttcttctttaaaatacagcgatctttttaaacctccggnacccgcttcttccacagattctcctaaagaatctgaatggaaagtaatctctcattctcgaggacgccgtcgcgctcgatccacccccccccccccctcacacatctcaaaatactccttctccaaaagactcttctttagttgctcgtacggataaagcggcaacagatatctttaattcggctaaacacaaagcgattgaaacgacaaaaagaagtgatcagcaaagcagatccttacctatactgcaccttttagctgcagatccggaacccattgtgttccactcaactcaccaaacaaaccacaacgatccgcaaagaatgctatgcgatgctatcctacaggctaaccgaataatcacaatgagaatttttaatattggttctcctgaaattattcgggcattaattcgagccgttcgtcgcaacattccggttattgtttcagcatggaactttcctaatctatccaattgggatcgggaatctaaactctatgtggaattgagaggcaatcctcaaatttgcttacataagaaaacgacactgattgacaatcagctaacaattataggaacggctaactacactaaatcttctttctttaaagacatcaacctaacagctcttattcaaaacccggcgctatattctttaattttgagcggtactcgaggctcagtttctatcggctcgcaaaccatttcctattacccacttccctttcctcaatccaatactaagaccttgcctatcatccaagagattcaaaaagctcagagaactataaaaattgctatgaatatcttctctcatcccgagatctttttagccttagaacaagcacgcttacgaggagtaaccattactatcgtaatcaataaaaaagagagcgcccatacactagacatattacacagaatctcagctctactactgttaaaatctgttacaacagtagattctttgcatgcaaaaatctgtttaatcgatgatcaaactctgatttttggctcaccaaactggacttaccatgggatgcataaaaatcttgaagacttgctcatagtgactccactcacacccaaacaaatccattcaattcaagaaatatgggcctttttattaaaaaatagttctcctgtttaattcgatattaaagattcaattttaaactttttgttaaaataaagtatttgtttttaacaaataaactatattgaaaaagcgaacaacaaaactaaaatagttcgaattaatttaacaaagttaaaaataatgagcgtttcaggttctagtacgtcacgcggttcttctccgctacctattcgtgaaacccctttgcctcgaaacccctcttcaccaagagatactgtatcccaggctatagatagaatttacaaacggaatcgcaacccatagacccctcctgttgtttgctatgaatacgatcatggaaggaacagacaacctgttcgcgtctatacgaaccctcgctcccactctacgtcatcgcgtaacatctcttctcctgaagaccgtcgccccactccttcgcaatacaaatctcgagaatggagaattccatcatcacgatcaagacaggacgatagaagtccttcccctcaaccctctacctcttcagtatccatctcccagcaaatgctcgccggctccaagagaaaacacaagactcccgaagacacttcttcttcctcctctaaacgagcccgatcttcttcgagccaagtcgtacctagactcttacagcatcacgaactgatccaactctactctgctcatcagcaaagaaataacgaacctgtgaaaatgatttgtgaaacaattctacaagctaagcgcagcgttctattaaaagtatttaatatcggatcccccagaattcttgcagccttagctgaggcttctaatagagcgcctgtctccgtacactatcaaatggggcctttttcaaaacactgtactgaaggaaatgtgcagtttagacctcgaagagggtgttctcttttacatagaaaaacccttcttatagacaataatattgtcgttacgggaacagcaaactatacagaggcctctcttgaaaaagatgtgaacttaacggctaaaatatttagcgaacacctatatcgctgggctttccgacacgatcgaggagaggtgcgagtaggctcgcaacaagtatcctactattcgctaagtcaaatacgaagagacttatgcgtcaaagctatcctcgaggctaacggcattgtcctacgagaacgtacatgcgaaggcattctgcataccaaagtctgctgtattgatagctcgacactcattataggatccgtcaactggagtagaggaggtcttacattaaatctggaagagttcttgattatcaatccgcttacagagacacaactcgaatgctataacgagctttgggcatatatagaaacaaacagtagattgatgactaaagagctgattcagttacatgagaagagaaaaaaatccataacagaccctaagcaaacctcttcttctactcaagacgaagagaatgcttccacatcagcagaacagcagtaacgaatggagttttgtagtcgaaagagaaggcaagtttcctgccttctcagaggaaagcatctaaaccttaataaattaggtgaaaatatattatgagcattcatggttcatcagggcatagccacttacatcctaagagttctagctattctcatccgcatcgccgcgcacattcacctcgccattcttctgcagaatcatctcctacagctcggtccgtttcaagagcttatcgatcttcacagccttccgacaatcgtccgagtctcggaactctccactaagagaaactactggaagctcctcccgacaccgctaccatcgccatggagaaacctcttcatcctctcgcattgaaacggtaggctctaggcacttttcatctagacgcgaatcttccagaacaggttctcgctctagcagacactctgaacgtgcccgtcatcacgaatctcgctcacatcggcattcctcatcatcaagacatcatgttacgcgatctcaatcaagcgcactccctcaattgcaagagcgtcctgtgcctcatccacttgcagaaagagagttgattacattccattccgtacatcagcagcagaataataatcctctaagaatgatttgcgataccattcgccaagctcaaagagggatatttatgcgcatttacgccatatcatctgatgacattatccaatctctaattcagacttcgcaccatgttcctgtagaagtcaaataccattgcggagaaagcttacctgtagcatgtcaaaactcgagagtcgtcttgcgtccgactaacggaagaaccctccaacataaaaaactatgttggctgatttccaaacagtagttacaggatcagccaactacacggacttgtctctcaatcacgatgtcaacgtgacggcatgtatagaaagttcagaattacatgacgcagtcttttctgaaagaccccaactggttcatgtcggacctcagctgctcaattacattcctatccagcgtttgattcctaatgcagcatcaaaaatgattttgaatgcaattaaccaagcaacggacagtatttttgtcttgatgtatatcttcttaagcccagaattcttcttagctcttgcccaagctatgcgaagaggagttcgagtaaaagtaatcatcgacaaccattccaaacaagatacatgcaaactactgagcaaattgggtatccaacttcctctttacgaaagaaaaacagaaggcattctccataccaagatttgttgcatcgacaataaaactccaatctttggctctgctaactggagcggtgctggtatgattaaaaactttgaagacctattcatccttcgcccaattacagagacacagcttcaggcctttatggacgtctggtctcttctagaaacaaatagctcctatctgtccccagagagcgtgcttacggcccctactccttcaagtagacctactcaacaagatacagattctgatgacgaacaaccgagtaccagccagcaagctatccgtatgagaaaataggattagggaaacaaaacgacagcaaaccacacattataaaccctttacggcaaacagtgatcgactctcctaatagggaagtgattgaatagaggctaagctcctcatcagtttctttgcttttctttaaagcaagttccttccattatagggtgtcaatcactgtccagcccggagagtttttaatgactaagccttctntcttatacgttattcaacctttttccgtatttaatccacgattaggacgtttctctatagactcagatacttatatcgaagaagaaaaccgcctagcatcgttcattgagagtttgccactggagatcttcgatataccttctttcatggaaaccgcgatttccaatagcccctatattttatcttgggagacaactaaagacggcgctctgttcactattcttgaacccaaactctcagcttgcgcagccacttgcctggtagccccttctatacaaatgaaatccgatgcggagctcctagaagaaattaagcaagcgttattacgcagctctcatgacggtgtgaaatatcgcatcaccagagaatccttctctccagaaaagaaaactcctaaggttgctctagtcgataacgatattgaattgattcgcaatgtcgactttttgggtagagctgttgacattgtcaaattagaccccattaatatcctgaataccgtaagcgaagagaatattctagattactcttttacaagagaaacggctcagctgagcgcggatggtcgttttggtattcctccagggactaagctattctctaaaccttctttttgatgtagaaatcagtacctccatttttcgaagaaacaacttcatttactcgaagtttttctgcatcggttacttttagtgtaccagacctcgcggcgactatgcctcttcaaagccctcccatagtagaaaatggtcaaaaagaaattttgtgttattcaaaaacacttattcccaagctactctcctaaactagtcgatattgttaaacgatacaaaagagaggctaagatcttgattaacaagcttgcctttggaatgttatggcgacatcgggctaaaagccaaatcctcaccgagggaagcgtccgtctagacttacaaggattcacagaatcgaagtacaattaccagattcaagtaggatcccatacgattgcagctgtattaatcgatatggaatatttccaagattcaatccaaatcagaacaagcttaatgtaattaggaaaatcaaatcaggctttcaacgcagcttggatgactatcatatttatcaaattgaaagaaaacanancttttctttttctccgaagcatcgcagcctctcatccacatcccattccgaagattctgatttggatctttctgaagcagccgccttttcaggaagtcttacctgcgagtttgtaaaaaaaagcactcaacatgccaagaataccgtcacatgttccacagccgctcattccctatacacactcaaagaagatgacagctcgaacccctctgaaaaacgattagagaattgtttccgcaattggattgacaacaaactaagcgccaattctccagattcctggtcagcgtttattcaaaaattcggaacacactatattgcatcagcaacttttggagggataggtttccaagtgctcaaactatcttttgaacaggtggaggatctacatagcaaaaagatctccttagaaaccgcagcagccaactctctattaaaaggttctgtatccagcagcacagaatctggatactccagctatagctccacgtcttcttctcatacggtatttttaggaggaacggtcttaccttcggttcatgacgaacgtttagactttaaagattggtcggaaagtgtgcacctggaacctgttcctatccaggtttctttacaacctataacgaatttactagttcctctccattttcctaatatcggtgctgcagagctctctaataaacgagaatctcttcaacaagcgattcgagtctatctcaaagaacataaagtagatgagcgaggagaacgtactacatttacatcaggaatcgataatccttcttcctggtttaccttagaagctgcccactctcctcttgtagtcagtactccttacgttgcttcgtggtctacgcttccttatttgttcccaacattaagagaacgttcttcggcaacccctatcgttttctatttttgtgtagataataatgaacatgcttcgcaaaaaatattaaaccaatcgtattgcttcctcgggtccttgcctattcgacaaaaaatttttggtagcgaatttgctagtttcccctatctatctttctatggaaatgcaaaagaggcgtactttgataacacgtactacccaacgcgttgtgggtggattgttgaaaagttaaatactacacaagatcaattcctccgggatggagacgaggtgcgactaaaacatgtttccagcggaaagtatctagcaacaactcctcttaaagatacccatggtacactcacgcgtacaacgaactgtgaagatgctatctttattattaaaaaatcttcaggttattgataacgaatgctttacaacttattcgctcttgtgatagcctgagcgtgtagatgtttgggtaaggggacggaagcgtctaatcattcccggatggtagttaggggtgaccgtgtctttcaagggaacctgaggggttcccgtctcaaatgtctactgtcgctgcattaaggtgccatcgcggagaatctcttctcggtggcacttttcagctagttcccgatcatgagtcacaatcaataccccacgatgcttctctgcaagagctaataacagttcgtgaattgtatccgcagtccgatggtctaaatttccagaaggttcgtctgctaatacaatctccggatcgttcattagagctcgcgctatagctaccctttgtttttctcctccagagaggagactccctttttcatcgcgccgatccaccagccctacggattctagtaacgcaagagctctttctcgagctttagatttctgcccagtatccttccttgcaatttgtgcaggcatcaaaacgttgttaatcactgaatcatcttctagcaaataaaaattttggaaaataaatcctatcctacagtttcgaaaaatagggagttcttcacgacggacctgtttaccaaaaaataatatctgcccagaactcggttggtctagagtacctaaaagatgtaagagcgaacttttgccactaccagaagctcctgtaatagccactacttcccctgcgtgtaattgaaaggatacatcttttaatatgggaatacagacatcttgttgctggatcactttcgaaatatgtttcgcctcaacaagaataaccatagttctactcagattttaaaatgtcagaaacctgcatgcgtgcaacatgctgtgctgggattgctccggaaatagctgctaagacaagcgctcctaatgataaacaaattacagttggaaggtgaaaatcttgagggagttgttcgccaaagaaggatggattaaaagcttctcttccttgcaatttgcttaaccaatgcgtcaaaacccctaaattttttagggttaatgcagctaaaatcgaccccaatagagctccaactagccctgaacaagctccacataatccaaacaccaattgcagccgagaagaagaaacacccattgctttcaggatgccgatttccttcttcttattattcactaataggatagacatagtcacaatattagagcaggcaacaatcaatacaataaaagaaacgattgaaaacaaaacttgatcactttgaagctgatctaagataggcttaaaaaactcataatcatataaggaagagatttcccaataagaagagacttccgattccttgaatatcttctgaatagactgtttcatgacagggatatcttgaacactaggaagaaatacctgccagccattatgcataccaagccttcggattccgagcggatggatgcagccaattccttatcaataaaaatggtcttccctccaaatggagacacaccaggattatagaatccgattactcgcaaagggaatcggacctcaccttctttttttacagagaagacagacaaggacgctgtatccccaactcgatacccttggtcgcgatatacaacaggcaaaatgacggacatacctcggaatttctcttgaaggacaagaaaatccgccaaccagccttcagaagaagcattaaaacgattcaacacttcagtcgaataatcggtttcctcaaaaggaagcactcgctgttggtaaaggatgtctgatgaatacgcgatatactgagataaggctcgaggttctcctttatgcccccgaaaagctctatccatgtgcacatgtcccattccttcttcaaactcaacaaaagagcctttccgagaagaaaacagggaaagcattctttcattggctgtacgaacaggatctatcatctcaccgttatccgaaaactcgggatccggaaaagcttctggaagtaaaaaatctacatccggatcataaggatccgtctgttcacagagaagtttctcccctatagttttataaatatattgcgaagcttctgcgtgagagtctatttgatagtagtaagactcatagtacttatctgaaggttcgatcctaatagaggaatgtaaactagcgaggtctcccacccatctttgctgcaatccgtggatcacggacatgaaaaccacggacagccaaacaacaagagcaacgatccctatagaaaaagcagaaactatggaagaggaaagtctttttctttttggaattagatacttaaaggctaataataattctaacttcatgacacccttgggaatcttagaagctagataaaagcctacttagcttctttgaagataacgtgcttacgcagctttctatcatactttttaagttctagtcgaccgcttgttttttttttatttttaacagtccaatacatttcaaaactttcggtacttttcaatttgataatttcgcggtttttgctggccatgaatgaaccttttctcaagaaaatgctaaatgagcccccatgctatacctattttcaaaaataatcaaaatctgctctcgcatttattcaaagaaaccctcataacgtttcactttctgaaccaagatcttacctaaattctagcaatatcttttttaataagactatacatactggtcgcatactttaaacacggtgagaaaatgattttttgataaaaaaatccttcttctcttacacctaaaacgacaaataattatttgatgccaggcaaaaagagttgttttatccagtaatttaccttattatgttctgccatcgtttcttgtttgaatcgaaatatgcagaaatcaacgcttcttttagaagctttttgaaaaaataaaggcttttctagatgaaaaagtttgctactttcctgtgtgtactcttatctggaagtggttttgcagctcctgttgaagcgcctgggtttccctctattcctgaaacctacattactatcaatgataaggaattaggtcttcaagagcattgccgtggtgttaatgttctcagctgcggatataatttagttggtatgttccataccccaaccactcctatgcctctaggaggatatcctactgtaatctttttccatggattccgcggaaattgtacaggaaaggatggggtctatcgagacttagcccgccttcttacggcaaatggaatcgctgtagccagattcgatatggctggctgtggaaatagcgaaggaatatgtgatcaaatccctgcacgaacctacctgcgcaacggcgaagatatcttagccaccgtagctaaatacccagaagtcaaccctcaccgcattggtattgcaggagtttccttaggttgtcacactaccattcatctggctagcacctatagacctagagactatacggttcaagccatctccgtctgggctcctattgctgacggagtcatccttctcaaagagatctgtgctactattggcctaaccatgacccagttttcggatatgggtgaagtgggtaaagcatttggattcaaacaacttcccctcaagctgtgtcgagatgatatcgatttcttcttaggtattcaggatcacatcctcctgctatccttaccaagaagaatccccgttctccaccaacaaggactagaagatcgcgtagtttctacggctcaccaacgcctatttttaggggctgctccagcgcaaatgctgtctaagagttaccccgaaactccccatgaaatcgctttatctccttatcgccaagaggttttgcaggaaatcttaacgcatttccaatcanatctttaatagtttgttttcgtagagaggctgggttcagcctctcttttctcttccattagccacactaggttttatatcctcgagattccttttaaaaagcttctcgagtatacttctccactaggcacaaacgtagtttctatccctccttcaaggtagaagttttctctgagagaaaagtacatttttgcttgtgaggataacaatgatcgatgttttaatcatgggagccaatccctcgggactgatccttgctagcattttgcaacagcacagagcccgtattaaagtaatagactctcgagatagcataacagcctctcttccgctccccctgcactctctgccagtagttttgtcatcatcttctttagaacttcttgataatatcaatctattgggagatttacttgataaagggcgaaaaatttttggggctcgctatcactggaaacaacgtactgttctttttaagttcaatcaatcatcagcctctcgttgccccttttctttattaatttcttataacgaattggtgacccatttactcgaagagtttgaaaggttaggcggtgtggtgaattgggctacgcgcccagttacccaagtagagcagaatctatttattgaaagcacaaagagctcttcacaagtctatgaaggacgagagatctttactcctaaatggattatagcttgtgaaatggatgctgatcccgatcttaaagatctcctcaaaacacaaatcaaaacaaaaaaaatccataaggaagctctttttgtagattgtgaggagggggagccttttgaagaatctcatattcacttgctccctgttacaaaaagctttgttaattttgttttttataacccttacagaggctctcgtcagctatacctcgcaaatacctctggctctctttcttctaaatttaaaaataaacttctgtatacctatagccttgcgctagcagaggatcctctctccatttcctcatctcttctacagtatcctttttgtcatgaccgttatattttcttggggagcattgctaataatctatccttttcttacctgtcgggagtaaattccaatatccatgacgcttttaatctagggtggaagctcctgccagtaattaaaaaagccgcttcttcccaattgatcctttccaaagaactaaaaacgagccatgtattgcctcattttaatgaggtccatcagaaaagagctaccaagcttcttttttcaaacatgtatactccagccctgatgtactattaccttaaggggtgtaagcagctcgatgctgcggaaggagagctatactatccctcccaccgcgcatcgaaatatgaagctagtgatattattaaagtgtctcctaatgataaagaaatccaaggccctagaccgggatcacgagctttagacatacggttagacactgggaattatctattagattccttaaaaaatgctaaacatctacttgtctttttcaaagaacgtcccgatctagtccacgctcttctagaagaatatggcgaatgggtagacgtgattgtcaccgaggatcctaaagtccacaagttataccacgccaacccagaatccttgtttatcattcgtcctgatcgttatattggatatagaacgcacacattcaagttgcatgagctaatttcttatttgcttcgtatttttgctgcagaaaatgctaattaaacaagtctgttctatacatctgtatcctaactaaaaagggggctttagcagccctcctttttttattctttcttatctgtcagtcttcttttctgagactccagcttctccatctgactttttagcatctgatactgattatgccacacttccccattcttctcgaactcagcttccttggcttttacaataatatttgtcttcgcaaactgctcttctaacttttcaagttctaacttttgatccctaatatgaagaactttagaagataaagatcgtaaaatagcacgcaaaacatctagaggtattttattcaaatcttcttctaagctagaaaatagcatctctgtagattcagcaagattctccttagatccggctttttggcagaactcgcgtatttttgtttctactttttgacattctgccgactcctgtcgcgttttccgcacccaatcttctaaatgctgtaaaacatttctgcaactctcttggtaacaagcggttactcgagctttaactcgttgattatctcgtatttgatgttgtaaaccaacggtagcatctgagctcttaccaagaggtaagcctaacttcggacgcagactgtctcgcgctttaagaaaacgttctaacactctgcagactttctcataatcttcaggagcaattgcggcttgagaagcgcttcttttccaacgtttgcgtagagacttcagctcagagctggcctcactgatcatctcatatccagatcctaaaacaaaccgtagaagagccgatcgatcacttccatcgtaagatgcaaacagatcttcaccgtattgaagaagttgctgagaggtgttagagcaagatgcttcgaaaacctctctctttagccttgaatgataaagggtttgcccagcattacctaaacacatatttagttctagcagagcttttactttttgtaggcttccttcttcagataactttttaaactgctgttgcagttgaccgtttatgctattatcccagttcacatcttgagctgtatgagcttttagaagttgatcatctaaagacaacagctctctcatttttgtagaaatctcttctttagaagcgtgttgagtagatgctccttttctcattgagatgcgctctttcaaatgactgactacttgagtataatgagcttcttgatgagataaatgggacacatctcgacgtttttgaattaacagcttttccagaaacttagctttacgctgttcggctaaaaatcgcatgctcacagactcaaattgcaagcaagctgcatgatactggtcttgcaactcttctatggcagccatatcttgtgctaccaaaacgtcatccctgctttcttgttccgttacaccttggactcctgtgacttcagagtgttgaggctgatatgactcaggaagcttcttaaatttcttattaagaaccttcgcatccgcccgcaatgctttaacagcactttttaaagattcttgtttttgctcttcaggaagtttctgaactcctaataaagctgcttcagctacccgtaattctgcaacaccatccagcccataaacatctcgaatcttctctagatgcttgatattttgatcccccaaatctggataaggaagctttcttccatccgaaaccaactcttcgctaaagaggcaacctcatatttccagtttcttttctccacccaaatagataaagcagaagggatagcttccaataccaaagctaaaacgcagagcataataggaagccatgtaagctgcacagagaagagcgcaatcgctaggcaggaaaaagctacagagagaatcgccgctacaacagctttagtgatcatcgcattacgtaaagatcctcgtaggcctttgatcagctgtgaaaatgcttctaatgtgcgattcactttcgcttttaccccattatagacacgctgatgagaagcatacaccaccttctctgctatagaagaagacttaggagatcctttcttctgttctatagaagcagctggaatgcttaacccctctaatccatagagcaaactctctaaagaatcctgttggaaagaggacaactttagagcaagctcatcagtcaatccaatcagctgtcgtatatcttgggacgcaattttcttgcctctagaaccttctaatattgtcttaaccgcattaatcttgcttacaagactagagaagtactcacatccttcagaaagctgcttcaacgttttcttcttcgttggagaaggctgttcgccctttgttaaagcctctaacaaggtttcttttgcttgaactttcttacgtaatgcttctggatgagagaagactgtattaagtagaagacgtttaccgcttaccccttcttcataaataggtcgagcgatctgttctagctgctcttgaataccagctagctcttccatcaactgcttaaactcttctcttgcagactctatctctgtaggattcattttttgctcaacatgagtgagatctgctttcatagcatcctcacaatctttgagctctgcaacagcttgctccagagaacatgcttcagcaacgtttttcagggtatctagaaaagcttctgttctcgatacaaagtccgtagacacaatgtgattcagttttgtctcttcaaatagcccgtaacgttctctccagtctgctaggctcgtttggatgcgcgtaagatcagaaacaaacttctgtttttgcgctagagtctcttcagcagaggtatgcactgccgatgctccccacttaggatctcggataaatgcttgcaacttctctacagcagattgcacccctaggaaagattgtcttggatgtaaagacatagcccggctaagttcgctacgtaaagtttttccttctctaatagctttatgtacaccatcaactaatggtgtcactcctcctgccgcacttcccatttgtaaaatagtatcgatcaagtctcggtaaatactctcttcgacttcttttatagaagtctgctccgaaattcctaactggctttctaagagtgtgacaacaagattagcacacgaactaatgcctttttgcattttagaaagatcgctttcatttaatggtgctttcttattaagaagctcttgtaaatcttgtcgtaaatatttttgtgtgaccttacgcacccgagcctgtatagaagcggaaaccccatcttcgatacaaaccttatgcatagctttttcaatgtcttggtacagttttcgtagagagtcttgatcaagatttttgttttggattagagtatcaatcttctctttccaatttctcattttgcctaaaacggaaactagctgcacacatttgatagcattctgcatctttgtatgattttcactagcaatatctaagacattcttacctttaagaacaaaatcctgagcagatgtggaaaacccagctccacaccacgtagctaagatgggactacttaaaaagcgcatttgatatcgctgtaaagcttcgtgagagtctttgccgacttgagaaccccacgcaaacagactggataaagattttgctagatccaacaaagactctttccctgcagcgccagagaaacctacccccgctgcttgtagagcctgttgcgctatcgggtacagatctgtactcgccttatcccctaaaacaacatcgtccttaacagattttacctgctgagcaacccctctccaaaaagcgtcttggctactagagattccaagagctgcatccacctggtagcgttgatgagccaacccggcaaaatcatatctcttgtccgcttctagtggatgattagcctctcttttatcaagatctaacccgtgtaatttctcttccgcttttcgaaaacggatatcgaagcgactcaaaagagtcccatcaatggaatctttgttggaaagtagatagcgatgatagagatgtagagcacgatattcttctcgaatctgctgacatcttttctgtaagcatcctttggcgatactaaaagcaattcctacaccgatacacgttacaataggaatccataaaggtacaccgagcaacatacaaagaggaacagcgaagagaatcgcggctccaataattgtaagaatctttagagcaatctcatatattcgaagttttttaagctcgctgcccttagcggtctctatagactcctctacaacatcaattaaatctcgccgagtagaaaagtttgaggtcaagcctctggactctggactcaaaggttgagggtccccttgtccggcctgcgtacattgctgacttgaagctcttaaacgaccttgtaaagaaaggccggaatgattggatgggggtgtagacggattcgccatactttcctgaaaaactatttttgaaggaagtattataccatattctcacatataaatctcggttaacttaggctgtctcttagaaaaaaactcgttttcaggagaccgattttgcgtcaagaattcttgataatttgctctcgttccaaatacttaaacctaaatcttgagcttttttcaatttacccccagcttcgctacccgctatgacggcatatgtgctcttcgataccgaagagctcactttcccccctagggagcggatacgctcctctgcttgcgttctcgtcatctgttggagagtccccgtaagaacaaacacttttccttgtaaaggagcctctttatcggattgcttagaaagaacctgaactcctagctcttgcatccgacgaatttcctctctattctcatgtttcgagaagaacgcgacgatcgatgcagctaccttaggaccaatcccctctatagacatcagctcatctaaagaagcttcgattactttgtccagagttccaaagtggtctgccagagctatggcaccagagctccccacaaaaggaatagaaagagccgttaaaagccgatctaatgccacctttttggctccggcaatgcttgccaataaattctgtatagaacgatctttaaacccagggacctgtttcaaatcttcttctgtaagagcaaatatatccgaacaagaactaatgagacctacttcgaataatttagttacgaccttctctcccaaatgatctatgtttaaagcgctcttacttgcaaagaaacagatcttttctagcatcccccctgaacaaagtggattgatacaacgcaccgacaccttctctttaacaacaggttcatgacatacaggacacaggcttggcattttccaaggctcgctctctaatgaacgcttagccaaattaatcccaacaattttgggaataacctctcctcctttttcgacatacaccgaatctccgatgcgaatatcttttttttcaatctcatcctggttgtataaggatgctctggacacgcggctcccagataaaaaaacaggagctaactcggcaaccggagtaagaatacccgttttccctacttgaaagacaatatcctccaaaatcgtttctgctctttccggagcatatttataagctatcgcccaacgataatgtttgctcgtcaaacctagccgatcctggtgtgcaatattgtctactttaatgacgactccatcgatagccatccggagcactgcgccgcatctcctctatctctcgaatacgttctaccacctcttgtctcgaacggcattgtttcggcatccctgcaacgaaaaatccccattgagagcataactgaagattttcaaaatgtgagcgttttttttgatctgtgatcaacccataaacagacaagtctaatttacgcttagcagcttccttagaagataaaagcttaagagttcctccagctgcattacgaggattagcaaattccagtttcccttgttcccgttgacaagcattgagctcttcaaacgcttcatatgaaagaaacacttctcctcgcacttctagatcctcgggagccttcttgagggagtctcataggtaaagagcgtatagtactgacattagctgtaatatcttctccttttaccccattcccccgactcaaagcttgagcaaacaatcgcttctcgtaccgaatggcgacagcaattccatcaattttgagttctaaagaatatccaggagagtaccccaataatttttctgtacgggaaaaaaattcctctagctcttgcaatgagtatacattcgctatagacaacatggggctagaatgaggaaccacaggaaactgtcctgaaggacgatcccccaaatacatggtaggagaccatgaaaccttccattccggatgctgaacttctatttcttgaagctctcgcattttcatatcatagctgtaatcagaaatcgtcggttgattgagcgcataatagcgtcggtcatgttccactaattctgtgcataaagcaatataatcatctcgagatacagcacccatactcagtcctttattttacatctttcgcacaacgaaacccgtaggtactgttaatagccccaggattatttcgatggcgatgtgcacaacgtagatcatcttttagacttttccaacatcctcctcgcaacacacggtagaccccttgaggaggccctaaaggagcatctggatctaaagcagaactctcataaaaatcataactataccagtcttggcaccattcatacacattgccagccatatcataaagacccagtatactagaaggatagctcataactggagtagtatccgaactaaagaaatttgctttgcttttatctatttcttccccagtagggtaccgcaaccctagctttcctcctgaggctgctacctcccattcagcttctgaaggcaaccgcttacctatccaacaagcataagaagaagctccataccaagttactcctacaacaggatgcttagcataccctggctcaatgatcagtcggcctgatcgacgttgaattctcgaatctttcaaacgaatgagctcattgtagtgttcgtcttgctcacttcctacgcattctaaaaaccggacaaactgctcattggtaacaggatgaatgtccaagaaaaaccctggtaaagtaatattgtgtacaggcaactcatctcgttgaccatccccacttcctcgagagaactcccctccctcaatgaagatcatttccgtcaataatggttgcggcttaatctcttctctttccacttctacatagcgactcactacaggctcccttgctaacagggattgaagagggttcgcatatccctcgctactctcaagctcttcctctgaatctacagtggtaaccatcgcctcatcgatcgacttggcctctactaatacaaaagcatgctgctcttccttaacttcacacagcctttctccttcccgaataagagcggaagggggtcccaactctgtaggagtgtcttctatttccatttcacgtagaggctcgcgacagctgtcaagcgtaacctgcagctgttctcctgacgtctttctccttaaagcctctcgtaaacatttagggcgagcctcccgttgttgttgtaaacaacttaagataaacccatcccaatcataccagctatcaggcatgcaaagcgaaggcttagggaaagatccccaaggaaaagatcctactaataaataataagctaatacaccaacggagtaaacatcggcctctcgaccaaagacctcttgttcttcaggagcctcaaacatcaacaagtcacgaatacgtgtaatactctctcgcgctgatccagactgcatgatagtggaaaacatgcgttctctgagcaaagaagcaaagccgacttctggaagatagatattagctatcccattaaagaaagaaacgtgcaccgaatgtaaatgaatctgaccatgggctaacccaatactatgcacaagctctagtgcatcgcacagttgctgaatcaaatgcactacttcttcttcagacagtttccttccagacaaatactgcgcaagagaaatagtccctccattttcttcagtaacaacaaaataccgatccccttctcgcgacacattttcgatagccaccaagcttgcatgacgaatggcagccaattgaacaatcacttcctgaaaaactcgcataaaattttctgaagaagaaagttccgaaggcagtatcttgagaatataacgcttcttaatgaatcgatgttccgcaagcacatctcggctccacaaatccatgtccgagttctgcgattactttgtagtctccccaatattcaactgcggctcgctcttccatctcctcgggacctctaaccttgttgcgaagtttctttacttgaacctattaagcgacttgctcttcccagtactatacttgtagctttccgatccgtctacaacaaaagatctcttattttgttttgataaaaaggaaccgcttaactaaagcaagctaagcggtgtaaatagaaaagagctccgttaaggaacaacaggtagccgaaccacactccaagagagagaagaaaccgaaagtttcgctctcccacaatcaattggaaaaatcctgaagaagttgcatagtatgttgctgcgcaccaaaacataggtactgttgtataccatgtggaccctaaacatacggctattcctaataagcgtcgcatcgtcttcccagcagaatttttagtgtttacatagagcatcacacgtccccctgctccattatctagccagtctccattttttctcataaagacggagagacggaacaaaacgggagccgcagagatgcctcaaaatacaatttacctctattcgcagggctaaaagtcacagccttatcttctaaatcctctctctgctgagtataggcatcccaaagcacttctgctccccagcctctagtatctccagatcctacgtggcctccggatagcgctgaacgcatacttattttaggcgctccattcttatagagcccataaggaacgtattgcttcccttgacgagagttgatgtccgtaaacgcaacttctcctcccccattattatacggattataagttatcgtgttatctgccaaattcacacgaccgccaaaagagatatccgatttcggattagtcacgatcaattttccttgagcaataagatcttgtgtacactcaagtttggctgtactactggttaaatcctgtgttacattcacgtaattggctgttgctgtttctgtaatcgtaaccgcattactcttatttccatctgctaaatccgtagtcgctacattcaaacgtacaaatgtcggaaaagaaacatcaatagtattattatctggtgttgtcattaatctgcctccttataagaagaaccaaaaggaaaccaaatcacgttaatcattgagtacgcaatattgacatgaatttttgtgaaaacttgtataaaaggatgctcattcccaatagaaggaatagaaaagatagaatacagggaggtattcgttgtatgctctggattaaatcctcttgtatctccagtacaaagattagtgtactcataggctgaggtgtataatcttaagaagatcgttggatcctcattacctgagtggtatcccccacttcgaaatatttgaaaggctacttgatagatgcctggacttttcagatataattttttttgatcattatctttccaatagaaccgattctgatacataggtgtgtaagactccgagtcgtcaatattatgcatacgtaaatcgataaacctgttccctttaactagtgcaccattacggtgggtcgcgcagttataagcttgtgtagatctatcccgataataatcaaaagtaatcgcatctctcgcggagagaggatcgcttaaattagtgaactgaggaacttgtccttgattacacttaatattaaaatctccttctagaacggtttcaccaagaaccgtcctacctcctttaacatctcctcctactgacagatcaagatctgtatgtattgtaggccccgtaacctttaaatcccgactggttaatgtgtcatctatagtcgcatccccctctacctttaaggtggcattgcgcatccataagttttgatctttaacccccgttccttcttctgtacttatcccaggaataggagctccccctgtaaatactggtttcttcatgttatcctcctatctctgggtatacgagcactccaaaatataaagtggacaaggcggacttgtccacatagtctccgcccttgtaacgcacctctaaaagtgtcttcataagttctgtatctgaagaagaaaaaggtccgtcaggatttgtgctctcttttctgatatgaattgctgttcctacagcagtagaagcatagtatcctcctctactaaatgtagagctctcactgtattcctttcctaaagggaccgctaaacagtaatctcctccatatccattattccacccccatcgcttcccaactcctacgttgataatgtacacacctttcgcaagcatttgcaggcctgtagtccctgagagatttattttcacctgcgtcctagttttattttcttcaaacgatacaaaacgaatgaactcattaatacgagacgattgatacaccaagcgcgaaggcccgattagaggaagcttctgcccccgtttccattcgattcttgctccatcttgcaatgagcagaaatagtattcaggagtacgaatatagttagcaggaactggttgggagtctttctccgggcatttgacattactaagtcgattaccgttgagattgattgaaattttgcctcgagttgtcagatcatatcctgcggcaccggtaaaaccgttaacaatgatgtcgttctcattcacatcaacctttcttttcacagaaaaggattcttttgcggaaatactctttaccgtaacgtccccttccgtagtcagatttgaagctaaaagatctccatgaacagttgtattaaagtcgaaccgacaatcattaataattttgtcagaatcactcatttaattgtttccaagtttttattttgaataaaaagcaaactattaattagaagtcaaaactaattcttttttaaataaaacttggatgaaaaagagcataaaaaaagcctgggagaacccaagcttcgcaaacaaccgatttctgataggatttttatgaggtcctgggggtggctggatttgaaccaacgtatccgtaaggagtcggatttacagtccgatgcaattgaccgntatgtgacacccccccaaaaaagatgctggagaaaggaattgaccctcaaccgttcgataaaaaatcgaatgctctgccaattgagctactccagcataagaaccagcattatgacaaaaagaaaactttagccgcaacaaaaaagttaagaattttcagattcttatgaatcttcctctttctgcacacggtagtcttcttctgtaggaagaaactgttcataatctagtgaagactgtatatcttctcccgatacttctgtatccatcacttgaaattcgtgctggcttagtttctctgaaatgatgcgctcttcttttgccttagccttgcgaatcgcgcgtttccctataggttccttatttttagtaataagaaaccgactcatcccctctttttgttctgaggtataagaatccactgattggcgaaacagttttgtgaaaccttccgtggaagcgcctgcggcaggcgaagctgttatagaaaacttaaatttcccttcaggagtatggcgagcagttagagcttgtgntttcaaacaacactgcttatacttcttcccagacccacaaggacaaggatcgtttctattaggctttttcaacatcaattctttcctgtctcttctcattcgtaaaattaattacaaagaaccttctttgcaaccccagtttttacaaggaactcaccgtttcctagtagcaagaggagcgagagcaaggggatactagcaggttcgtgttaattcgtaaaattaaataaagctttctttgtgaaaacctaaaatcgattaaaagtgtgcttcttctttattcaagcgattataaaaaaccttggctagagccacacaaggagaagctaacaaaagagccgtccctttggacaacaaagaaaacatcatgacatctggtaagttagcaacgagtccatacaaacctagaaaagaaaaaattacggtgtctatgctttgagaaagcgcaacggagcatgcggaacgaatccaaagacccgtcctcgcgaatgttttttcagccaaccaaataccttaaaatcaacaaactgcacaatcatcgttgtgatcactgatgctgaaataatccgaagagaaggggcgaatagagcttcatagtgcagttggctgatatctcctggagaaggcttaagatggagatggagttgtgtcaggattagaaaagaaagcgtgctgcaccaagaaacaaaaatcactttttttgtagactccttcccccagaattctctcgcacaattcaagcaagaaaacagccctatcacgtaaacatccgctgcagttacttcgaatccgaataacacgatttgctttaatacaaaaatgttcatgataaatggaaagcaatgaggcccatgccgctaacataattagattacgcgcagaannaaaagctccgaacccaataactacaaggatttgcaatacaaataatgtctcgtttaacataaatgataactcactttgaaaatacgagaaaagcattcttttcagcgaaaaatactgtgtatttttctccgaaagttattatacttccgctctctaaggaagtattatacatttctagaatggaancggcaacaaacaaaaacttctgattctacagaaatactcaaaaatattttatgtatgttcgctctatcttttttagtattatcgccttcctaacggtcggatgctccttttctcctccagaatcgggcttaatcatagccattcacgatgatcctcgctctctttctccagaaaaaggagaaaatgcttttcatttttctttgtccaaggctttatttgctactctcttcagagaagagctctctggattaacccctgctctggtctcctcctatcaaatttcggaagacgggcggttttatcgtttttgtattcgtaaagatgctaagtggagtgacggctctcttttacttgcagaagatgtaatagctgcttgggaacacactaaacaagctgggcgatattccctactttttgaaaagctatcttttcgagcctcttcttcttcagaaatccttattgaactcaaagaacccgagcctcaactattggcgatattagcctctccgttttttgctgtgtatcgtccagaaaatccttttctttcttctggaccttttatgccaaaaacctatgtgcaagggcaaacgctcgttctacaaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattaccctgtagatggcacattctggcttattcttaatcccaaagatcctgtactttcctctctatctaatcgtcagcgattgattgctgccatccaaaaggaaaaactggtgaagcaagctttaggaacacaatatcgagtagctgaaagtctccatctccagagggaatcatagctcatcaagaagcttctactccttttcctgggaaaattactttgatatatcccaataatattacgcgctgtcagcgtttggccgaggtattgcaagaacaatgccgagacgcaggtatccagctgactcttgaaggactcgaataccatgtatttgttcaaaaacgagccactcaagatttctctgtctccacagcaacttctatagctttccatccccttgctaaatctaagttcgatcaaacggctctagacaatttcacttgtctgcccttgtaccacatagaatatgattatattttgagcagaccgctagatcaaattgttcactatccttcaggtagtgttgatttgacctatgcacactttcactagaacgcaatgtgattgacaactttcttttgtgccgaaactacccgattcaaaaatcgctgagctctttcctctagcagagattgcgccttgtctataggaatagcctccttaatcaaagcgtgtagtttagggtgatcttttgctgtggaaaaattggggaaaaacttttcttcctcagtataaaaaaagtctgttcctaatactaaactatctaaaatccctaactcttgggcatgagcgatatgctttttaatatcctccaaagatgctcctacaaaatagttcactccattcagcccaatcaccccatcccttgcaaaaatctctttagcatgcacatctaataagttccgctcgatatcctgaaccgcgcgaaaattggagtgacaagccaatacgaacatgtccggcattttatccgcagtaaaatctaaaatatcatccgctaaaggatctgagcagtgactaagatccactggaatagctagagcatgcaacaattccaaaagatttttcccatctctggacaaacgtttaggctctaaaatcccaccaccaaaacgatttgcaaaattccaaacaagccctatataggctaaggggccctgttcatgtaacaacaaaagcttgcgaaatagttcttgtaaaggctgagcatcagagccaagacctgaagcattttcaatactacgaactacctgcaaagagctttctacttgtggttcgtaagatagtggagtcagtcgctcatcttgctctattaaagaaaaaaaaattggttttgttcatctaatgtggtgcattcttgtgattctgtgaataaggcgcaggcctgcaatcccactccaccctctattaattgatcaggagagcttcgtaccgctgggtctgaagaggaaaagtttttatgagatagcatatcacaatgcatatccactatcataactcactcctagaaaacgtgaaagaattggatattctgtattgcacaaatcgtaaacgaaaatgatttcttgtgtaggagagcgtaaagcctgccttagaacagaataaaaagtatgaggatgaggctgatggcaaataacacccttaaaatgaggtctagacaaaagaaaactacataaatctgcgggagtttttacaacatggatacctatcttttctctaaaccctagttccttagacagattagcacatggagcccccaatacagtttctatttctgcaatagaaatagcaccctcacgataaacaattcgctcctcaggatcgattactgtagactccaaccctatagaacattctcctgaaatcattacgatatcttcttccgggaaatcttgttttacctcatcagcagaaactgcagaaggaaagccggatagattcgctgaagtagcaagaaacggccctactttttgaatgatctgctgcactataggatgattaacaatcctgaatcccaatgttttctgaggaaatctcggattattatgttttgtaatcaaggtaagaggcccaggaagaaacttttgaattatctttctcgaagatgctcctaaagactgttgggcaacagcctctaattcttctaaagatgagacatagacggacagagctttttgggaagatctgtgcttaagagcaaataatcgctgatcagcatcaaggatatgaaaagaaactcccaaaccatatactgtatctgtagggaaggcaaaaacttgccccgccttaatgctctcctcaatctgttgcgaaaacacctaaaactcctgtccgccttatgtcgactgactccatagcgcgatgctttcctgtatcttttgcatcataacaacaggaatttcatgtcctccatgaaaagaaaccatctcgccttttaaagaagctgttaaaaccttatataaccgctcccctaagaaatagggcaaaataggatcatcgtacccatgactttgtatataaggagttttcccacataaagacgcattttcttcccaagattgattcggaacggctgctccagagcaaatcaaagcacctcgataaggaagccgagaagaaagcatcagatgcgtcgtcatcatagctccctgactaaaacctccaataatcacttccgatcgatctctttccaactcgtgaataagaccctctaaagcctgtttaggcttttcaaagtctacatccaatagctgctgatataaacgatccgtatctggagtgatttcctgagaagaaatcaatttttcaaaaagaacggtatccaatggaaaccaagctcgtccccctcccaactggtagggaagctgttctataccatgagggaagacccatgtgggacgcaaattggcgcacacgcacatggttgggaaaaaagtaagatgatcggcacttgcgccatacccgtgacaaaaaatgatcacaggagcttcaggatctccaggacactctataaattctatcccagcaagctttcgacgaaaaaaagaatagctcatatatctccctaaaagctgatctaaagctttagggagcactataccacaaatccgccgctatgagcagaaaattcttttttcgaaaccgtttactctatacgcgcatctaaaggacttacagaaagaaaggaatacgcctgagcatctattccctctcttcctaaacaagctgtgatgctcggcatctcttcccaagccaactctcctgtatccaaagattccccagcttgaatcgcaaccacacttttcgctacaccatctttaaggaattctttagggaatcgctgcattttctcaagaacaagcgcataaagagcacctcgctgaatacaccgcgcagttctactttatagttgcgctggcagattccggaaacgatgccgaccaaaactccgacagctaaggctcctatgcctccccataagcacccaaagaaaacgcttgctagtccagcacttgctgcacctaagaaaaatgctgcgattaccgcagaagctaataaagcacagaaggccagtgtaatgagtgcatttgcaacaaaagctgtgatcattttgtttcttaattttcgatggcccctctctacttcattaagagctcttatggctataatgcctttgagcttggagtaagcagaacgcatatctgtagctcgtgctgctaactgtctttgaattgtttcacggagcgcatgtgcctgcgtcatagttctcacaatgcgactaattttcacagcacaggagacaatggcaacaaacatagccccgcataccaaagaaatgcatccaattaagcaactcatcatcacagtatcgcaagttgaaggtttattccctctcaaacgggcgaaggcagatatccaaaaagttgcttctacggcttcgagaacactaggaactgcagcctcttcaaacatgatccgttcgttacttagagaatagaatcctgcagctggtcccaaacacgcaacaaaatgttgaatacgatgccctaagtcttcggcactagaaggcccttgagcaaaacagaaagctcccattggagagcataccactggtgttaacaatcctatgccgccagcagcacaagtcgcactattgagcatgcgattgatatttctgtaatgattgtctgtatttcttactggatcatttaaatcgaagcttaccatctttaaaagctttacctcttttatttcgttcccccaaatcttttttagactgttttattagaccatcacgatctttagctcagatcgattcaaacgaagggaatctaatagcatccatggagactgcatagcgcacactagagaatccaaatgtccataaccttcctctctagctttaaagtaaacaacagctgcaactaccattggccctaaaactgggattaatgagaaccattcagcacggctttctgtgatagggaagaagtttactctctcactagcaggagaacagtagttatgaattgcacacgcaatcaacctaataagaagccatactgcggagaccgctgtggtgatcgctgctgctatatgaaaaagcacgcagtctactgcgaccgccactactttttctgcagtctcctctctacaacaaatctcatcgtaaccgtatacacatgcgcaacaagccataactgctctcctcccgccgcagatttccttactttctatcgaagcttcggtctcccctaattagaaatcgctatccacgtatcataggtctctaaagggcagccagcatatcctctttaattggaatgaaaaccaataagatagatcttgcttatgcagcccagttccactttttgagctcttagaatataaaaacttgcgaagaaactaggaacttaaaaaaaatcctgataaaagctgcgattcagaagcattgtactctaattagagaaaatctcctaagtcgaagactgtccacccttcaaaataacaactacttcttgaattcttactcagagaatatccgagttttgccaaagatttttgttaagaactttacatggattcttccttgacgaaacgatccgaaacgacttatggtgtttaggatgaaaatttaaggaacctcttaattatgtccagaaaaccggcttctaactcatcccggaacaccaaacggtcctcagacacttcctgggaagtcattgcccaagattataataaagccgttgatcgcgatggacatttctatcataaggaagtgattctccctaatctcctttctaagctacatatttcccgctcatcgtctctggttgatgtaggatgtggtcaagggattttggagaagcatttacctaaatatctcccttatctaggaatcgatctttcccctagtctgctgcgttttgcaaagaaaagcgcttcctcaaaatcacgtcgctttcttcatcacgatatgacgcaaccggtaccagcagatcatcatgagcagttttcccatgcnacagcaatcctttctnttcagaanatggaatctccagaacaagctatcgcacacacagcgaatcttttggctcctcaaggtaggttgtttattgttctcaaccatccatgctttcgcatccctaggctttcttcatggctttatgatgagcctaaaaaactcttatctagaaaaatagaccgctatctctctcctgtggcggtccctatcgttgtgcatcctggagaaaaacattctgagacgacatattctttccattttcccttaagctattgggtacaagctttatctaatcacaatcttctgattgatagtatggaagaatggatctcccctaaaaaatcctcagggaagagggctcgagcagaaaatctatcccgcaaggagtttccgcttttcttgtttatctcagcattaaaaatatcaaaatgattttgaaaaactataattaaaaaatcttctttttagtttaaaatctttttaagatctgttttttattatagcttcattatgttgcgccctccgtcttttcttaaaaagcttctctcttctgttcgcaacaatttcatcatcaaatctatcctaaaagctcctaaagttctttatcacaacggggcttctaaagaagcctgcgttctaagctattatggactattcagttgtgttcctatattggtcttcttcctcaggctttctcaatacctattcattagtttagactggaaagagtggttactcctccactttcccgattacaaagcgccgatcttggcaattattgaagcagcttactcaacaactagcaatatcggagtggttcttgtcagtagtttctttgtcttctgctgggcaggtattctgatgctacaatctttagaagtgggctaaataaaatcttctgttcaggaatcactcaagcttctttaaagagactaattagctatctagttatcactcttgttagccccatgatctttattattgtttgcggatcttggatctatattacacagattctacctatcaactacccccaactatttagtttcagccattccatggcttttatttatattgtttcacgattacttccctatgctcttctgtacgggattctcttttgttgctatgcattcctctctagagtccccaccaagaaatctgcagctttttttgcagcaactatagctggtagtgcatggatcctttctcaaaaaatcttcttttgcctccagctccacctttttaattatagcttcacttacggagctctagttgctttaccctcttttcttctccttctttacctctatgctattatctatttgtttggaggagccttaaccttcttattccaaaacaaaggttttagcattttaatccctaaagaagaaattttcccaagtagctatttcaagttcattttatgtgtgtatgttctttccctaatcacagaacactttgataatgctctccctcctcccagtgcaaactatcttgctaacaaagccaaagcttctattggagaaacctctcaatgtttagatattttagaaagagagggtatgattcttaaatacaaagagggctataagccttctcataacattgcgaaccttcatatcaacaccatcttcgatcagcttactaagtcccctgctttttctaaaatctgctccccctctcttattcctatacaggatgcgctgactcatatacttactgaaatcaaaaagaactcgcataacctttccctttcagaaattgctaaaaaagtgaattcatgaagcgttctccatggtataaaatatttggctactatcttctcgtgggagtgcctctagctttattggcgctgcttcctaaattcctttccagtgaatcgggaaaatatctgtttctttctgtattaaataaggaaacgggactgcaatgcgaaattgaacagctacacctatcttggttcggttctcaaacggctaaaaaaattcgcatccgaggaatcgactccgaatctgaaatatttgctgcggaaaagatcattgtaaaaggatctcttcctcgcttactgctctacagatttcctaaagccttgaccttaacaggctggtctttacaaatcgatgagtctctctccatgaattccccgtccctttatcacttagatcctggagtccttctttctaaaatagagcgcaggttatcacttcagaacttggatccataaccatgaaaacgattaacggctctaccctttcggtttccgggttttatgtaaaaaaaaccgctgaacaactacttatacgagctcttacaaaagaaaatgatgtgccaggatctgtcgctgtagaaggagctctttcccccaattttgttcttaatgttgagctttcctctgttcctgcttctcttttcaaactctttatagcctctccttccttagaccgaatcctatcaacagaaaatctcatcaatctaaccgcaaaagctcatcaagaaaaagactctactctcattactctgactgcagaaggaaatcaaatatcggcaaaacttcgtggttacgtacgcgatcgcgtattcctgatcacacaaggcggagcctccttctgtgctcttacagcctacaataacttctcgaattctctctgaactctctcctctagatacgcccatccgatctcaagaagcctatctttttatatcggaagcaaaacttcctctctccatctcgaaatggagcgcatcagacttttcattacaagctaacctgcctcaaatttctgtagataccctcgatccgaacctttctattcgtacagaaaatacaaaaatttccatacgcaaatccgatcatcttacggtcatgcgttcttcttcctctgccattctaggaggagcttctccttcctatatccatagcacactctctatggacaatcataaacatgttgcagaatttcatatccaacactcgctcttgcctcacacatatttgcgagctcttcttcctaaacctattgaaatcaacactccacttgaagtcccctattatactctagatatcaaaggaaaatatcggaatacacagctctcttgcgaggctttactagataaccctctattaagactctcctgcaacctatctggacctttatatgccctacaatttagtggagagggcgcctatacattatccgagcgttggaaagaacgtttagctccacactttttacaaatacaagctatcttctctgggaagatgcatttttcccaaaaacacgtctttttcccaaaactatcaggcaaactcattgctggagataatgaaatttttatccatggaaaatgtggtagagctagtgaagagatgaagccttccaattcctctcttttagtgtatggaaacactctcctctcttccttttagatttattatccccctaaatttgctccactgcaaatgacgngctctagcttttcacttcattctgatgggggaaaggcgttgctcaaaggaaacgtaaaattatttataacggatccagaatctcctcacttngaaganacaaaaattctcattccagatatcgtgatcncgtctttagatcccagtgctccttggactgcagataatntctctgtgcaagcatccggggaacttctacaacttccggtggataggctcattcgattacaacacaaagacctttctctatcccgttatattggagaaacgagtgaagcttcctttcaacttctttactctccggataaagaggaaactgtagatatctcctctagatttaaaacggatgctcttaccggagacttccgttttgttatgaataaagagttgtctctgactgagaaagctcatggatcattacaatgggaaatttccccagaacgctatagctccttctttgaaaaagcctcttgcccaccttcatgtattttgcatcggcctacgacatttcgtcttgatctgtctaaaatttcttgcttagataaaaaaacaggctattcctgtctctctctattatctcaaggcggcatagaagggaagctatcttccaccccattagttttttatgaccatctatctaaagaaaattttatcgtaaataatataggtggatcggtttacgcacaaaatgtgaacgatctcattcaatatcaactcaatggaaattgcctcgctcctaaccaggataataagactcctgtatcttttattattgaaggagaagctagaaatattttttccgatgagactagagcctgctctcaaacagcaacttgggtaaatattcctacctcttttattacaggaatctttcctatctctcctggagttcgctctaaactaacctctttagccggaccaaaaattcatgtctccattcacaacgatttctctagaggagaaggtcctgtaacgattaaagtagattccgaaaatctaacagcctatttccctctagtccttacagaacaagctattctcttagaagacgaccttacagcatctctacatatcaatgaggaaatcaataaagcctttcttagagaattcaatcctttgattgctgaaggtggagcttattccaaacacccggtaagtttacgagtgaacaagcaaaatttttatcttcctatcaagccgtactcctttgaaaattttcgtattcaatccgcttctttagattttggtaagatcgaaatagcgaatacaggaactatgcaagatctctttcaatttttggatgtagaagctgaacagcaacgtgttgagtcttggttcaccccaatctttttctctgtacaaaaggggcaaatcatttgtaaacgcttcgatgctcttattgatgggcgcatacgactagctttatggggaaaaacagatattgttcgcgagagattagcgatgactttggggattgatccggaactgattaaaaagcttttccgtaatactatgctaaagacaaaaaacttcttcctaatcaagattagaggacctatttcgtctccagaaattgactggtcttctgcatatgcgcgaatcgctctacttaaaagctatacaatagcgggtcctttaaactcgttagccgataaattattctcatcattaggagagcctactcctacacaaacagtctctcctcttccgtgggaagtttctgaaacagaataatcttattcatcggatcctgtgggcccttcttgcagagaaagatactgcttcacaaaactatttgccttgaggatcgtcgtgcagactatcgtaagcatctataatttgccccttatctacaagatacactctatccaaacattgattaatgaatagcatatcatgtgtagagatcgcaatagtcatgccctgctcttttagagacagaacgatttgaagaaactttgaggctgaaaaaggatccaaagcagaagtcggctcatcaaagagaatcgctctcatatcaagagcaagagcacgagcaattgctactcgctgtctctgccctccagataactgatgaggatagctggatgcatattctctgagctccagcataccaagaagatctaaggccttatccttagcttctctctccccacgttttttgactatcatctgaggatgcgcacaattatccagtactgtcatgtgaggaaacagctctggttgttgaaaaacaaaacctggaggatctcctacgacagaaatactaccgctggaaataggagttaagcctaccaaagaacgtaaaattgttgttttcccagacccacttctcccgatgaacaaagtgattcgcccggggactagagaaaaagagacgttggaaaggatctctttacccttcacagctacagtcaaatctttaacttcaacagtcatgcagactccttctctgataatctagcaaaataagaaaaagcagaggtcattatcaaataaagccctgcacagattaaatacatctccatagggttgagttcccgagctacaatgtctttagtgacttttgttaattcaggaactcctactaccataagaatgctgctctctttgattaaagaaacaaactcattcgctagagaaggaagaatatttttaaaaacttgaggatacagtatatgcaagaagatctgtggtcctgtataccccaacacttttgctgcctcccattgttgaacaggtagcgcattgatccccgcacgcacattttcagctaagtaagcagcagaattcaaggttagggcgatcagtccggccaccagtggggataaattaactttgatcaaagaaggcaatccgaaatatacaatcaaaatttgaatgaacagcggtgttcctcgaaccgccactacataaaaattccctaaaaatttagatatacgacaagggaagtaccgagaattcacagttcctataccccagcccagtacaaacccacacaccaaagaaatagcagtaatcaatagggtgtatccgcacccgcgaagaagtaattttgctgttagcaaatagtgttccactatcccctatcctgtcattagtatcacaagaaatctatgtaactatattgaccgaaaggttcttataaaaaaagcctttcctaattaaaatcttttatcaaaaaaatttttatacgacttctgtttcgaaaaaaataaaaactcgtgtacattttatatggcctccaaaagtattgtcggcttacaagatagtttattaggatgatatggatcgatcccctctttttcttattattatgggcgccccaggatccgggaaaggcacccagtcaaagttactagcatctcaattatccctcctgcatattagttctggagacttgcttagaggtgcggtttccaaagataccccgctcagccaagaaattaagtcttatctagaccaggggaagttgcttccagatacattggtttggaagttagtgcacgaaaaactagatgaattccaacaggatacgttattacgacgactttctttcctatctcgttctgagaacagtgctattttagatggcttcccaagaactgtcacccaagcgaagcttttacatgagtttcttagttcctacttccccaattacaaagttattctgttagacatttctgatgaagaagttcttaatcggttgacttctcggtatatttgtccagcttgtcaaggcatctacaatgaacaacaaggattttcttcctgccctaaatgctctgtagaacttattcgccgatcagatgacactctagaagtgatcctagatagaattcaaacgtacaaacaggaaactcaacctgttctggattattatacagagaagcaaaagctcatcactattgatgctaatgctcccactcaacaagtattccagagtatcctagatagcctttctgcttctcttgtctatcaagaaagagactgttgcaactgcgattgcgatgatgaagactagaatacggaaaagaatttctttggtatagtcgcgttcaacaaggactaagaacctctttttagtcctctttgtgatgtctctaccgaggttctcccatgccgcaccaagtcttattatctcctgtttgcgatcttttatcgaatgctgaaggtatagagacgcaagtactgtttggagaaaggatatgcaaccataaccatcgacactatgcctattctcaactagtcttttcttctatatggaagccataccctggcgactctctacagaatattcctctattctcttcccaactgcagcctcctaatgctgttgtctgctctcaagaagcttttttagatccttggcatatccccttaccttttgccgctccgctccacatagataaccaaaatcaagtgtccctatctcctgctagcatagcattattaaattccaattccagaagtaactatgcaaaagctttctgctctaccaaagagattcgttttttaaattcttcattctctctaagagatttagtttctttcgcagaacaattgatagatactccgtacgtttggggtggccggtgcattcataaacagcttcctcgtaatggtgtagattgttcggggtatattcaactactttaccaagtcacaggaagaaatatccctcgcaatgctagagatcaatacagagactgttctccagtaaaagatttctcgtctctacctataggaggacttatcttcctcaagaaagcaagcacgggacaaatcaaccatgttatgatgaaaatctcggagcatgaattcattcatgctgcggaaaaaatagggaaagtagaaaaagtaatcctaggaaatagggctttctttaaagggaatctattctgctcattaggtgaaccgcctatagaagctgtttttggcgttcctaaaaatagaaaagccttcttttgaaagaaggcttttctgaaacgcactccaatatatggacaagcaatagcttatcgtttggagaattggaaactcttacgagctttcttacgaccgtattttttacgctctttcttacgaggatctcgagtcaagaagccttgagccttcaattcttgctttatgtcttctttctcttgcagaacagctctagctaaacccaatcgagtagcaataacctgaccttgaacccctcctccacttactcggataatcaaatcgaaactattgacatcaccgagcattctgagcggagctaagatagttgctctttgaacttcaagagggaaatattgctctaaagtctttccatttacgtcaatttttccatttccagaacgaagacgaacgctagaaacagcctgctttcttctgcctgttgcaacagactcttgtatcatattctttgtcacaaattaccccaaattacgcgtctaaaacaattggtttgatagcttcatactgtgcgtaagaactacctttcaaaactcttaaagatttcatttgacgtcttccaagttttgttttaggcaacattcctttaacagcatgctcgataacataagcagtttcgcgcaatcatgttttcaaaaggaacttctcgcatcccagaaataaagcctgtgtaatagtgatacactttctgagctctttttgcgccagtcaaacgcactttctcagcattgatcacaatgacaccatctcccatcgctacgtgaggagtaaaagtcaccttatgcttacctctcaggatcttcgcaacttctgaagataatctccctaaggtcttcccttcagcattaactacataccaggctttgtttcgatcgtccgaagccttagctagggtcgttttcgtatcttttcttttttccataacttaaatcaccttatcagagggaatgattataattttgatgattattttttccaaacaaaaagcagctgtatttgccttctaaagaatttagaaaagaaaaaatttcaaaaagatctcttttctttttgccttcaaaaacagccttacacttctacacttctttcgaaaaaatattttagggaagttcttgaatcatgatttacataataaaaaaaatagttagctgccatcagctaaatttaaaaaggtgctaccagacgctaaaagctggtccacgtaattaatatcataatcagaaagaagaaacttcggattatccaacatgaactgatgaaaaggaattgtagaatgcaccccaccaatatggaactcttttaaagctcttttcataatggctatcgcttcctctcgattctttccttttgtgattaccttagcaatcatggaatcataataaggaggtatcgcataaccactgtagcaagccccatctactcgcacagcaggacctgcaggagggagataataatctaatctaccaggggaaggagtaaaagttattacttggatcctctgcattgattcggcattgaatcacgtgccctttaaactctatattcttttgcttccaaggcagtttttctcccttagcgacactaatctgagcctttaacaaatcgatccctgtcacttcttccgtaatagtatgttccacttggatacgcgtattcatctccatgaaataaaaacgcttctccttatctaacagaaattctactgttccaacagagaaatacccggcactccgagctaaatccactgctacttttccaactttagcttgcatttctggagttaaaataggacttggagtctcttctattaatttttgccgacgcctttgtactgtacaatctcgttctccaagatacacgtaatttccgtgcttatctccaattacttgaacttctaaatgtcttggattttcaataaatttttcaatatacacgtcaggattattaaatcccgcttctgcttcagcccgagcggcagtaaaagccctatagaattcgtctttttctctaacaatccgtattcctcgtccaccgcctccagcaacagctttgatgacgatggggaatccgatcttttctgcgattctaatcccttccacctcatccttcaccacaccttcagatccagggattacagggcacttaatctttttagccaactgcttagctgcgactttatctcccatagtcgctatcgactcagcactaggaccgataaatgtgagcccacaactttcacaaatagaagcaaagtttgcattttcacttaagaaaccataaccaggatgcacagcatctgccccagtaatctcacaagcagctaaaatattggcgatctttaggtaggattttgctgcctgagcttctccaatacaaacagcttcgtcagcaagaagcacatgcaaagcttcttgatccgccatagaatatacagcaacagtagctaatcctagatcatgacatgctcgaataatccgaacagctatctcgcctctatttgcaatcaatacttccttcattaactaagccttaactatacggaataacttagaaccaaactggactggatcaccattagtaatcaatatttcttctacgcgaccagacattcctgcctttacctcgttcattaccttcatagcttccacgatacaaacaacggtatcctctgaaacagtatccccaggcttaataaatgccggagcctctggcgaaggagagccataaaaagtgccgaccagcggagaaacaataaaatctccctgagcaggcgcctcactttctttcttctcgatactctctttaacaataggattcccaaggttttgatctgtaggaataggtctttcttgggaaaatccagcaaacagtctgttatcataaaagactggctcctgaatacttgggactgtatccctttctaactctaactccaaaccttcacgcttgataacaatgcgcttcattttattacggcccatagcaatcatgagcttttctatctgctttaaatccatgctatccccaatttagacgcgttgaatatactcacaagtacgcgtatcgaccttaataacatctcctatttctacaaaaggcggtaccaaaacctctactcctgtttccaaaagggcttttttggctcctcctgataaggataaagagtctccagggaaatctgttttagcaaccattaattccaagaaatggggtaactccatagaaaaaacagtgccttcatgcactaaagcaaagacggtaacacctgctttcaaaaacatggcgttgtctttcataatttcttttggaatatagatcttatcgtaattccctaagtctaagaataggtatttatcctcttccagatatagatactctaaatttcttggctcaaactgagcctctttgacctcttgccccgctttaaaatttctctcgactatcacgtctgatccagcggcctgcagggatactttaataaaagtatcccctttgtttcctgagactttcgaaacagaaactactttgtataggccatcttttgtagagataaacatccctaccgagagttggctacttagcaccatgttcttccccttgaagtaacaaaactttttctttcatatttatagagtctttctcaaaaaaataggaggctgcaaccaaaatatctgcgcctgcttccctacatgctcgtgcagactctttatcaataccaccgtcaacttcaatcaagcaacttccttctcttcctaggacttgtatagcttgtttaacgaattgaattctttctatcgtatcaggaatgaacttttgcccacaaaaaccaggatgcacagacataagcaagatgacatcgcatagaggtatgaaagatgtgacaaactctatagaagtctctggagagaaagctacccctgcttgcactccgcatttttgaatatagctaataatttctttaatattttccgctgcctcaaaatgcacaatgatacgatccgccccggccttaacaaaagcctctacaaattcaaaaggcgtataaatcatagcatgaacttccagaaatagctctgttgaccgattaatcgcagcaacaactccgggaccaaaagtaatattgggaacaaaatgtccatccataacgtctatatgaataagatctgctccggactcttctatatttcgcgcttctcttcctatgcaagctaagtcagctcccataatagatggagctaccaacaccccttgttttttcatggcctcttctcttatttccttctgtagagatgacgcacgtacacttcaatcttgtggtcaaaaattttaactctctatgataagaaggagagtgtacaatggcaattatttttggggaactaagagtttccctctatcctccttttctctttacatacatttcacgacaggcacaccccaaagcgattctgcactgcgcagacaagaattttcttgaatccctccatagcaatcagtgctttcgtatcgccaatgcaacatgttctactctgtcctatatgcagaaattgatcgttaatccagtcaacaatattaatgcaaatgctttagaaatacatgtaagctggtttttacatagaatttttatcatataaagccctaggatctggtttcagagaactttaaatgagaaagtgcctatgacaacgcctactctaatcgtgactcctccatctccccctgcaccttcctactcagccaatcgcgtacctcaaccttctttgatggacaaaattaagaaaatagcagccattgcctccctaattcttataggcacaataggctttttagctcttttgggacatcttgttggctttctgatcgctccacaaattcactaatgttcttcttgccctattcattacctcattagcagggaatgctctttatctacagaaaaccgctaatctacatctataccaggatctgcaaagagaagttgggtctctaaaagaaattaatttcatgctgagcgttctacagaaagaatttcttcatttatctaaagaatttgcaacgacatctaaagacctctctgctgtatctcaagatttttattcttgtttgcaaggnnttagagataactataaaggttttgaatctcttttggatgagtataaaaactctacagaagaaatgcgcaaactcttttcgcaagaaatcatagcagatcttaaaggctctgttgcctcattaagagaggaaatccgattcctaaccccattagcagaagaagttcgccgattagcgcataaccaggaatcattaacagcggctattgaagaattaaaaacaattcgtgatagcttacgagatgaaattggacaactttcacaactttctaaaactcttaccagtgccaaattgcattacaacgaaaagagagctcagatctgtgttcccagataagagagacgctctcctcccccagaaagtctgcatcaccctctacaaaaagctcctagtcttaggagctttttgcaaagcaaaacataacaccctgtaaaaggctgcagaactagtctactcatcctaactgcacacagggtgccaatagtaacggaactctacaaaataaaaaaaaagaggaggtctccctcctnctttttcctacgcgaatcacatgtcatcccttagaaggagcgtgaatcgagaacggctgttgtccttatttatatcatcgaatgccccagaaacactatctcctattgagcgaaaagcggattcaagacgcaaagtagacgaagtaggagatgcttgtggtgaagcgctctcntcggacaaacgtcctcctgattcctgctgatcagagggacgagcagccccttcaatttcttcaggtgatctctttttacaactctgaacaactgctgataaacttcttaaaagcacaataacagcataaacacatcctagaagagctgttgttaatatcagcagatatggaagaacagcagcagtgccactaaacagtaccgccgctgataatatggataaacttcctgaagcaaacaccgcaaacaaagacaacgcaagaacaactgcttgcttagccgtttgtaagcatttcgttacagagcatttatctataacaggcattgattgtacgctcgacaagactttgtcacaacagatcatgtatccccctatccctttatcaaatttcgtttcttgtcattaaaaaagctagcagacctagaggaagtctgcttttcgagttttgcctagcacttatttgtagaagcgatccatccccgatccttagcagctataaacaaaacataagctacacacaagaagctcgccagtgttgtcgctactaaaacggctaaaggccctacaggagtagctcccacacataaagcaaccagtgaaagaacacacaaagccccattcaaaacaagagcggcgagacaactacgagtttcgcaactttagctagcgctcccaccacacatcccaaagaatcacagcttccgtgatgaccatcaactaacccactttctgttttcacgctctgtatcatcacgtctcccattgtcttattgagttactaaaatcacttggtctgcgcttccatttttacctttaaagaattgtacagcaggttcattagctggactcgatttgcatggcaacttaaatggacatcccaccaaaccatgattctctagaacatccaaagcagatgttgcaaacaatacaatccctaaaagaatggcgataatacccaatccaagagcaaatccaccacacgaaacacccactgccgctgcagcgattcccaaagctaaacaaataatcgaacaaacaactcctaaacagcatgctgctagctgaactttttctgcagttgttcctttcgtcaacaccgagcgcacaggatccgtcaagttgtctaaacgtagatggtttctacataactgtttaacgcattccatagagcctcctaaaaactcttaaaacagcctctcaatgaagcctaatctttaaaaccggactcgcctttagctcgccccttttttactcaccgagttttcgagcttatcattgcttttggcatttgcactagctctcgagattttctgctcaacctctgctgttttacagcataagttgttccacatcaaagtttgtgatcgatgcaaccgctctctagtcacagcttctgtagtcagcactcctccaaccaaagctcctcctaaaaggaaagctcctaccccgaagaataaagatgccgctacaacagaaacagggctacagagcactccagagaacaacaagcccgcaacaactagaagagcgatggccaatatagtggccacagcaactgccgccaatcttttcgctgtcggcaatgaattactcagatctaagcatctctctaaaagagctatcctatccacaactctctcttgctgaatgctatgcgcataaaccttcgtcataaacctcacttcgacagattttagccagatctcatttctcacttataaaacaatgtttcggacgcaaaaactaccggatttaaattatttagggacccattttaactaaaaaaactatttaaaacaaacttttttcaaatacacctgaacaagattcttcacgccctcgctgagctttgaagaatctaaattgttaaaatatttacaaaatagctagaaggctccgtttaactcggagcancaagagatagctttttcccgatagtttttaagagagtataggaagttttttcggaaaacaacccctctttaatgagaagacttgcgcttgatcaaaatgatattttgctcggacataatcatgtcgattgcaaagaattttacaaaactgcagacgtaaagagaggtcctctggggcatccttaacactctcttctaacaactgcaccccctccttaaccagccctagctccaatgctgttgtcgccaacctcaacctaagagatccactttttggatacttcttggaaagcatcactagtttttttcgatactccaaagtttcttgataggtcacccctgaatcggcaaacaacacccctaggatttcgggggaaatatatccttggaaatagtcatagatagatgaccctcgccgagtcttttctgcagatttctttaaaagagcctctcccgccgccttctatcctaaaagaacataagtaatccctaacaaatcagaaatctgctcgtctgataaatatgattgagcttgctcataagctaaggacgcctgaagaaactctcctttttgcaaaaagaaagctcctctattcataaaagttaaccctataagctccatctgcgaacgcacctttaactgcgactcttttatgcattcacaatacctttcagtaggaagatgccttcctccagaagtggtttcaatatttaccttgtccttatagcgtaagtaaatatgtccaggaggggtgacagggtccagagacaaatcaagccgctgggcgacagcttgataaagcactacagttcccaagcaaactccaaacttactatctgtaacagcagctaactcagaaaacctgctttcaaacatctcttgttttgaaggatacctccatctttcttcctgaaaaaggatggtattaatagcttctatggttgccaaatctatccgctcaggatctccgtgtgcagcactcgccaaacgctctctttcaacgtatgcacgcaaagctaaaacatccagatacaatgaatagtatcgagccttttgctcttccgcagaaggctccgctaacaccaacactctcgctaaatcatcgtcccgatgaacacctagagaaacccttggcaaaatcaattttgcaaagagctcttcctccgattttgaaaaaaggtattctggacgctttgaagacaaaatgcatcgagcaaaaacagatacatcctcttctgagagctgaggaaacagatacattaaccgttttgcactcaaaggatctcgatgcgctacaaaacaagcgcatatagattccagacaataaggatctacattccaaaagctttgttgcttatctaggagcgggataggctcctttctcatccgttcagtcgctcgcagagcggtcggtaacagaagactgcctatcccaataaagcacatccaatgccgcaaacacacaaacgtcctacacagctggatttgttttaattttaaacacaactacatcttttgccatagtaagctctaccgccattccaggtttgatatctcctttcaaaagagctttagacaacatagtcactactttttgctgtatcaaacgcttcagagggcgagctccaaaagcgctgtcataaccttgctcactgagaaatagcactaaagaatcatcccaagttaacgaaatttttctttccagcaaacgtaaagcaacccgattcatttgaataccgacaatttttacaatgtcttccgtagtcaaaggaacgaaaggcagaatgtcatcgatacgattgataaattctggactaaaataatttttaagcgcaggggcaacaacagataacacagcttctttgtctacgatagttcctttcttagtacaataatcagcaagctcttgcgaaccaatatttgatgtcataatgaaaagagcattcttacaatttaccttacgcttcttgctatccgtaagaatcccatcatcaaaaatctgcaataaaatattaaatacttctttatctgctttttctatctcatcaaaaagaacaacagaataaggtcgtcttcttaaagcttctgagagactccctccttcttcatatcctacataccctggaggagatcctatcaatttggaaacggaatgtttttccatatattcggtcatgtcaaaccgaatcatcgcttcttccttattaaataaaagctctgctaatgctttagcaagctcagttttccctactcctgtaggtccaagaaatagaaacactcctagaggacgctgcggatcactcaatcctactcgagcagctcgaatcgaatcactgactgcggcaatagcgaaaggttgtccgacaaccctttcttctaaagactcctccaacaccaataacttttcagattctccctccaacattttttgcacagggattccagtccaattcgcaacaacttgcgcaatcaaccgctcatcaacttcctcttgaagcaggcgcccatctctttgatttaaagcttcctcagctaaatgaatttcttcctccaaagaaggaatcaaactatagcgtagttctgctacccgattgtaatcggcagtacgctcagcttcctcttcggcaaattttaaattttctaaagcattcttcttttcttttaatcctgcaattaatcctttttcttcatcccagcgcaagcgtaaagcggccagctcttccttaacccggtcaattgcttnntgcatgtcttcagcctcttcctgataagctggtgcttgctcgcgtttaatagcttcttgtttcacgattaaagctgataattctctttccttttcatcaataggcagaggtaaacttcctatttgcatacggattaaactcgcagcctcatcaattaggtcaatcgccttatcaggaagaaatcggtctgtgatgtaacgataagaaagaactacagctgcattcaaagccccttctgtaatgcgcacaccatgaaaaatttcatatttttcccttaacccccggagaatgaatacagcatcttccaaagaaggttctgttacaaaaataggctggaaacgccgttccaaagccgcgtctttctctatatatttttggtattcattcaaagtcgtagcgccaatacaatgcaaagtgcctcgtgctaaagcaggctttaatagattcgctgcatccatagctccatctgtagctcccgctcctactaaagtatgcacttcatcaatgaataggatacactcgccttcagaagcttctacactcttcaatacactttttaaccgctcttcaaactctcctcgatacttggcacctgcaatcaaagctcccatatccagtacatacagatgcttttcctttaaactctctggaacatccccttgcactatgcgaagagcaagtccttcagcgattgctgttttcccaactccgggctcccctatcaacataggattattctttgttcgtctagaaagaacctgtatcgtacgtctaatctcttcatctcgaccaatcacaggatcaagcttgccttctcttgcaagtacagtcaaatttttgcagtatttctctaatcctttcagattttcttcagcactaggtgagtccatacgacttccttgtcttaatttagtaattaattctttcaacgcttcagaagtagtttttacagtttttctccaagaagcaaaaggctctttagtcgatcgccaaaaagctagtaacaaatgatcccctgatagatattcgtcacccatacttctagcttcttgatgcgcattgagcaacaactgatgtaaacttggagaaggactagcaacagcggttccctcgactacagttggttctctgcgtaaggcgtcgtccacagcagaagtaagcaaaccaagattaccgtgcacatccttaatgaccaaacaaaatagggagcctggattttgcaaaagacttttcagcaaatggttttctgtcacgtaggaatgcttagagtttttagctaactcaaacgccttttctaaggcttcgcttactgcatctgaaaatttctccataaataccttttatcacacctgttacaaaggctatcaatctgagaaggcttgccaatcacatcgatcaataaagcagaccttatatccatacagattaattctcttacagtcaataaaagagctaagatcatttgatcacagaaaactacaggcaaaaaacttgattagaaatcgatcttgatcgaaactgctctctttgatcaagaaacagctaactctcttctccttactggctatcctaaccaaggagctgatgatttagctgacacaagcataaacagcttcctctaaggagagattcatgaccactgctactacttcacaaacagctttacgctctagaaaagatgttcctctttctgactgctgggatacgaaaagtttgtatgcgagtcgtgaagtctggcaagacgaattaaaaaaagtaggtgctgaaggagctccattttggcctcaccttagcgaaaacaattttgatataaaacaaccttcttctcttcgtgagctgctaaccacagtcttttctattgaaagaactttggataaactttatgtataagctcatcttactcatgatgaggatattgcgaatcaagaaaccgcagctgatctgaaatctattaccttcttgctcacatcatttgtagaggaaatttcttggattcaaccggcccttatcgccctccctcagcaagtggctaatatgctattagcctctcccgaacttcaggaataccatttctatttgaaaaaactattccgtttagctccgcacacaggaacttctcgagaagaaaaaatcctagcgtcttctttccctgcattggaagtagcctataaaactttttgtagcttaacagattctgaaattccttttggggaagctgtcgactccgaaggtaaatctcatcccctttctcacgctctagcttctctatacatgcaatctacagatcgggagctacgcaaaaacacttatcagaaacaatgtcaacgccatcacgggtatcgtttatctctcgcgaatctactgaatggcaaaattcaagcccatctattcaatgcaaaagctcgcgattatgattcttgtttagaagcagcactatttcagaatgatatcagcacttctgtggttaccacgctcattgataccgttaaacaacacacacacctgatcactaagtattttcagttaaaacaaaaagctcttggtctctcagatttccatttctatgatgtctacgcaccgttggtcgctagcgaagcttcacgccattattcttatcaagaagctgtcactctgatctgcgatagcttgtcccctttagggaacgattatgtagagactctacgcaaaggtctcacttccgatggatgggtagataaatatgaaaatactaacaaacgctcaggagcatattcgtctgggtgttataacagcaaaccttacattcttctcaattatacaggaacgttatacgacgtatcggtagttgcgcacgaaggtggtcatagtatgcactcattcttgagtcataaacatcaaagttatcatgaagctcagtatccgatttttctagctgaaatcgcctcaaccctcaatgaaaccctattgatggaatttctgctaaaacaagctccgtctaaagaagagaagattgctattctttctcgctctctagacactgtttttgcaactttattccgacaaacactatttgctgcttttgagctggaaatgcattctgcagccgaacaaggtctcccattaactgaagaattcttttctcaaagttacgagaaactgcagcgcctattttatggcgattgcataacttttgatgaacatagctgtatcgaatcggctcgcattcctcatttctactacaacttctatgtttaatcaatacgccactggaatcattgcatcgttgtgtttttctgaaagaattctttctggagaagaaggtgctcaagaagcatatctcacatttttgcgtagcggcggatccgatttccctatcgaaattttgaaaaaatctggattggatatgacctcaatcagctcctatgcttaaagccttttcctacatcgaacggaagctggaagaactagctagcttgctataaatttttaaaaatagcagttgatcatgccaactgctaaaccagttgcaaaaaagcgaggactttgctatcgttcttcctctgaacgttctatcgttcaaatccctacgttggtagcggaacaaagccggaccacggggcctcatagaatataaaaatacgaggagcttaaacatgtcagatcaagcaacgaccctcaagattaaacctttgggagatagaattttagttaaaagagaagaagaagcttccactgcaagaggcggaatcattcttcctgacactgccaagaaaaagcaagatagagctgaagttgtagctctaggaacaggcaaaaaagatgataaagggcagcaacttccttttgaagttcaggttggtgacatcgttttaatttgataaatattctggccaagaactcactgtcgaaggtgaagagtacgtcatcgttcaaatgagcgaagttatcgcagttctgcaataaaaactaagagagtgaagtaagatttaaggagcgcatcaatggtcgctaaaaacattaaatacaacgaagaagccagaaagaaaattcaaaaaggagttaagactttagctgaagctgtaaaagtcactctagggcctaaaggacgacatgttgtcatagataaaagcttcggatcccctcaagtaactaaagatggtgttaccgttgcgaaagaagttgagcttgccgacaaacatgaaaatatgggcgctcaaatggtcaaagaagtcgccagcaaaactgctgacaaagctggagacggaactacaacagctactgttcttgctgaagctatctatacagaaggattacgcaatgtaacagctggagcaaatccaatggacctcaaacgaggtattgataaagctgttaaggttgttgttgatcaagtcaaaaaaatcagcaagcctgttcagcatcataaagaaattgctcaagttgcaacaatttctgctaataatgatgcagaaatcgggaatctgattgctaaagcaatggagaaagttggtaaaaacggctctatcactgttgaagaagcaaaaggatttgaaaccgttttggatgttgttgaaggaatgaatttcaatagaggttacctctctagctacttcgcaacaaatccagaaactcaagaatgtgtattagaagacgctttggttctaatctacgataagaaaatttctgggatcaaagatttccttcctgttttacaacaagttgctgaatccggccgtcctcttcttattatagcagaagacattgaaggcgaactttagctactttggtcgtgaacagaattcgtggaggattccgggtttgcgcagttaaagctccaggctttggagatagaagaaaagctatgttggaagacatcgctatcttaactggcggtcaactcattagcgaagagttgggcatgaaattagaaaacgctaacttagctatgttaggtaaagctaaaaaagttatcgtttctaaagaagacacgaccatcgtcgaaggaatgggtgaaaaagaagctttagaagctcgttgcgaaagcatcaaaaaacaaattgaagacagctcttctgattacgataaagaaaaactccaagagcgtcttgctaagctctctggtggagtagcagtcattcgcgttggagctgcaacagagattgagatgaaagagaaaaaagatcgtgtagacgatgctcaacatgctacaatcgctgctgttgaagaaggaattcttcctggtggaggaacagcattaatccgttgtatccctactcttgaagccttcttgccaatgttgactaatgaagatgagcaaattggagctcgcattgttttgaaagctctttccgctcctttgaaacaaattgctgcaaacgcaggaaaagaaggtgctatcatcttccaacaagttatgtccttctgcgaacgaaggatatgatgcattgcgtgatgcatacacagatatgcttgaagctggtattttagatcctgctaaagtaacccgttctgctttagaaagcgcggcttccgtagctggattacttttgacaacagaagctctcattgcagagattccagaagaaaaacctgctgcagctccagcaatgcctggcgcaggaatggactattaattcctctaatgggaacaaatagattcttcgagcctcgtttcccaaaaggaacgaggcttttttttagattcctaatatttctctattcctctatcgtaaacatctagtgcttacgaccatccttttctatgtttaaactaatcaagagcgcatttctcatagcctgttgtattgtagggtacttctggataaaaaaagaaagtattgttgagcagtggctatcccaacagttgcatgctcaagtgaccgttggcaatatttcccccggtctttccaaaacgaagattcgccatttatgtatccacaatcctctttcttccgataagtatccctatgcggtagaaattgagtacgtgagtctcaagtactctattgttaccatgattctttcgaaaaagatcgatatttctgatgtaatcctacaaggaacatctctaactgtattcccctgcgaaggatcttctaagacaaactggtcattcttttgggatagctttatcaatcattctaatgagctgaccaagtttcattcttcacagtttgagtcatctgttgatacaatccccgtattcattaaacgttgtctatgtacaaacacgagagtcagtggcatcaaaaacaactataaggaaatccctactacacctgtgccgtctctcgaatttagagggtctttatcttgttctcctctaccaactttaggagaaactgcgagagccttactgtatctcatcgtggaagagagtttttatcacgcaaatgtttcgggagatatcgctcgtcctctttctaaacaggctcgagcatacttcaattcttctctatccgattactcttatctaaaaaaacgaggagcatttccttcgaatcttaccaatgaacttgagggttttatgaaagagttgctattccgatagagcctttcttaattaaaaagggttgtccgtatccaaaaacacaactgattctaaacccgctccttttaaatattgagccaaggcttttggaccaactttttcagtagctgtatgtccaaaagccaaaaaatgaatagccagctcatgcgctaaagaccatgccggctcatcaaaattaccagtgatgaagcagtctacctgctggtttttagcttcggaaatttcacgataagccccgccagaaataagcgctgcagaagaaactcttttctttcctccaagagctttcgctaataccggtgtttgatagtatgcagataattgagatatgaaatcatgaacctccatttctgggaagactcccttaactcctaaagaaggctgagagcttccgaaagattctagttgttcccaacctagatcccttgctactttccagttattaccaatcgttgtatgcgcgtctaacggtaaatgataagctatcaactgaatattcccttccatcaagcgttgcatacgctgatagagtatccctgtgatgggatagggcatccccttccaaaatatcccgtgatgtacaagcaaaacattggcttcgcaagctattgccttctcaatagttgctaaatccgctgtgactgcaaccgccaccttacgaatcgcagtttgtgtattaccaacttgtaaaccattagggccatagtcactaaaatattcaggatgtaacagttcattcaaaatattgagaaggtctgaaacgttcatataaaaaaacctctgctgcaaagagtcgaaaaaagactacggactatttttatttatctccagaacagcttaccatctttttccaaagacttatgatactcgactaaaaaagtctctttaattctgcgatgtcctgatgagcttgggagacttgatagctctgctaacgtgtagctattcggtanactatattntgtgtagaaaacatgtgggaatagtgtaacgcgatangagtaaatacctgcttttgagaaggaagactactaacaaaatgcagcgtctctccataatctttctgaacaagatgaatgattttctcaatatcacaacaatcttctttgggaagctggtagtaagggaactcatacaaacctgccataatctctttctcttcgcgttttgtcatcaagacctgatccttatacaaaacaatcacaacagctcgaaataacctggaaatagctgctcgtgtatttctgacagggtattgttccatagtcccttgtcgatatgctgtacaaaatgaacgcaacggacactgttcacaaagaggctgtttcttacaaattcttgctcccaactcgataaaagactctgctatgacttgaggatcctgatctggaagcaaactctcacaaagccctgtgatctctcttcgcgtgttcatacgatcgatggattcctctatagcaaataatcgactcatcacacgcaaaacattcccatcaacagcaggatttttttgcttaaatgcaaatgcaaggatagcatttgctgtataagacccaatccccttaatggagctaagaagcgctaaatcgtttgggatttctcctccgaaaatctctgtaataacacgagctccggctagcaagttcctagcccgagaataataacccagcccctcccaaagctgcaccacatcgctttctcttgcttgcgcaagatcttgtaaagtcgggaatctttccatccacttcaaaaaatacggaaccaccacttctgctcgagtttgttgaagcataacctctgaaacccaaacccgataaggagtcggagaatctctccaagggaacgatcttttactttcaagaaaccatgaacgtaaagcttccagaggaaaacactctttatcttggaaaaaagctgttcttatcatagaaattctcgtaaaatcgtaccaacacacttatcgataatggattatgcaagaatttattggtacagcggatcgccacataaggctctcttcttttctccggacttctctgcctcatctgcctaaaaaaactattttagaatccgttcgctatcatggttgccgagtcaatggtcgcattgaacgcttcgaatcctataagctgcagcccggagaccgagtaagtttacaaatcatcgaacactcttctccacaattactttgggaggatgagcatctctgtatttacaataaacctgctaaacagacttccgaggatttggctcatcagctcaatgttcatcttgtgcaccgcttagatcgagatacatcagggtgtattctctttgcgaaacatgcaaaagcctcttctcttattacacaactattcaagaatcgagaaatagataaacgctatattgctctagtatttggacaaccacgccaagaatctggaatcattacaacctatacagccccctgctaccgtcgaactggtgctgtattatttggaaatacggatcaaaattccggtaaaataacgattaccaagtgggagattcttacccgctatcccaagtacactttacttctttgccgccccgttacaggacgcacccatcaaatacgcttacatatgaaaacaatcggccatcctattgttggggatgtggattacggaaatcaagaacagccaaagaatgttgtgcggactttgcttcacgcagctagcttagccttcatttctcctttctccaatgaaaaaatcgaaatctcctctctaacgccatcacaagacccttaccctttttacgcagattttaggccttaaacctcttaaaaagcctccaataaacaaagttgtcttaatacaagtagttctggaagctaaagactcggtaagcaaaagaatagtatgaatccgatacaaaaaagagaccgagcctccgcttagaatgggaagctcggtctcattatataaagccctccgctgattagaaagggctttatactagggaaggaaagtacttctagatagaggagctttgcacacctgctttctgtgcccaagaagcgaagcattctctcataagatctttactttctttgctatttggatctcttagaccctctaatagggataggaaagaactttgtgcctcatatttcacaaccagtttacgcacttctgctcgagttctgttgtttgttctcttagaaactctcaaggatgattgcaaatgcgttaaactttcttgcatgactgtattctggaattcttggtattccgcactctgattagaaggtccgccaactattgaaataccactcattaccatgcagacgcataggatctcggttatctgtttaggtgttaaccaaataggtctgcgatcatttcctatagctgcggagagaactgagcagaacttacaaagaagcatggtcaactggtctgtatttagcccttgaccttcgtcatcacaatcctcttctgttcctgtcacctgcaagctagacaaagcaggcaatagtaattcaagatctaaattctcagcttcttgcttgttgcctgaagatgtaataactttaacacgagatgttagatcttgaagagacagcatatgtgtaccgcctgctaatccgctgcaaagagctcttttccagaaggggttatctaaaattcctgcacaagagcaaaggcgtcccaaccatttctcgtgagttatacgcatcatcaacttcccaaggctagaaactgcgtctttacaagccgtctctagttgttctggggtaggcagattggtgaaatttccttttactagatcagagaaagaaatccctaaattatgtagtcccaacatgaatgtggtagaacctacagccatttctaaatctttaagcttacgagcatattcttccaaatttgcttcttctgcaggagactcttgacagcaccatagttcggcacaactacatactaaagctccaaaacttccacagccaccttctccgtcagcacatccgcaagaaggatatccacacgcacttgcgcagcaaggcttacaagcatcatgacacaataacgcgcattttcgaacacgttggctttgcgcagctaacatcagaagttccgtcaatcccgttccagcaatacccacagcgctaacaattggattgggggaagaagataatgctccacaaagatgcgtacaacactctcctagaccaggtcttgctccatccgatgtgggagcgtcattttggagtttcttcaaagcttccaataactcttggagctttttggcatccaacgatcctgaaagagagtatcggctgagtaacgtggcaactaacggagaatttacaccttgagatccagatcctcctaaagcaagaaacagagctataaggtctgctgtagaggctcctttggttgcatctcgcaatggagatgaagaagttgatgttccatcaacggcatcgcctattagattggttatttgagattctccaaacaagtcaaaaatactattgccagtaagagtactcatcccagaaagcacagcccccatttgtaaggaaccagcacctcttgcagaggatcctgatccttgaggctgttgggtaattactaccgaaggaagcgggccatccacagagtctcccgctccaatggatatagatgtaagacttactccactagcagaatatttttggtagcatctattcacgaaaccgcgtccgccatgaccctgattcacaaggctttgcacattagctgagtacgtccctaccattggtatctgtacactaggaccattcccttctgtagaagcgctgctcgtaggttgctggcatacagcagaagcagcaccagaacctgaggcggcgtctgaacccgaagacgtcactccttcttcgctgttaccctcactgcctgatgaaccacacaaacggctccataaagatgaacaagcactaccaataccaaatgacatacctttaactcccggattcttgtaaggattttttatttttaacaggaaattctacatataaaacctgtttttcacactttaaaaattaaaactattaaacagttgttaaaacaaattattttaaaataaacataaatcacttgaaaacagttgattaactctacccatataagaatttgacaaggaaactctttactctagaaacctggatccagccagtgaatctactccttatgtattatgaggcccgtttctcaataaataaagaatctgctactctcctctctcaagaagacaaaatggggttagctcatgttgaaaattgatttaacaggaaaaattgctttcatagccggcataggcgatgataacgggtatggctggggcattgccaaaatgttagcagaagcaggcgcaaccatacttgtggggacctgggttcctatctataaaattttctctcaatcttgggagttaggaaaattcaatgcatctcgtgaactctccaatggagaattgctaactttcgctaaaatctatcccatggatgccagtttcgacaccccagaagatattcctcaggaaattttggaaaataaacgttacaaagatctttctgggtacactgtatccgaagttgtagaacaggtgaaaaaagattttggacacattgatattcttgttcactctttagcaaacagtccggaaattgctaaaccattacttgatacctctcgtaaaggctatcttgccgccttaagtacatccagctactcctttatcagccttctctctcattttggcccaattatgaatgcaggagctagcaccatctctctaacttatcttgcttccatgcgtgctgttccagggtatggcggaggaatgaaaccagcaaaagctgctttagaaagtgatacaaaagtactggcttgggaagccggccgacgttggggagtccgagtgaatactatctcggcagggccattagctagccgtgcaggaaaagctattggatttattgagagaatggtggattactaccaagactgggctccactaccttctccaatggaagctgagcaagtaggcgcagcagcagccttcttagtctctcccctactagcgcaattacgggagaaactctctatgtggatcacggagccaatgtgatgggcataggtccagaaatgtttcctaaggattaactagctgtttgtaacgcagctcaccagcttcccaggcggagagaataccaagatccttcgccgggggagccaaaaagtccgctaatccatgcatctcctctggagccgtctgtataacaattttaaaatctcctcgagatagcaggtcgatatcgttgacatcatccccagaagccataataaaaggcttattctctttatagaaggtctgaacaacttgatctacagcaaaaccttttgaaacatcttttaaggtaagtaaaagcactgcgtatttgaaatcaaaaggccaacgcatgtaattcatggttacctgtgaagaaacttctggagattgaataaatctatccataattttcttcacttcctctctctcaccgaaaaatttggcaatggcaaaatcttcataagaaaattcttctgataaatgtccctgaacatccaccagcagtcgcgcagcttctggtgtaggaaaatacacagcatcaagaatcgctttgagttcctgagatgttttccctaatccctttcgaaagtatacatcacgattagaggctccagattctatacaggcaatgagatctaaatcttcaaaatatttctctaaaacacatagaaaatctcgagacaagctacgaaaataaataaactctttatccgtggaggaccacacggaagaaccattctggctacctaatagaaaaggaaccgaaaagttttgaaaaagaggatatgcataagaaaaatatctgccagttagaaaaaataactgccaaccagaatcatagtattgatgcaaagcctttacaacacgatcatgaagtaggtgggattgatgtgtaattgtcccgtcaatgtctgtaactaataacttctgtaaactcataaagaagctctctctttaccaataacctctaggattatttcttttctttaaattgctttaagaaacctgaaagcatctcccctcgagaagtcgaaggttttttttgatccttctgtattagctcattaagatctgtattcggaggaaattcagataataaggtcactcgctctcctctctcagcaacaactaaagtcttgttcgctactttaatcacatagatggaggtttttgaagccaaaacccgttgatccaaaatcttgatggacgaattgccgctaggaagatgtccgcgggaacgcaaaaaacgtcgaaatagcaaacacccccctccaaatatccctaacaggagaagtaaagagcctagcatcttacctacttcccaacgcatagaaccagagaaagcttcattgacaaaagaaagctcttgaagcacgtctacaaacgaagggacttcttctaaaaaacacaatatatgttgaaacaagcgcaacataaaagacctcttcctcgccggatcctaatcaagatatgtccctcatcctacgaagccaaagcttattaatcaagagcccttgttctaatcaataagctttggcatactccctctttttctaaaaaatactttaggatgatctccatgattccaaggtttagcattgcctgcatccccttagctgtgtggttgttttctggagcaaaaatgttagtgaaatctctatatcttgccctgcactaccaattttctcttgttctatcggcagagctctttgctatagcatggatcctggcctctatcaaacatcgctttatcctacgtaaaagcatgctcaaacagcatgagttggatgctcagctactcattaaagaaatttccccgtggacttttattaaaaggtccttcttatctaaacgtatgtttgtgatcataagcatgtcagttatttcttctttgttgcatcgctctacaacaataccgctgctatcttttctgatgtgttcttctgttagctacgctctgttcaaaacaagcttagctcactggaaatcacttaaagagttaaaatcaaaatattctgtttattattacctgattactctgcaattgccacagccgtagcgtattcgcgactatgacttacggagaggaggactcgtttcacacctagagaacataatagggcctctggaacaactacctgaggctgtctagagtctctacgcatttcaatttctttccactttagtaacttacctatgcctgtacccaaagcctttgctacagcttctttagcagcaaaacgtgctgccaaagaggcatagggattcgacttagaaaagcagtaaacccgctccccttccgtaaaaattttctttagaaaccgatccccataggtctgataagatttccgaatcctatcaatttctataatgtctatccctacaccaaacataatgctcaattttctaaaaatcgttcgacatctaaagctgccatgcacccactaccagcagaagtaatagcttgtctgtaatatttatcttggacatcccccgcagcaaacactccaggaactgatgtgcgagaagaacctttttctgtaataatgtatccattctcgtctaaagctacctgccctcctagaaatgcagtgttgggttgatgcccaatagcaaagaaaactccagcagcttccatggttgtggtggtcttatccacattattatagatgtcgatagaacgaactagagtatctccagaaatcttgacaatctcactattccaaaggaaaaagattttttcattcgcctgagctttattcaccataaccttagaagctcgcaatgtatctctcctatgaaccacaaatacacgtttaccatagcgagtcaaaaacatggcttcttctaaagcggagtctcctcctcctacaacaaacaaatctttgtcacgaaaaatgggagaggctccgtcacaaacagcgcaagtgttacgcccttttgccaaaactcattatctcctgccccagggatagataaacgctttgctgatgctccagtagctataatacaagcatcacaggtaaacgtctcctctccagatttaagaacaaagggtctgacactaaaatcaacagcggtgatgtccttagaaagcacttgcgtaccgaaacgttgcgcttgagttttcataagatccatcaactggtgccccaacactccctctgggaaacctgggaaattttccacttctgttgtagtcattagctgccctccagcaatgccagaaaagaaaccctcgaaaagcactggagtcaaaagtgctctagaagcatagatagcagctgtgtaacctgcaggcccggagcctataatgactaactttgcatgtgtcatgagaacccccaatatgaacttagataaaagagctttaaatacacaggaaaaaggttcccggcttttacaaaaaaaggaactataaccaacccgactttttccgcaaacgacattcatccccctccgatatccttgaaaatctcaaggattgacagtcctttccatggggatgtttagatggaatatttataatgtttcgacacacaaaatctaaaactaaaattacacagaaactagtgaaactttttttaataaagagatgcatcttattacttgtagtgcaagggaaatcttgccttttttaaggtgaatatttacactactctttttgactttgtagtttttaggagaacatcattaaatgccaaaacaagctgattatacttggggagcaaaaaagaatctcgatacgatagcttgcttaccagaagacgttaaacaatttaaagaccttctctacgcgatacatggcttcaccgcgacagaagaagaacccactagcgaagtacatcctggtgcgatcctaaaaggtacagttgttgacataagcaaagactttgttgttgtagatgtcggcttaaaatctgagggagttattcctatgtctgagtttatcgactcttcagaaggtttaactgtcggagccgaagtcgaagtttacctagaccaaactgaagatgacgaaggaaaagttgttttatccagagaaaaagcaacaagacaacgacaatgggaatacattcttgctcactgcgaggaaggttctattgttaagggacaaattacccgaaaagttaagggtggtttgatcgtagatattggtatggaagccttccttccaggatcccaaatagacaataagaagatcaagaacttagatgattacgtaggcaaggtttgtgagttcaaaattctcaaaatcaacgtggatcgtcggaacgttgttgtatctagaagagaacttctcgaagctgaacgcatttctaagaaagcagagttgatcgagcaaatcactatcggtgaacgtcgcaaaggtatcgttaagaatatcacagatttcggagtattcttggatcttgatggcattgacggcctactccacattacagacatgacatggaaacgcattcgtcacccatccgaaatggttgaactcaaccaagaattggaagtcatcatccttagcgttgataaagaaaaaggtcgcgtagctcttggcctcaaacaaaaagagcataatccttgggaagatattgagaagaaatatcctccaggaaaacgtgttcgcggaaaaattgttaaactccttccttatggagcatttattgaaatcgaagaaggaattgaaggccttattcacgtttcagagatgtcttgggttaagaacattgtagatcctaatgaagtggtcaataaaggtgatgaagtcgaagtagttgttctttctatccaaaaagatgaaggaaaaatctctctcggtctcaaacaaacaaaacacaatccttgggataacattgaagaaaaatatcctatcggcctccgcgtaacagcagaaattaaaaatctgacaaactacggagcgttcgttgagttggagccaggaatcgaaggtttgatccatatctctgacatgagttggattaaaaaagtttcccatccttcagagctcttcaaaaaaggtaataccgtcgaagcagttattctgtctgtagacaaagaaagcaaaaaaatcactttgggcgtgaaacaattaactcctaatccatgggatgagattgaagctatgttccctgtcggaagtgatatctctggcgtagtaactaaaattacggcttttggagctttcgttgagttgcaaaatggtatcgaaggactgatccatgtatccgagctttcagagaaaccttttgctaaaattgaagatgttctctctattggagacaaagtttctgctaaagttatcaagctagacccagatcacaagaaagtttctctttctattaaagagttccttgctcatgggggagatgctggtcacgatgcggaagaagaatcttctgacagagactaatctctttactaataatcttcgttagtgaagagcaaacataagagcagagctctagggctctgctccgttagcattattttttttgctttttttcccttacccataagaggagtattaatgaacaaggatcttgtggctatttttgactacatggaaagagagaaaggtattcaacgctctacgatagtaggtgctattgaatctgctctgaaaattgctgcgaaaaagactcttagagacgatgcaaatgtgtccgtaagtatcaatcctcgcaccggcgatatagaagttttttgtgaaaaacaaatcgtcgaaaaatgccaaaatccaagtaaggaaattcctttagataaggcccgtgaatacgatccagattgtcaaatcgggcagtatatggatgttccttttatctctgatcagtttggaaggattgctgcacatgctgcacgccaaattatcgggcaaaagcttcgtcatgctgagagagacgtaatttatgaagaataccgacaccgaaaaaatgaaatcatttcgggagtggttaaaagtttcgctcgcggagccaatttagttgttgacttggggaaagtggaaggactacttcctgctcgcttttatcccaaaactgaaaaacataaggtgggtgataagatttatgcgcttctttacgagtacaggaatctgaaaatggtggagctgaagtaattctcagcagaagccaccctgaatttgttaagcagttatttgttcaggaagttcctgagctagaagaagggtctgtcgaaattgttaaaattgcaagagaggcaggatatcgaacaaaaatggctgtacgctcttccgaccctcaaacagatgctgtaggagcttttgtaggaatgcgaggatctcgcatcaaaaatatcattcgggaattgaatgacgagaaaatagacgttgtaaattattcccctgtatcgacagaattgttacaaaatttgctctatcctgtagagattcaaaagatcgctattttagaagacgacaaagttatcgctattattgtccaagattcggactacgcaaccgttattggtaaacgaggtatcaatgctcgcctaatcagtcagattttaggctatgaacttgaagtccaaagaatgagtgaatacaacaagttgttggagattcaacgtttgcaattggcagagttcgaagaccctcgattagatcagccattagaagttgaagggattaatacgctgatagtgcagaacctagagcacgcaggatacgacacgattaggaaaatattgctggctagtgctagcgaattggcttctgttccaggaattagtttagagctagcttataagattcttgaacaggtcagcaaatatggagaaggcaaagttgacgaaaaacctcaagtngaagattaagaacgcacagttaacgaaggctgntggcttagataaactgaaacagaaactagctcaagccggatcttctgacaccaaaaattctccagcaagtaaagctcaaactaaagaaaagagctctaagaaaactgctggcacacctgctcctgcgcctgaagtggatttgggcgcaacagaatctactgcgcgaagaattcgcgcaaaagatcgctcttcatttgctgcagaaccgaccgtaacaacggctctgccaggagatgcatcgcatttaactttagatgccatccctgcaataaaggctccagaaattacttctgttactcaaaaagaacaaaccctaagagagtgcacagacacttcttcggtccaacaagaagaaaagaaagagtcttcagaagagacttctccagagactccggagcgtattgaagaaactcctattattagaacaagaacagagcctaagagcgttgtttctatcaagcctaagtttgggcctacagggaaacacatcaatcatctcttggctaagacgttcaaagctccagctaaggaaacgaaagcggcatcaactgaagagactactcaacaacagcctcgacaaaatgatgctgcttcccataacaataaacaacaaccttctggaacaagctctcgcccagcctcctctgcgccttcttatcgcagagagtcaacgagcaacaataataacaacgcgaagcgcggatctgaacgagatcgatctaaaagatctgatgagagcgttaaggcgtttacaggacgcgatcgctatggattaaatgaaggttcttctgaagaagataaatggcgcaagaaacgtgttcacaaaacgaaaaagcaagcggaagaacacgttgttcaatgcccagcacacattaagattgctcttccgatcactgtaaaagatcttgctgctgaaatgaagctaaaagcttcagaacttattcagaagctctttattcatggcatgacctacgtagtgaatgatgtcttagatagccaaacggttgtggaatacatcggtttagaatttggatgtacgattgaaattgattcttcagcaaaagagaagctgtgtctagtagagaacacagttcgagacgaagtcaatgcgacagatccagaaaaacttattattcgctcccctatcgtagcttttatgggtcacgtcgatcatggtaagacaacgattattgatgcactaagacaaagcaatatggcagcctcagaagctggagcaattacccagcatacaggagccttcaaatgtacaactcctgttggtgaaattactgttctcgacaccccaggccacgaagccttctctgctatgagagctagaggagcagaggtgtgcgatatcgtagtcttggtagttgctggagacgagggtatcaaagaacaaaccattgaagctatcgagcatgctaaaggagctaacattacgattgtagtcgctattaataaatgtgataagccgaaacttcaatgtagaaacagtgtaccgtcagttagcagaattagatctctccttcctgaggcgtggggcggatcgattgctactattaatacttctgctaaaactggcgaagggttgcaagacttgcttgaaatgttggctttacaagccgaagttctggaattgaaagccgatccttctgctagagcgcgaggactggttattgaatccgagttgcataaaggattaggagctgtagctaccgtgctcgttcaaaatggaaccttgcatctaggagaagcgttagtatttaacgattgctatgggaaggtcaagacaatgcatgatgagcataaccagctcctacagtcggcaacaccttctacccctgttctgatcacaggattatccgcaatccctaaagctggagatccttttatagttgtaaaaaatgagaaggtcgcgaaagagattattagcgcccgacttgctggccaacaaagatctgcagctttgcagaaaaaacgaccaaactttgacgctgtattacagaacaagaaaactttgaaactgattatcaaagcagatgttcaaggttctattgaagctttagcgcactctatattgaatatccgctctgagaaggtagatgtcgaaatcttatctagcggagttggagatatttccgaatcagatattcgtttagcatcggcatctaaagccactgtcattggtttccacacaagcgtagaaagccatgcagaaccattaatcaagaacttgaatgttaaagtttgtctattcgacatcatctatcatgctgtagacgctatcaaagagatcatgacaggtctattagatcctatagcagaagagaaaaacttgggtgctgcagaaattaaagcgacctttaagtcttctcaattgggtacaatttacggctgcctagttacagaaggaaccgtggtacgtaatcagaaaatccgtattatccgggataaagaggttctatggaaagggtctctgtcttccttaaaacgccttaaagaggatgtgaaggaggtgaaaaaaggaatggagtgcggtattctgttagataattatcagcaagcacaagttggtgatatattacagtgctatgaggtcatttatcacccacaaacattgtaggctaatatggctgaaaatagaagaatgaagaaagtgaatgcaatgcttcgagaagctattgcaaaagtcattttgaaggatgtgaagcacccaaagatttcgaatcgctggatcacaataacacgagtatctttgtcgagagacctacagtcggcttgtgtttacgtatccattatgccgcatgagaattcccaagaagaaactcttgcggcattaaaagcttcggcagggtttattgcttttcaggcttctaaagacttagttcttaaatatttcccggatttgaatttctatgtggaagatattttctctcctcaagaccatatagaaagtcttctcttgaaaatagcggaacaagataaaaaaactaacccataacaaaaagacaatccttctgaactccactatcaatattatggaacttgcgacagaatctattgaaggcgttttgctggtagacaaaccacaagggagaacttcttttagtcttattcgttctcttgttaggttaataggtgtgaaaaaaattggccatgcagggactttagatccttttgctacaggcgttatggttatgctaatagggagaaaattcacccgactatcggacatcatgctgtttgaagacaaagagtatgcagcggtagcgcatttaggaaccacgacggatacttacgattgcgatgggaaaattgttgggcgatctaaaaaagttccaactatggacgaagtcttgacttgcacaagctattttcaaggggaaattcaacaagtccctcctatgttctctgcaaagaaagtacaaggaaaaaaattatacgaatatgctaggcaggggttatctatagaacgacgttttgccacagtaacggtaaatcttcgtttggttaaatacgaataccctcgtctacattttgtagttcaatgcagcaaaggaacatacatccgcagtatcgctcatgagttaggcaatatgttgggatgcggagcttatttagaagaactccgacggttgcgtagtggaagcttctctatcgatcagtgtattgatgggaatcttttagacgaacccgagttcaatgtatctccttatttacgtgatgcaaatggacttattctacagcctgctcccgtcctctaatcctatagaatctgttactataggntttttcgatgggtgtcanttangacaccaagctttgctttcttttttaacgaagtttcctggcaaatctggagtaattacgttcagccagcatcctgagcatactttgtctaactctcctccagaaactattacctctcttgaggagcgtattcagcttctagctggctgcggcattgattatctagccgttctcccttttaaccaggaaatagctaatcaagaggcagagctatttatccagtctatttacaagactctacatccatcaagaattgtcttaggttacgattctagacttgggaagggtggtttaggaacagcacaaacgttaaggccttttgctgcctctttagggatatctctagaagaagtccctcccctacagattgaaggcactattgtatctagcagaaaaattcgacaatttcttagagagaaagatttgtgctctgcagaaaagtttcttgggagaccttttgcttatacaggaaaggttgctcatggacgaggaatcgggacatcttttggatatgcaacaatcaatcttccccttacccattctctacttcctttaggggtatatacttgtactatcgttattgaagggttcagctatgcaggtgttatgaatttaggtatggcgcccacaatgcaaagacaccaactatgcctagaggcacatatccttgatttttcagaagatctctacgataagagtattactgtgattcttgagcaatttctcagggaagaaaagctcttttcttctaaagacgagcttgtccttgccattcaagaagatatccgccaagcccgtctcaataaaaatagatgaatgctcctttaattatgcaaaaagagcataatatccccatcctgaacaatatagtccctaccttcaggcacgtagtttcccggcttctcgcgctccagctcttccatcgtaagcaacaatatcctccatagttacaacttcagcgcgaataaatcctctttgaatatccgaatgaatttcccctgcagcctctgccgctgtaacccctttagaaattgtccaagctcgagtctcttgtggtcctgtagtgaaataagaaattaacccaagagtgtggtatgctgaagctactaaacgattcaatccagactcttgtagacctaagctatgtaaaaaatcttgtcgttcctctagagggagcgatagaatttcttcctctaattttacacagataggaactacattcgcctcttctcttttagcgatctcccgtactttctggacataggggttatccagatccgttaaagagtcttcatcaatattcgcaatatagagcataggctttcctgtgaggaaaggatagggtttcaataaaactttttcctctaaagaaagcgagagggttcgaacaggatttcctgattctaaatgatcaactacgcgatctaatagaggtagcaactgcccaatatcttttttccctttagcctgttttccaagtttctctcgcacgctagtggcagaagaaaagtctgctaatacgagctctagattaatcacagctatatcttcttcaggatcaattttcccagatacatgggttatatcatcattgtcgaagcaacgaacaacatgcgcaatagcgtgagtctctcgaatatgtgataaaaaacgattccctaagccagcaccgctagctgctccttttactaatcctgcgatgtctacaaacttcatatctgcatagataatcttttggctctgactaatacgtgctaaggtctctaaccttggatcgataacaggcacaataccgacattaggatctattgtgcagaagggataattacaggaggcaacttgtgcgcctgtcaacgcattaaataatcctgatttccctacattaggaagacctactattccgcactctgtttgtcccattttcattacctaagaagttgtacagctttttcttaaggctaacacagcctttttattattaaggaaaaagaaattctaaagaaaaagcaagattagtgcttcatgaaaaacgctctttaaaaaaaatattctgttctctacacaaccccttactctttgtttataaatgggatgagcatctgccaccttctttcttgagaaaaacatttatatacggtaacttgcgaagtattccttatagcgcttaagcaactggccatctatgggcgaaaaaacagaaaaggcgacccccaagcgtcttcgggacgctagaaaaaaggggcaggtagccaaatctcaagattttccttctgcgattacgttcattgtctccatgttcttaacgttttctttggcttcattttttgctgaacacttaggaagctttttagtatctatttttaaaacagctccccagaatcatgatccgcacttagccatctattatttaaaaaattgccttattctgattctgacagtctctcttcctttgttaggagcggtgggattcgtaggattgttgataggattcttaattgttggtcctaccttctctacagaagttttcaaaccggatttaaagaaattcaatcccattgacaacctgaaacaaaaattcaaagtaaagactttcattgagttactgaagtctatttttaagatttcaggagctgctttaatcctctacattgttctaaaaaatcgtgtagaacttgttattgaaactgcaggagttcctcctctggttacagctcaagtgtttaaagagattctatataaagcggttacttctattggcctatttttccttgtggttgcagtgatagacctcgtgtatcagcgtcacagtttcgctaaggaactcaagatggaaaaatttgaggtgaaacaagaattcaaagatacagaaggaaaccctgaaattaaagggcgacgacgtcaaattgctcaagagatcgcttacgaggatacgtcctctcaaatcaagcatgctagcgccgttgtatctaaccctaaagacatcgctgtagcgattggctacatgcctgaaaaatacaaagctccatggatcatagctatgggggtaaacttaagagcaaaaaggattattgcggaagctgagaaatatggagttcctatcatgcggaatgttcccttagcacaccagctgctagatgaaggaaaagagttgaagtttattccagagaccacatatgaagctgttggggaaatccttctctatatcacttctcttaatgcgcaaaaccttgagaataaaaacattaaccaattcgataatctgtaatgaacaagctactcaactttgtcagtagaacattcgggggagatgcggccctgaatatgataaacaagtccagtgacctgatcctcgccatgtggatgttaggcgtggtcttgatgatcattttgccattgcctccagctatggtggactttatgatcaccattaacttggcgatctctgtgttcctgctgatggttgccttgtatattcccagcgcattacaactttctgttttcccctccttactcttaatcaccacaatgttccgattggggattaacatttcttcctcccgacaaattctccttcatgcttatgctggtcacgtgatccaagcttcggagacttcgtcgttggaggaaactatgtcgttggatttattatcttcctaatcatcaccatcattcagtttatcgtggtaacaaaaggtgcggagagggtcgctgaggtagctgctcgattccgattagatgccatgcctggtaaacagatggccatcgatgccgacctacgagcaggaatgattgatgcgacacaagctcgtgataagcgatctcagattcagaaagaaagtgaactttatggagctatggacggagccatgaagttcattaagggagacgtgatcgcagggattgttatctccttgattaacatcgtaggaggattagtcatcggagtgaccatgaagggcatgacgatggctcaagccgcgcacatctacacgttgattacgatcggtgatgggttagtttctcaaatcccctctctgttaatctctttaacagctggtatcgtaaccactcgagtatctagtgataaagacactaaccttggtaaggaaatttctagccagttggttaaagaacctcgggcacttctcctatccgcaggcgcaaccttaggaatcggattcttcaaaggtttccctttatggtcatttgctttaatggccgttctctttgcagtattaggtattctgttaatcactaagaaaaactctccagggaaaaaaggcggagccagctctactactacagtaggtgccgctgatggagctgcggcttcaggagaaaattctgatgattatgctctgactcttcctgtaattcttgaacttggaaaagatctttctaaactcatccaacaacgaaccaaatcggggcaaagttttgtggatgatatgattcctaaaatgcgtcaggctctctatcaggatattggaattcgttatccaggaatccatgtacgtacagactccccttccttggaaggtaatgactatatgattctgctgaatgaggttccctacgttcgcggaaaaattccaccaaatcatgtgttaacaaatgaagtagaagaaaacttatctcggtataacttaccttttattacttacaaaaatgctgcaggattgccttccacttgggttagtacagatgctctcactatcttagagaaagctgcgattaaatactggtctcctttggaagtgattattcttcacttgtcctacttcttccatagaaattctcaagagttcttaggcattcaggaagtacgctctatgattgaatttatggaacgttccttccctgatcttgttaaagaggttacccgtcttattcctctacagaagcttacagaaatctttaagcgtttagttcaagaacaaatatccattaaggatttacgaactattttggaatctttgagcgaatgggcacagacggaaaaagatacagtattacttactgaatatgtgcgctcttccttgaaactctatatcagcttcaagttctctcaagggcaatccgctatttctgtatatctgctcgatcctgaaattgaagagatgatccgcggagcaatcaaacaaacttctgcaggatcttatttggctttagatccagattctgtaaacctcatcttaaaatctatgcggatgactattactcctacacctcctggaggacagcctcctgtgctgttgacagcaattgatgtcagacgctatgtacggaaattgatagagacagaattccctgatatcgctgtgatttcttaccaagaagttttacctgaaattagaatccagcctttgggaagaattcaaattttctaaccgtgaggtgagaagagatgactgcatcaggaggagctggagggctaggcagcacccaaacagtagacgttgcgcgagcacaagctgctgcagctactcaagatgcacaagaggttatcggctctcaggaagcttctgaggcaagtatgctcaaagaatgtgaggatctcataaatcctgcagctgcaacccgaatcanaaaaaaagaagagaagtttgaatcattagaagctcgtcgcaaancaacagcggataaagcagaaaagaaatccgagagcacagaggaaaaaggcgatactcctcttgaagatcgtttcacagaagatctttccgaagtctctggagaagattttcgaggattgaaaaattcgttcgatgatgattcttcttctgacgaaattctcgatgcgctcacaagtaaattttctgatcccacaataaaggatctagctcttgattatctaattcaaatagctccctctgatgggaaacttaagtccgctctcattcaggcaaagcatcaactgatgagccagaatcctcaggcgattgttggaggacgcaatgttctgttagcttcagaaacctttgcttccagagcaaatacatctccttcatcgcttcgctccttatatttccaagtaacctcatccccctctaattgcgctaatttacatcaaatgcttgcttcttactcgccatcagagaaaaccgctgttatggagtttctagtgaatggcatggtagcagatttaaaatcggagggcccttccattcctcctgcaaaattgcaagtatatatgacggaactaagcaatctccaagccttacactctgtagatagcttttttgatagaaatattgggaacttggaaaatagcttaaagcatgaaggacatgcccctattccatccttaacgacaggaaatttaactaaaaccttcttacaattagtagaagataaattcccttcctcttccaaagctcaaaaggcattaaatgaactggtaggcccagatactggtcctcaaactgaagttttaaacttattcttccgcgctcttaatggctgttcgcctagaatattctctggagctgaaaaaaaacagcagctggcatcggttatcacaaatacgctagatgcgataaatgcggataatgaggattatcctaaaccaggtgacttcccacgatcttccttctctagtacgcctcctcatgctccagtacctcaatctgagattccaacgtcacctacctcaacacagcctccatcaccctaacttgtaaaaactgtaataaaaagagcgcgcttcctttatgcaaaatcaatttgaacaactccttactgaattagggactcaaatcaacagccctcttactcctgattccaataatgcctgtatagttcgctttggatacaacaatgttgctgtacaaattgaagaggatggtaattcaggatttttagttgctggagtcatgcttggaaaacttccagagaatacctttagacaaaaaattttcaaagctgctttgtctatcaatggatctccgcaatctaatattaaaggcactctaggatacggtgaaatctctaaccaactctatctctgtgatcggcttaacatgacctatctaaatggagaaaagctcgcccgttacttagttcttttttcgcagcatgccaatatctggatgcaatctatctcaaaaggagaacttccagatttacatgctctaggtatgtatcacctgtaaattatgccgtcattatcccaatcccgacgtatcatccagcaatcttccattcgaaagatttggaatcagatagatacttctcctaagcatggcgtatgcgtaccgttattttctctccatactcaagaaagttgtgggataggtgaatttcttgacctgattcctatgatcgattggtgtatctcgtgtggttttcaaatccttcaaattcttccgattaacgatacagggtcctgttcgagtccttacaatagcatttcttcgatagcactcaatcctcttcacctttctatctctgcgctcccctataaagaagaagtgccagctgcggaaacacgcatacgagaaatgcagcaactctctcaacttcctcaagtacattatgaaaaagttcgctctatgaagagagatttttttcaagagtactaccgcgtgtgtaaacagaaaaaactcactgatcatcctgatttttatgccttctgtgaacaggaaaaatattggttacatccctacgctctctttcgctctatccgagaacatttggataaccttcctattaatcattggccaaccacctacacagatctctcccagattaccgagcatgaacgtacttttgcggaagatatacaatttcactcttatctacagtatttgtgcttccaacagatgacacaagtgcgggagcatgccaattgcaaaagctgtctcatcaaaggggatatccctattctaatcagtaaagatagctgcgatgtctggttttataggcattacttttcctcttcagaatctgtaggtgctcctcctgacctgtataatgcggaaggtcagaactggcatctccccatttataatatgaaaactttgcaacaagataactacctctggtggaaggagcgcttacgttatgcggagaatttttactctttataccgtcttgatcatatcgtcggtctctttcgattttgggtatgggatgagtctggatgcggacgctttgaacctcatgatccgaaagactatctagctcaagggcaagatatcttatctcacctcttgaccagttcatctatgctacctataggagaagatctgggaacgatcccttccgatgtgaaacgtatgctcgagtcttttgccgtatgcggcactagaattcctcgttgagaacgaaactgggaagggaatggagcctatacccctttcgatcaatacgaccctctatccgtcacaagcctctctactcatgattcctctacattagcctcatggtggaaagaatctcctcaggaatccaaactatttgctcagtttttaggactcccctattcttccaccctatctcttcacaatcataccgaaatcctgaaactctctcacaaaacctcttctatttttcgcatcaatcttattaatgactatctggctctgttcccggatttgatatcaaaaactcctcgctacgaaagaatcaatctgccaggaactatttcaaaaaataattgggtgtatcgagttaagccttctattgaagatttatcctctcattctaagctaaattctttacttgaggctctattttaggtttccttgagtacttttattttgaaacacattttctgccactttttcacgaaaacttcttcccgatatattaaaaaaggtctaacatagtttctttttgttacagttgccctgtcgagagatagcggccagtgaatataggaaagtcatgtcgaaaaaatgtgcgcttacaggaagaaagcctcgtcgcggttatagctatgctatccgagggatttctaaaaagaaaaaagggatcggtttgaaagttacaggaagaacaaaacgtcgattcttccctaatatgatgactaagagactatggtctactgaggaaaatcgcttcctcaaactcaaaatttctgcagcagctttacgccttgttgataaactagggttagatcaggttgttgctagagctaaaagcaaaggtttttagtctcctatgtgcatgctgagaaagattttccctcagcatgcgtgtatctatccctgacacatagcctttttggggcagttcggaaaactatttttatattcgaataagcggactacgacgtgttttccttacgatctttagtggattatttgcgctctcaacatgagctcattgatattcatgttcctgtagatccccatttggagatcgctgaaatccatcgtcgtgttgtagaaagagaaggaccagccctcctttttcatcaggttaagggatcgcctttccctgtgctcactaatttattcggcactcgaagacgtgttgacctactgttcccagatctctcttcagatctttttgaacaaattattcacttactatcttctcccccttctttttcttctttgtggaagcaccgctctcttttcaagcgtggaatctctgcattaggaatgcgtaaacgccatttacgctcctccccttttctttatcaagatgctcctaatctctcccagcttcctatgcttaccagctggccagaagatggcggcccctttttaacacttcctttggtgtacacccaatctcctgagaatggcgtccctaatttagggatgtatcgtatgcagcgcttcgataaagagactttgggattacatttccaaattcaaaaaggtggtggagcccatttctttgaagctgaacaaaaaaaacaaaatcttcctgtcacagtgttcctatctgggaatccttttttgatcctatctgctattgcccctcttccagagaatgttccagagcttttattttgttcttttttacaaaataaaaagcttagctttgtagagaagcatccgcagtcagggcaccctctgctatgtgattctgaattcattcttacaggcgaggccgttgcaggcgaacgtcgtccagaaggtcctttcggagatcatttcggatactatagtttaacacatgatttcccgatctttaaatgcaactgcttatatcataagaaagatgctatctatcctgcgactgttgtaggaaaacctttccaagaagattttttcttgggaaataagcttcaagaactactttctcctctcttccctctgatcatgcctggagttcaggacctaaaaagctatggagaagccgggttccacgctctggctgcagctatagttaaagaacgttactggaaggaagctctacgctctgctttgcgaatacttggagagggacaactctccttaacaaaatttctatggattacagatcaatccgtagatttagaaaacttttctagcttgttagaatgcgttttagaacgcatgaattttgaccgcgatcttcttatcctttcggagactgcgaatgataccctggattatacaggtagcggattcaataaaggatccaaaggtatttttttaggcgtgggagctcccatccgctctttacccagacggtatcgaggcccttctcttcctggaatatctcaaataggagttttctgtagaggttgtttagttttagaaacttctctacagcagctagatatccccgctctactcaaggacccccatttagcagattggcctcttgttattttagtggaagatctatccagtgctctctctagtacgaaagaatttatatgggagaatatttacacgatcttctcctgcaacagatttacacatccctgtaagtcaaatcactaatcacaaggtgagttacaccccccccatgatcctgaatgccctcatgaaacctccttatcctaaggaagtcgaagctgatgaggcaacgcaaaatcttgtttcttctcgctggcatagctatttcccataataaccttttttattgttttttgtttaaaaacagattgtaaaatagattttttgttttgtttttaattaaaagaaaataaatagccgtaaaaaatcatgttagtaacaactattcatgagcagattaaaaacagcaccttatcgaggtgtcaaggagctaaacacaatcaaatgaaaaaaacaaaacacttatttccaaaataatgttcagcttagtttccctttttgttggaggatttttactaaaagccccagccccgactcaatctgctgataccttccaaacgcttattgaatccaaggaacctgttatcttcaccaaacagtgtggagacaatgtaacgcaaatactatgtgatgcgatagactctgcaaaaaaagatatttttctcagnatttatgacctatctgctcccgctatcacgacaagtttgaaaaaacaagtgtccgctcgcattcctgtatgtattcattaccaacgtatctctaaaaatgcggagttctctcagtctccctatcttaccccttgggagaacatcctcccatgcacagaaaactcatgcatcaaaaaactatggcaatagatggagaactcgcttggatcggatctgctaattttacattagcttcgttagagaagagcgctaacctaataattggattaaaaagcgcagaaatttgtcattttattaaaacgcaaacctctggtcggtgctttattaacaatcaactcatcgagtattgtttcctttgatggagggagttctgctgctctagaaacagttcttcaccatattcgatcagcgaaagaatccatccaagtaggtatgtttgctctcactttacctcagattattgctgaattgaatgccgcacaaaactgtggtgttgatgtagtgatccttgtcgacaaaggatacaaatcctttaccgtacagcaaattaagcaattagaacatcctagtctctctatttatgaaaaggtaaccccgtaccaactacatcataaatttggcattttcgataaaaagacgctaattacaggatctgtcaattggtctgagaatggcttccttattaatacagaagacatgattgtcattgaaaatctgacagaaaaacagcaaagcaaaatacaagcgatatgggaaggattagtaagagagtgtgctttgtattactccccagatcaagaggaaaaagaaaaagatcctttaatcattccgttccctcctagcgaaaaaaaacaagctgcttgattggattgcaagattattcgttgtctttatgttggaatagtgacaacgtcatctccaagattccttcattgcgggcaatcacccaagcctctgcggcatgagcaatagcttgtgctgcagcagcgctaatacagatcgttttcttagattttctggtaatccgagatcctaatgacttagagcgcttggatttatcatcccaagaccactcgatgacaactcctgcttgcagtttttggaaatccaatcggaaatgacgtagctgaccaagcaacatcctggtttgttttttggttaagattttgaaccgatgcttttgttttttttctttatcttcttgatcggcaatagccaataaagccatgcgtaaagcttcattacgagcaatctcttctgaaattttctctgatatgctcccattctttcgctcttgaggatctttcgctatcgcttgaaaagccatggatccataaggatcaaaagggattattctcatgaatcgccgcctgcatcctctgtttctctcgttttatcctgctcttggtctttcccttcatcactatctcgatttccacctgcagcttcttcttgatcatcattgtatacagctacagcttccggcttaccttgcacggaaaaacgcgaagaaacactgaatggagacggtgattgaaaaataatggcgggatcaacagccacatttcggtattgataaatcaatgggtctggaggtcctccaggacctttacgatgttctaccgcagtcttataatcctctgtagaaagaggaaccgaggctaacacggccatccctaaatgggaaggaaactggtaagccgaactaaccgtatcttgtcctactacctcagcagaaactggtatctctcccaaactctcattctgaataagagcttgttctgtattcgcagtctcctctgaaaataccgtactatgttgaacagcaaaagggatttcattaacatccaaaggagcttctcctacagggaacctataagaagcctcctcgtgcaagcttgttgtcggtaaaggggacgcattattttctctccgtgtatcaaacgctatgcttcctatctgagaatccaatccccaaatggtttcgttatcttcctttttagaaaaatgatgtgggatagttcctgagaacttaggttcaggaaattgtgttgagcctgaactaggagtggaagaagctataaaaactgccatcccttgaccagagcttaatagcgctgccatcatttttgccatggctgccatctcttccaaagagagctctccagtctttttttcttcttctgcagaagctggatcatcaacaacagtatttactaatccttccatggataaacttgtagtctggtttcccatatccgaaacatcgaccatcccttcgttacttacggtaggagctcgacgtagaagagaagacgtctcaatattggggtctaagagagtggaaaccatttctcctcccaacctagcttctgtccaagcattaattgtctgctcattcaaagaagctgcacgaacattaggattaaacgaagctaatgcagtgatttctccagatgatagatgctctatagacacaggatcttgcatagtcgtcaatgaaggggttgttgacagggcagtagctcccaaacgattttccgttttagaagaaacatcagacgttggactccataatcctgaagctccaagataaaaattttgcatttcaggagaaacccgattcccttttttcttcacatattccatctggctagggatcatagacatcccttctccattattttctgccttacgagcagaaatacgagaagctcgcgttccaaatcctgtaaggaatcctttagtacctgcacgtactttggaaaaattcccttttaattttgttttaggagatttcgaagtcttatcgagggtctttttgtatttaccctcgctttgctgcaaatccgtgacatagtctagttccgttccagaactaattaacgcttgttgttctgcagcagacgtttccgtagccttggatgctccggaggcctctttggctgcatgagctgatgccgcctgtcttcccatcaagatggatgggtcaaaatcaggagttgcaggagatacattaccacttccagaaattgacatgattttttcctaaaaaacaaaaaaccaatgaatgggtaataataattttaaactgaaacagtgaattatgaaattaaaacaaaagatcggaataaaaacatttggacaaaaaaaacgcaaggctctgggccttgcgaaaaaaaccaaaaaataggttagacggaaaagaaaagcgggtagatgcaataaagtgcatctctgtagccccaagcaggcactcatgcctaaccgctcagtgataaagattttggagatctttattactgggcggtctttgagaccaatatatacacccaggctccccgtctttccattttgggttaatcccacttattagttttttatttgatctttctcccccactacagtttcacagaatatcgcccaaaattatgaaagtctgtctccacaaagccattctggtacgtaaaaatcaaaacttggtcagaattttgaggaacgtgtttatctaataacgaatgtactagcacatcgaactctttcgctctttttcgtagagactctttttcttttgaggctgtgctgtaataacgtttgtgctctttcttggtttcgccttcaatagaagctgggaaatagtttcccgtcttacgcccaatcacttgagctagcttgcgactgcttctttttttcatgagcagaaaccagaataatttatttcaaaaatctattctaattttaaattaaaaaattgtttttcataaaccataaaacaattgataggaacattaaattattaacaatccttgccgttatccctctatattgctgtaaatcattttatcttttatagtccggcgatgctgacactaacccattgaggcctatattcctctccgcaatattcctttcccaacgctcatcaaaacattctttgagaatctctcccaagccactctactcctagtctctttggtcagttttctcttattccctcgctatttccctgaatggcgaccagtgtactttgctcctttgattgtcactactttctattcccaacctaaagaacgcgtgctgctttgggctatgctctcgggtctgctttgtgatatgggctccacctgctttatgggcatccaagcttttctgtatgtgagcacctctcttatcctgtacaaaacacaaagattctttattaaagaacgttggatctcgttccctctcatcagtgctctattttccctaacgttctattttctctcttaccccgttctagcattcttcaatcgccctctatgcctatataacacagcccttcttgccgatttacaacacgttctcatggtggatctaccttacggggcgcttctcagtcttctggctcataaaaagtctttcactcctcagatctgattctctttcagtcttctagttttaaaaattcatcagcttttgtaaactgatcaagagaggtctagactctttccctctaaacaacctatgtgaaaccatttaactaagtatttgtgcatgttattaaagggtgcgccagcagctgaccatattttagcaacaatcaaagaaaatatccgagcctgctccaaagctcctggtcttgctgttgtgttgataggaaataatccggcctcagaaatctatgtgaatatgaaaatcaagcgtgctacggatttggggatggtgtctaaatcctatcgcaagccctcggatgccacactatccgacattttagcgctcatccaccaactcaataatgatgagaacatccacggaatccttgttcaactccccctacccaaacatttagacgctcaagccattctttccactatcacccctgacaaagacgtcgatggactacaccctgtcaatgtagggaaactacttcttggagaaacagatggatttatcccatgcactcctgctggaattgtagaactgtgcaaatattatgagatccctctccatggaaagcacgttgttatcttaggacgtagcaatatcgtaggtaaacctttagcggccttacttatgcaaagacatgcagatactaatgctagtgtcactctccttcatagccaatctgagcatcttaccgagatcactaggactgcagatattctcatttcagctattggagtaccgctctttgtaaataaagagatgattgcagaaaaaacggtgatcatggatgtcggcacctcaagaatccctgcagcgaatcctaaaggttatatccttgtaggagatgtcgattttaacaatgttgtacctgtttgccgagccattactcctgtccctggtggagtcggcccaatgaccgtcgctatgctaatgagaaatacatgggaaagttttttgcgtcatacctcctgatcctagcccccttcttcctccaatcctgttcagctccttcaagaactactcttgaaggggtccgtatgacaattccttatcgcattgtatttggagaagcactttctccagatgcattccaacaagcgcaaaaggaaattgatcgagtgtttgatcatatcgatcaaacttttaataattggaatcctctatccgaaatttcccgtattaatcgcaccacaaaacaaacccctatccccttatcgccagcactctttgcttttctatgcgaaatagaccatttccacgccttctctgatggccgtttttgatcccaccttaggcgctttaaaaagcttatggctactgcacctaaaatcccatactatcccttctcaagagctccaacacctctacaaacacagctctggatggcatctgatttctcttgataaaacccagcaaactttaaggaaactttcgcctctcgtccaattagatctctgcggaactgtaaaaggttttgctgtagatctattaggaacagcttgtgctcaattctgtcaaaattactacgtagaatggggaggagaaatcaaaaccagagggaaacatccttccggaagatcttggctgtcgcttcatcagctaccccagagattcttcatctgcatgatcatgctatagcgacgagcgggagtcaatatcaacgatggcatgtggacaacaaaacctacacccacattcttgacccgttaacgggaactcctctagaagatagcagccatcccatccttgcagtttccgtgatcaacgaaagctgcgcctttgcggatgctatggctactgcactgacgaccttctcctctaaacaagaagctcttgactgggcaaataagaaacatctttgcgcatatattaccgacaagaacgtttcatagctgcagccaattcacgattcttttctcgttcaataatagactgccgcttatcatgagctttcttccctcggcaacagccaatacgcaccttgacaaatcctttagaaaagaaaaagctaagcggcacaaccgtcaatcccttttgagaaatgcgagcgtctagtttgtgaatctcgtacttatgtaaaagaagtttgcgcttgcggcgctcttcatgattattgatattcccaaaccgatatggagctatacttgactgtaatagccaagcttctcccttagagatcgtcacataagcatcccccaaatttccaccatgatctcgcagagaatttaatttctgttcctgttaaaacaatccctgcatccaaggtctctaaaacctcgtaatgatgaaaagctttgcgattcgaaacannnccttaacgcccatgtttttacctcttaaaaactaaggagagtatagcaaaaagggcttcttcttgaaagaaccgtatgcccctctctccttaaaaggattcttcctttgtcattgataataatcctaatcagcaagtaccatgtgaatttccgccttcatggggctttttcaaatccgtcttttgtcaagatattttttactaaagctagccccgagagacgacttacttgcttccatgtcacaaaacatggttattcattccaaacagacttacatgattacaggaaaataatgaaattcgttatctcccgcaatgaattaggaaatctaattaaaaaagttcagaatgtcgttccacaaagcacgccaattccagtattgactcatgtactcattgaaagctgtaacgatgagttggttttcacggctacagacctgacggtcagcactcgttgtgttgttaaagcaaaggtctatgagtctggatctgttaccatcccttctcgaagattcttccaactcattcgtgagttaacagaggcaaatattgaagtagcagctcattctggagaaatggcgacaatcacgtcgggttcttcctgttttcgcctgttaagtatggggaaagaagatttccctatgcttcctgatatgcaaaatgctctgcgtttcactctggattctgagcgattaaaagacatgttccaaagaacctcttttgctgtatccagagaagagagtcgctatgtactcactggcgttttactttctattgcgaatggaactatgacagtcgtgggaactgatgggaaacggttagctaagatcgatacagagatttctttagatcctagtttttcaggagactatatcatccctatcaaagccgtcgaagaaattattcgcatgtcttcggaagatgttcaatccactattttcttagatcaaactaaaatcgctgtcgaatgtggaaatacactattagtaaccaaactcctttctggtgaattcccggacttttcccctgtgatctccactcatagcagtgtacaattagatctacatcgtgaagaactgatctcccttctcaaacaagtggcccttttcactaatgagtcttcgcattctgtcaaatttagcttctcacctggagaactaactcttacagccaactgcacaaaagtaggagaaggcaaggtaagtatggctgtcaattatactggtgaaaccctagaaatagcctttaatcctttcttcttcttagacattctgaaacacagccgtgatgaacttgttcaattaggtatctcagattcttacaatccaggaatcattacagactccactcgcagcttgtttgtcatcatgcccatgagattacatgacgattaatgcgggttctttctttatttcttaaggatttcagaaattatacagatcttcgtttagaattaggaccggagatgaattccatcttcggtcttaatgcacaaggaaagacgaatcttcttgaggctctgtacattctatcactaggtaggtcttttcgaactagtcgactgaccgatgccatacgttttggagcatcccacttttttatagaagctgtgttctcgcataaagaggtttttcatactctttctattcaagtggataaaaaagggaagaagatcctgtttgacggagctcctattacgaaactctctgagctagtagggttatttcctgttattttgttttccatcaaagacatagcaattattgaaggctccccttcagaacgtcgtcgttttttagacctcttactagcacaagcttcagataaatacaccgagcatatttctctctaccacaaagctttagaccagcgtaacgcttctattaaagctcagaatcagaaagctatttctgcatggaattccccattgattgcttatggtagtctggtagccttcttacgcaatgaatgtactaaaaagctaaatacgatctttcaaactctttgggataatacgttaaaagagactctatctcttcgttatgagagttctctcattacagaggaatcccctaccctcaatgacatagcgagtaattactacgaacaacttcgcatagcaaatactaaggacctcgatcttggctatactatggtagggccccatcgggacgaactccttctaactatcaatgatcttcctgttgctaaattttccagcgaaggccaaaaacattcgcttttagccgttcttcgatttgctgaatgcgtgtatcttcaagaagagttttgtatccatcctcttctgtgcatggatgacatccatgcttgtctagatcaacagcgtttagatcagcttctgcaactctcaaactctttagggcaagtggttacaacttctactatttgtccagatcaccgcagcacaacatcctgcatttttcatgtgacacaagctcaagtatcccttgtagctcctcaatctctataatttctccttcgcaaaaactgtttgttaattgaaacaaactttgttgttttattttattgataaaaagatgtttggatcacataaacaaactaagtaaataaacacctgtttttaataaaacaaacttatttaaaataatattaatcggtgttgcgaaatgaagaattttttattaactatactctttctattaatgggaacttccctattagctgatccctctgtgattcaaacattgacatcaggggttgctggggtgaactcgatacgcgaagaaaaggaatctgttgtgtgcgttcacgcgtttctaagatcctatggttcgctaaaacctattggccgggttctggaaaaagaaaactatgatgttttcatttggaactatgaaacccgaaaatttacattagaaaaacatgctgaacatcttgttcgattactcaataagattgcagaactgaaacctggtataccgattaatttcgttacgcattccgtaggaggagttattgttcgtgtagcattagctcatcccgattgtcctgaagaagctaaaaaaggcaaagcggtccttatggcgcctcctaatgcagggtctacattagcaagacgctatagccgaagctctttagtgcaatttgtctttggcagaaagcttggtatgcagcttcttacatatagccctgagcatatgttgaacattgcaaaaatgccttcttctgttgatgttctcgtattaagtggaactaagaaaagtaagtttctactgtttcaattagaagaagataatgatggcaaggtctgtgtaacagaaacaagattagatactccacaccaaaactacatcattgatgcgaatcacacatacatcattacgaacaaaacctccctattcttaatgagggagttcctaagaaacggaagtagaagctctgctcttacccaagtcccagaagagatagaggcgagcatacaacaatctcctaaagccaaagtgaataaagaaaagagtaaagatatctacgttattcactgcttaggagctcacccctatagcctttacgggttcccaaaaagtagaacatcacccaacgaaaactctagaaaggtcttggagggtcaagaatacaaaaaataggaccaatagaatcataaacgggacaagagctttctcaacgagccgcatatttaatcgacgtctggaaagaatctcccataaacacaaaagtatataaccgccatccaatacagggataggaagtagattcaacactgctaggtttacactgatcaacccgatccaagccaaagcctcaggaatccctacagaccatcctgtatggagaatacgcacaattcctacaggtcctgatagccattaaggctcacccgccccatccccaaggctttcacagtctttaagctgtctgaaacggattcctccatcaatacccagggatccggattgtactgaacggctagatcttaagggaatgcctaaagaaatccgctgattttcggcttctattctttcgagataataacgtctctcttgttcatctcggaacttggatgcaagagctcgctgtttgtccaacaacgcctcagaataaatatgtgcccaaggtctaggctgcacccgtgttaccaaacgataatcccctaaacgggatacctcacgttcctctccaacagactctgcaacacgtagaagatcgtccatatcataggaattaataaatgcctgatctgcagccttctgctctaaaacagtcagctgctctggagacatcctttgaaatatcaaagacactctatgatcttgaacaagacgtaaaatatccgcattgctcatgacagggattccatcaacggctacgattttgtcgcctaactctagattatagtccaaagatacccgctcattgttgagcagtttgaccttactttcaacaaaaccatccccattaataatatatgggagcatgtacaatgaagcccatttgcctttaagacctgcttcatactgacaatctatgagttcgtttttaaaatacggagtgagagttaaatctcccgctaggactctagcttgacgaacaaacaccaccttcccttgacgctcaaccctcaaaaaggattgcttttcattgagcatttgagaaacttgtgctccagaaaagactaacaacccatccatccatactagacgatctccttcagacaatccagcgtctactaaaggagatttttcaggtaaaggatcggatcctcgatacagcagataactagctcctaaacaaggaactccttccatatcaggattaaacggtgcttctaatgaaaaagcctcggactcagaaaagtaggctggatgctgcccttgcaacgatagctttctttcaagaagagaagatgaaaaagccattttatgcccagaataaggctgcccattacaaaagaaaatctgatcccctgcatgtaagccttgttgctccaaagaagggtgcacccaacctacaatgctggtgtgttcagaaaatgattttgttctaccaccagaaaaatagagaatcccgaaaacaaatatagccacaagtaggttagctaaaggcctgcggctaaaacaaaaatccgcttccaaggcgacttactaaaaaagccttctgggatatcgtaaacagttttctctttgtctccagaattgtctttatcatttctatccatacctttgatacgaacatatcccccaaaaggaatcgctcctatccggtactcaacgctccctattttctttcgaacaagagctgggccaaaccctatactgaaactctctacagacattccgacagcttttgctgctaataaatggccaagttcatgaattaaaatcagaaaacctaaagccagggctgcaagaacaaaatatattattgtcatactctatatacctgaatgatctttgttctaagccagactatactctacttaaaacagctgctaaacaagcctctatcaggaagcctaagatactataagacgctcaacaaaacaaagagccgtccctatactacacgaatcgtttttttccgcaccactatcgaaaaaactgacatcccacgaacatagaaatagttaacactcttgagcacgagctctggcctcagcatctaccgatagaatttcttccagggataaacaggattgcacgcgatgctgatccacaagagcttgtaatttaggaactatttgatgccaagaaatctcgcctgctaaaaatcgatgaaccaaagcctcattggcgccattgaaaaaacaccccatagaccccttttcaagaagcactcgcttcgctagatgaacactagggaatctatcttcatctatcgggaaaaactctagagtgcgatttgaaagaaaatcgaatcctggacctattgcagggctacgttctgggaaagtcaaaacatgttgtattggaaatagcatactgggaggcttcatcacagaaaggatcgttccatcacaaaactccaccattccatgaacaagactttgaggatggatcaccgcctctatctctacagcttccagcccaaatagccagaaagcttctataatttctaagcctttatttactaaggtagaagaatctactgtaattttgggccccatattccaaacagggtgtcgcaagacctcttgtaaagagaccttttgtaattcttcttttgatttattccttaacggccctccagaagctgttaacaataattttttaatggtagaagagtctcttccttctaagcactggaaaagtgcgttatgttcactatcgatgggaagaatctgcacaccattctctctagccaaagtggtaaccaactctccagctgccactaacgactctttattagccaaagctattgtctttttctgtcggatagctgcaatgactgctggtaaagcatctataccagacgaagctacaatggttattgttacagaaggttctgtagcaacagaaactaacccctcttctcctaaaagaatctcaatatgagggaataacttacggagctccttgtaagttgtttcttcacgaacggctaccactcgaggattaaactctctaatctgagagatcaatgcttcttgattccgtccatacgcagcaagagtttctataataaaagtatcgggaatagaacgaactacttgtaaaacctgtctaccaatactccctgttgacccaatcagtgctaaatgcttcaaaagaacctcgtattctctacattgccttacttatcaagtttttgacggagcataatagcccttttagaacaaacgaacactaacataactacataaaacacaagtagtagaccgacagctaatcctgaagtagatagaccgattccgtaaaccgaaagaatggatctagaaagagccggggcaatcaaagctgccaaacctccaaaaaccatggaatacaccatcatctcttgaacagaagaggctatcaattttgcgatcaacccaggaatgagtagaaaagccaaagacatcaacacgccaaccgctttaaaagctccaacaatagaagctgagagcaaaagcataacgagatagtctacaagacggactcgaatacctaaagaaaaagcaaaaatcgtatcaaaagatacacaaacaaaacttgagaaaaagcagtacgaaatacccaagttaattaataaaactaaaaatatagggagaatatctgttttagtaaanatccgcattaccaatgacaagctcggtccctacatgcgcgttacgagtcaaaaacacaagcagtaataaactagctgaaaacaagagagaaaagactaaagctgtgcttgcttcttctgctaccttaaatacattccgaagaaaatgaatggatgctccggtcagtaaagttgttgagactgcagcgatagtcaatgcttgcatagataaatgaatgagctgatgagtaaataaacagacacagaccaacccaaacaatatagtatgggaaactacattcgcatacatagccatctttttaagcactaaaaaagtccctactacagaacaagaaactgctattgcaaagaacacgatcacctgaatgtcatcgatatacaaatgatcgtaaaacagcttcccagaaaaaagccgggaaaaaaagactagaaaaaactctaaaaatgatactccgtagtacggagaaatactagcaaccatccgacttccttgttcgttttggaatctctcgctgatgcggatcgtaatcaggatcttgcaacatctgcgacagagtagaatctaattcatctgtcaaaacatgctccatttcttccgcgaaatgatgtacttcgttcttattaaaacctaactgactcaccagataagattcccaaagtcgatgagcacgcactaatttagcagctctagctaatcctttatctgttaaagaccattgatgttccgaacaggagactaatccctttttacacagtaaaaacatcctaaatctgggaaataccttatcaccaaaatactcttggtactttctagaacgaacaaaatctctcacacctacttgataggtattttgttctcgtaaataccaaaagattttcaatagatgttcttcatctcgagaaaataagaaccattttccttcggaaatagcgagtgatccaccctgttttccatgaaaaaattaaacataagaaaactagcactcccgcgaagaaaacaacaagcggtcctgtaggaagaataatcgatataggcttcccttccactacagtctgacaagtgaaagctacggaaaaatagcatcctaaagccccgcaaatacccccaaaaatactcgatagaattaagattgtacttaatctatccgaaagctgtctggcagataaaggaggggcaacgaacatagcagaaatgagtagaattcctacagaacgcacaccactgactatgaccaacgaaataaatacgagaacaacgagttctgctgtacgcgttcttaatccacaggaatacgcaaattctctatcaaaaatagctacagaaatttgtctgtaccaccaccacaacactacagctgataaacaaaaaatgatcaatgcaagcttggcttctgtataccctaaagtcgccgcttggccgtacaaatatgcattaatcttgttgtataaaagagggcagcaatctttgacgtaactaacaagaatcacccctacgccaaaaaatgaaaccaaaactaaacataaagctgaatctttatgcatagctaatttcttttctaaaaatgagattcctaaacatcccaagacagaagctaggcaaccaaaaaagataataacccacaaagaatctgaaaatgcaggaactttataagaaagaagggcacctattaaaagccctggataacaagcatgagaaaggctctcacttaataagggctgtctctcaactaaaagaatagtcccccacaaggcagtcgtcatgcaaatcagcgaaactgccaaaaaactggatagaaagatagtgtcctgaaatatacaactcagcatctagcacgatccttggtacttgcctctagacaatttgagtgtgtaatccaaaagctcaagttcacacccataagcctgaaaaatggcttctttagtcaagcattcttctacgcttccagagcacacaagatgcttatttaataaaatcacatgatcaaaaagcttccggacattactcaaatcatgatgaatgaccacaatagtcttcccttcgcttttaagctcttgcaaaacatctacaaccatctgataagaggccatatcgatcgcagagaacagctcatccatgagatacaaatctgctttttgcattaatgaccgcgctaaaaaagctctctgttgttgtcctccagagagcttacctatttgacgatttgcaaaagcttccaaaccaacccgctctaaaatacgcatagcctcctgacgatcatcagtggaaatacgattccatattcctttatagccgtaacaccccatcaacacgagatcaagaacagtcattgggaaatcccaatccacactcgctctttgaggcatataggctattctatgatgtgccttggaaaatctctgaccaaagaacaagctttggccagaagaagcacgaatcagtcctaaagaagccttaagcaaagtacttttaccagctccattcggcccaataatagcagccagatcccctgcaggcagagaaaaagtaatgtgacataagacgtctgagtgatcataattaacacaaagatcctctacggaccaagcaattgcattatctctattcaagaacagtccctcccaattcttctgtaattgtgcgaacattgtgctggaacgtgctaaaatagttatcacagacattatcgctatataaaggagacttagcgagacgaatcttttgtccgctcttagagcaagaaacaatctttctcaaagcatcttgatttaacgtatcctctaaaaagacaacttctacatcgtttgcagagatatactccactacacgcataatatctcggatactaatctgagcctcaggagacaacccttctggagaaatgcaacgcgatctccattccccagacactctctccgcatcagaggatagataccgacgagtaaagtaactgaacgcattgtggcctgtgactaaatagcgatttttttcaggaatcgtagagagagaacgcactgcccaacgatcaagttcctccatctctgataagatctgatccgcattcttttgaaaatcttcttcatattgaggaaattgttgaattaatgccgcagccacctcttttacagcagcaccccatactctcatatccgtccaaatatgtgggtcagggaatccttcttcactcagaagatcaaaacagtttttgttaagcaaacgttgaccgaaatcaaagacttttgggttaccctctaaatgtttacgtaaactagctgaatgctctaaacctaaaccattgcaaaaaatcagctggctcatagccattcggtcttcatcccccttcaccatctcatatgaatgaggatcaatcgctccatcaatcagaacaatattcttgactcgatccccagttatgcgagacacgcaatcacaaatcatgcgattcatagacaagacatagatgctctcatcagcgggttgatttcctcgactagaggaacagctgttcattaagaaacagcctgctaaacacaagagtcctctgaggataagcttatattttctagtatgaaaaaaagacataagagcctccagataatcgatacggggaccatactttgaaaaagtatacgatcccctcaaggacaaaaaccaaccgatatttctactatcggcgctagacccggcctatcgccacatggggtcataagaaaaactctattttaaaggatacaagcctcctgtaaggagctccccctccacaaaaagaacctcgcttatcgcgaagatacttttaacaggatgaatttatattctcaaccgaaaggaaaatctagcgcgtttctcatctcgaagagacaattctaaataattttaacaactaagaaaaatgcatactaatacgtgttttctaagcaaacaactataaagagtctgaagaaaagtaaaattgttccaaacagatttctgctactaacctgcataaaaatgatggctgtttatgcaaacaaacttagaaaacaatctgaagtacttcattttcttttgtccaaatcaaaaaatctctaaaatgagattgcgaaaaaagcaaaaaccactatagaattcaccaaaagataaacactaattgatttttatttcgactgaacattaaatcgaaaaaaacagacttagttgactattacaattaataaagcaaaaactaccatctgtagaactagactacccactaaggagctattcatggctacggcacagattactatccaagaagaaatagagcagctcataactaaagcgattagcaaagtcggaggaagtaaagaaaatgatctttgtcgttatctcccagggccaacaggcggctacatgcaccattttactttaaaaaaaatgaagaactctgctcctgagcaactgcttaaaaatgttaaagacgtttgtgatcgattctatcactcccagatccattagccctaaaccacgagctcctcgaggttctaaaaagcgcagaagactttgtgaatttcacaaaaaccgatatcgaacgggtgttagagttagctcgtcaagttggcgataaagatcttttggctcgcttcagccccaaaaaacctcttccatcactaaaaagagaattaattcgctctatcccgcaataatattgtaagtacggagctttggaatgcttacgttgaagctctttctcaacctacagaataagttttgtaaagtctttttttaattttttaataaaagcttttttttctcagaggctcattctcagtggacccttctgcttgttcagcatacagcccttttctattgccttccgagacctttggtggtatactcttttcctaaaggttggattnctgccattttttattccgccctcctgggctccttgagtggagggcatctcctcctcacgtaatcgaagattcagccgaaaatgggagtcgtgaaatcaaaattttttcacgactttttaaagaaatactttaaatcttcgttgatttgatcaacaaagaaaacttaacaataaacataagcttttcagagggtgaaatatgactcaaaccgcggaaaaaccttttggaaaattgcgctctttcctttggccgatacacatgcatgagctgaagaaagttctgccaatgttcctaatgttcttctgtatttcattcaattacacgattttgagagatacaaaagatactcttatcgttacagcaccgggatctggagcagaggccattcctttcattaagttgtggctagtcgtcccttctgctgttgtgttcatgctgatctacgccaagctaagcaatattttgaacaaacaggctcttttcttcgcagtgctctcaccattcgttgtattcttcgcactgttccctgtggtgatctacccttgccgtcatattcttcacccaacagctttcgctgatactctacaatccattcttccttccggatttatgggattcattgcgatgctacgcaactggacatttgctgtgttctacgtgctttctgaactttggggaagcgttatgctctctttgatgttctggggctttgccaatgaaattactaaaattagcgaagctaaacgtttctacgctcttttcggagtaggagctaacgtagctctcttaatttctggtccagctattatctggtcttctaaattacgtgctagccttggcgaaggcgttgacccatggggagtcagcctctatttcctaatggctatgttcttgtgttcttgcgctattattgctgcttgctactggtggatgaaccgctacgtgcttacagatcctagattctacaatcctgcagagctcaaagctaagaaatctaaacctaagatgagcatgggcgaaagcttctcttatctgttaagatctccttatatgcttcttctagctcttctagttatttgctacggaatctgcattaacctcgttgaagtaacttggaaaagccaactcaaaatgcaattccctaatccaaatgactacagcgcatttatggggaacttctctttctggacaggagttgtatctgtatttgtaatgctcttcatcggtggtaacgttatccgtagattcggttggttaactggagctttggttacacctatcatggttctcgtaacaggagctgtcttctttgctctcgttatcttcagagatcatgctacaggtttagttgctgctttgggaacaacaccactaatgctagccgttgttgtcggagccattcaaaatattctttccaaatcaactaaatatgctctctttgatgcaactaaagagctggcttacatcccattggatcaagagcaaaaagttaaagggaaagctgctattgacgttgttgccgctagattcggtaaatctgggggatctttgatccaacaaggtctcttggtcgtttgcggaagcatcggcgctatgactccattcctagctgttgctctctttgcaattatcatggtctggttgacatctgcaactaaactaaacaaactgttcttggctgcatccgctgctaaagaacaggaattagnagaagctgcagcagcagagaaggaagcttcttctgcggctaaagaatccgctcctgctatagaaggtgtttcttaataagactttctaaaaattctctaaaaagaagccccgttctatctcggacggggcttttcttttgtgttcaaaaatcccctcgccttttttataaactcttctagatctagattacttttctctagatagacaactcacaattccgttaacatgtccttttcgaagcaaaaactcggttaaaaacattgaaaccgtataaaattgagaacattcgtaatttttctatcattgctcatatcgaccacgggaaatctacgatcgcagatcgtttgttagaaagtactagtactatcgaacaaagagagatgcgcgaacaacttttagattctatggatctagaaagagaacgcgggattaccatcaaagcgcatccggtcactatgacctatgaatacgaaggggagacttacgaactcaatctaatagatacccctggacacgtagatttctcttatgaagtatcccgatcactagcagcttgtgaaggagcgctgcttatagtagatgctgcccaaggtgttcaagctcaaagcttagctaatgtatatctggctctagaacgagatttagaaatcattcctgttttaaataaaatagacttacctgctgctcaaccagaagctataaaaaaacaaatcgaagagttcatcggattagatacttcaaacaccattgcttgctcagcgaaaacaggtcaaggtatccctgaaattttagagtctattatacgactcgttcccccaccaaaacctccacaggaaacagaacttaaagctttgatctttgattctcactacgatccttatgtaggaatcatggtttatgtacgcgtgatcagtggagaaatcaaaaagggagatcgcattaccttcatggcaaccaaaggctcctcttttgaggtcttaggaataggagctttcttaccggaagctactctcatggaaggatccttacgagccggacaagtgggatacttcattgccaacctaaaaaaagtaaaggatgtaaaaattggcgatacagtcactactgttaaacatcctgctaaagagcctttagaaggctttaaagaaatcaaacctgtagtgtttgctggtatctatcctatagattcttctgactttgataccctgaaagatgctctaggccggttgcagctaaacgactcagctcttacgattgaacaagagagcagtcactctctcggatttgggttccgctgtggatttttaggactgctgcacttagaaatcatctttgagagaatctctagagaatttgatctcgatattattgctacagctcctagcgttatctacaaagtcgtcttaaaaaatggcaaaaccctttttatttgataacccaacagcatatcctgacccagctcttattgaacacatggaagagccttgggtccattgttaatatcattacgcctcaagagtatctcagcaatattatgagcctttgtatggataagcgtgggatctgtctaaaaacagatatgcttgaccaacacagactggtgctttcatatgagctgcctctcaatgagattgtttctgatttcaatgataaactcaaatctgtgacgaaaggatacggctcctttgattaccggttaggagattataaaaagggtgctatcattaagctggaaattctaattaatgatgaggctgttgatgccttttcctgccttgtacacagagacaaagcagaatcaaaaggcagaagcatctgcgagaaactcgtagatgttatccctcctcagctttttaaaatccctattcaggcggccatcaataaaaagattattgccagagagacgattcgagctttagcgaaaaatgtaactgctaagtgctatggtggagatatcacaagaaaacgcaagttgtgggacaaacagaaaaaagggaagaaacgaatgaaagaattcggaaaagtatccattccgaacacggcgtttgttgaagtccttaaaatggagtagactacttctagctatattgcttcataaaaaagacccagtagtttactgggccttcttgttttatgctctaaaagttttcttggtttctagccaatccgtatgataaaactcccctcgaggacagtctcgacgctcataaccatgagctccaaagtaatctcttaatccttgcactaagaataaaggtgaatccaccgtacgatatccatcataaaaagatagtgcagaagataagcaaggaatagctacaccagatccgatagcatgcaaaacagctcgccggaaacctgtttctgaatcaaacagaacctttttaaaataatcttgtaatatcaaagagtgtgcttctggactattttcaaaaccttgatgaattttatctaaaaaggcactttgtataatgcaacccccacgccatatcaaagctaactcacctaaattcagatcccatcctttatcttgagagacctgcttcagcagcataaatccttgagcgtaactgataatcttagctgcatacaaagcctctcgcacatcctcaaatcaaggcagaagcttcttgtggaggttgacagngaagaggaatcctggaaactcttgagctgcctttgtgcgcacttctttccaagtcgaaaggtatcgagctaagaccgattcaataattagggacataggaacgcctgccttaatagcgtcctctgcgacccaacgcccagtccccttctgtccagcaacatcaagaatcgtagaagcaatcgcattgccattctcatcttttgctattaaaacggccgctgctgctccaaggaggtagctattcagatcggtttgattccattcaaaaaagatattccctatctgctctaaagagagattaagtcgagtcttaagaatctcatatgtttcacaaattaactggatatccccgtattcgatcccattgtgaacagccttaacaaaatgccctgcacctcctgtgccaatccaagagcaacagggtcgtccacccacctgagcagctatggattgaaagataggagcgattgcaggccaagcatctatattccctccgggcataatggaaggcccttttctagccccctcttcccctccagagactcccatcccaacaaatagaattccttcttttttcaggtcgacatagcgtcgctcagaatctaaataatagctattccccccatcaatgagaatatctccctcttccaagaaaggaagcagggaggcaatcatttcatcaacaggagctcccgctttaatcatgatcatgatcttacgaggacgcttcaaagattgaacaaactcttgaatcgtagtaaatccttgcagagctccactctctccatgatctttcaagaactcttctgttttcgccggacttcggttatagacagaaacagaaaaaccatgatccaccatgttcaatacaaggtttttgcccatcacggccaaaccaatcaacccaatatctgtatttggagccacagacccctcctaatttaagatctatcacttgttttttccttttcccttgggacaacaaaacataacgatcgaaacacaactgagtcccgtctaatatactctgttcatcggccaaaggctcctgattgatgtacagacctcgctgttgaatgagtcttctagcttgtcctcttgaggaacaaaagcctagttccacaacgatatctaaccagcgtttccctattaaatctgctcgagctactttaacgccaacacctgactctactaacgctactagttctgcttctgtaatactctttcccttactagcaaaaaagctttcggttgcggcttgagcctgagctaatccttcagaaccatgaacatctttaacgatcacttccgcaatgtatntcttcacagcttgtggatcactagtcaaacgctcatcaagagcaaaaacttcttcgttatccaaaagagtaagagttctcattactttggagatttcttgatctggcaagcgtaggaaatattggaatagttcataaggaggagttaacgctggatccagccagatagttccagactccgtcttccctattttcttccctttgctatcagtgagcaaaggataggttagaccataagcctgccctagtcctcttcgacggatataatcaatccccgaagtaatattcccccactgatcactccctccacactgtaatacaacattatgctctttaaagagatgtgcaaaatcataagactgcagcaataaataactgaactcagtgtagctaattccctcttcagaatagactcgctgcttcactacgtctttagctaacatagaacctaaacggaaatgcttcccaacatctcttaaaaaatccaccatacttaaagatcctagccaatccgcattattcacaatacggataccaggaagatagctagcaagagcagccgctattttcttactattatcaagcacctgtgcctgatctagtaatgaacgctccacacttttaccagaaggatctccgatcattccggtagctccgccaacaagagcaacaggagtgattccatatgctgctaatcgacgcaaaaaacaaattccaatccaatgtcctatgtgtaaagaaggcgcagttggatcgaaccctaaataggcagaaacaggaactgttaaactttctaatcctgcggaagaattatctagaataccccgtttcttaaggttatcgattaactgttgcataaaaatctatccatataaacttatctagcaacatcttatctatcctgttctttttatagcaaggcaagcgatagcagacacctcgtcaaaaaaacgacgcgcttctctaatagaatattgataggaaaaatacagagaggatcttctggagacagttactaaagcagactggacaatgtacctcgtaacttcaataaagctttggagtgtatctgagaaactcgggactcgctcactcctaaaatcttcccaatttcttttaataccaagtcatcatagtaataaagagccataacctgccgctctttttcatcaagagccagcaaagcttctgtcaaaatagaaatagcttctttttttctgatgacatcgtatccggtttccgctcgctcatctgctatgcgctcttctaaagcaagcccctcatcgtcatcttggcaggagaaatcatcatttaaagaaagaactagagcaggtctagaggaggaaaaccaatgggataactcttgttgtgaaatatttagatactcacaaagttctccatcagtaggttctttacctaaagtctgtctcaaagaatccatcgcatcagctaatcgattggctctttgataaacactgcgtggtacccaatcctgtttgcgcaatccatcaataatcgcagcttttatgataaaaagagcatagctctcgaatcgcttgcttttttctggatcaaaacgttcgacagcacgaatcaacccttcaacccccagagcataaagatcttccatctttacatgagaaggcattcctgaagcaagccgatgcgctacattctttactaaaggaaggtaggattcgatcaaaacatccctatgatggatttcttttgtcgaccaatatagctgccaagtatctgcgagatcgtgagtcttcacaaaaaaaatttcttttacaaactaaaaaataaggctaaatcaaataaaatttttaaacaatatctacccttacacaactaacacataactcctaatcaataactcttttatgataataaaacctcatcagacaccgctcctaacaaagttatagggatctcttctggaagttcgctatgtgctaaaaccaataaatctgggaaataaggatccactatgcgtttcagttcttttcttgtttcggatcccgttacgatagctcgaaaattcccctcccctacccgcaataaatgcttcacctgagcaactactttttcatttaaatccaacacaaccttttcttgtgaatctctcacaaactgctcaaccagagagtctatcgtaattacctctaagacatcttggcgattccataaggataaaccaatttgcttcccaagatattttcgtacacactctaccaattcctgagaattctttgatttgagagccatatacatctatagcttcgagaatcttagggaataaatgcaaagacactcgttctctaacaagagctctcaataagaaaatcaaagaattctctgatatttttaacggaaggatctcttctatcgataagaatgcatgctctcgaaactcatcaactaagtgagcaacgaagcgttcactgatcgtttctggagctagctgcctaatcgattctagtatagctgggcaagacagctctctcaaagcgacctcttgcccagaaaagattaaacgtggagaagatcctgttacataacgtacaacaatagcttccgggaaaactacgcctaactcttgataaatctgattgcgggcgtccttgtacaaattagcaggatttcccactccctcatcaggcaatacaaactctacccgttctttctggaagagaagagtctctcctgaagaaggattcttataccctaagaataataaaactgaaaaacctaggatcagagctttaggagctcctggaatacaagccatcccacataggatcaaagcgataaaaagaaaactctggcgactctgctcataataatctagcagatgctgcgctagactttctttttccccaactttagctataagcgttgctgctgcacacgatgtaagcaatgctggaatttgactcactaaagcatcgcctaatacagttaaccacaaatcgccaacatgagtagctcgtcctaaaaatagagcagctaggatattcactcctaacaacacccaactcattatcgcatcgccttttacaaagcggaatacgccctccatggcggagaaataatcactctcttctaaaagagagctttttttaacagacgctctgctatacccgatccttccagcagcaatatcagcatctaatgacatttgtttacctgggagcgcttctaatgaaaaacgagctcgcacttccgcaatacgctccgctcctttagttatgacgagaaaattcactaaaaacaggagtaaacataccgtaagagccaaccgggatgctcccaagggaaaagaaattccctaacgcaaaaattaaaggagaagcccatccagaagataaaatccatcgggtggaggctaaattcaggccaagtcgcaatagacaaagatacaaaaggagcgaagggaaaatacgagccgaagctgaagagcgtaaagaaaacacccaaaaaatgatcgacaaggagcacgctaaatttgtacataccccaaaatcaatcagccatctaggcaaatggaatatcaaagtaaacagtatacaactggggattgctacaattttccatgaacttcctctaaagttattcacaacagccacccgattccacaccgaacgaatacccagcaaaaacatatatctgcaagaagaagttcgaagaatattttgcatttatagtatctttcccttgtctagtatataggcaatatgctaacttccttagctcctacttttttaaatcggagtatagcgcagcctggttagcgcggttgctttgggagcaataggtcgggggttcgaatccctctactccgattcttaactaatcttttctttttccttctggagtcctatggctaagctcatcatttcagcagatgacgagaatcaagagtttcatttagaagacggttcctctatagcagaggtttgcgaacattctggcgtgcctttcgcttgtatggaaggagtttgtgggacttgcgtgattgaggtcttggaaggcgcggataacctatctgacttttctgaggctgagtatgattttttaggtgatcctgaagattctaatgaacgcttggcttgtcaaatgctgcattaaaggtggctgcgttaagataactttctagcctccggacacttgcattcttgcgcaaaacggtgtgttgtcctaagcccttgggacaaaattttaaaagttaagagtttatgtttacatcgctgtccgcgatacagaatgctatacgtccttcttgtcaacttcctgttttgactcctagacgcgctctcattacttctcttgcgtctggaatcattttaggacttgctggttgcgtggttggcgttttagcctcccttcctgccctaatcgccgtttctgctgttattttaggtgtcagtctttttgcttcaggactatttctctgtcgatatgtttgtcccccaaaaattgtgtcccgaagaccttctaccgaactccctgctgaacctactcccgagctgcctgaaatcaaaagacctaaacctatagctcctcctcctccagatttcatacctccaaaaccactgagaagaacgatcggtgaaatgctttttggatggaactgcatagaatcgataagacagatgccgtttttccttgctaatgacaaaacgcctctgttcttcagaaacccttcagcaagatttagagcctggaatattcctttcactcatactatttttgtctctacttcaggccaattttcttctttgagaatgcaatcgaatctacctgctgcgattgcaaatgccacacaatcggcagccttcgcgaagagaggccaaggaggattaggagtgaacgatgcattccctgctgtgcttaccgacaagtgctgggaagaatcgaaacccgagtcagggatcctacttccaggagaatgctcttctgccacctgggaagacaaaaatcatctagtgccttgctgggatgaggaaacaaagacctataacaagcctctattgttcatccaaatgctagctcctaaagcttctatgtctaaatcttgctatgagataaccttacgagcttacacagcttgtttcgaagaggctattcgttgtggttgtcgtatgatccaaattcctttaatcgcttctttcggagattttgttccaagagcgctaagcaaacggccaaaatggatcgagtctgctaaactagccttactccatgccgtagaaaaaaccgcgaaaaaacacgcatccaaagatctagtgattgttttaacgaacatccctcaacccgtgaatttataaacaatttttaaagggaggtttctccatggagaccttcctttaaattgatctaaagcttatacttcctcagccccccaaaaccttcaggagaaagagattcggccggtactgtcccagccaatttcaaaaattgtttgtaggacacctcgtcatggcaacaccctgtatacaaaatgcgtttcgacgcaaaaccctcccagtaagaatcggagatctttttgttggtagtgagcactccatcaaaatccaatctatgacgactacagccaccacagatgtggatggaacggttagacaaatttgtgctctgcaagagttgggttgcgacatcgttcgtgttacggtacaaggtttgcgagaggttcatgcatgcgagcacattaaagaccgcttgattcaacagaacatttccatccctcttgtagcagatatccatttctttcctcaggcagccatacatgttgtggattgtgtagataaagtgcgtatcaatccaggaaactatgtagataagcgtaatatgtttactgggaaaatttactctgatgagcaatacgcgcatagcttagagcatttgatgaacaagttctctccacttgtggaaaaatgcaaacgcttaggcaaagctatgcgcataggcgttaaccacggctccttatcagaacgcgtaacgcaacgttatggaaatacgattgaaggcatggtgtactctgcattggaatatgccgaagtctgtgtcgctatggactatcatgatgtcatcttctcaatgaaatccagtaatccaaaagttatggtggcagcgtatcgatctttagcttatgagctagaccaacgagaatggtcttatcctctgcacttaggagttacagaagcaggatctggcactgcaggcattgtaaaatctgcagtaggaataggtacgcttctttcagagggattgggtgataccatccgctgctctctaaccggtagccccatcaatgagatccctatttgtatcgatcttctcaaacagacaacagaactctccgaaagatggggagaagccgacaatccatttgccatccattcttcaaaacaactgggtactcgaaacactttgaatacccctccttgggacaatgtctatggactgttaattaacttaaccgatgtacagctactgacggcagagcctatagaacttcttcagtgcttaggcattgacacaaccacagggaaaatagatcctacaaccccggaaggagtcgttgtccccaaagctatgcgctcctctcctatcgtttctgaaatagagaagcatcttcttgtctttaataaagaagatgctcctatccttaatccgatgaatgaggaggaatggctctctgaagagactctttctgctccatttgtctattttgaagtaaccgatatccatactgctcgtcgctttttttctctgcgacaacattctacacaacctgtgtgtttaagcttttctttagatcctcacctttctaaaaatgaagccattatcgacttgtctgctcggttgggagctttacttctagacgggttaggatcttgcgtactactagattttgtagatattaaactctctagaactctgggttttttgattttacaaagtgctaatattcggtccgtaacagtggaatatgtctcttgccctggatgtggccgaacgcttttcgaccttctcgcagtttctcaacgcattcgtgaaagaacgaaacatcttccaggaggtttaaaaattgctgtgatgggatgtatcgtcaatggcccaggagaaatggctgacgccgattttggctacgtaggatcaaaaccaggtatgattgacctatacgtcaaacataaatgtgtaaaatcatgcattcccatagaaaatgctgaagaagaattggtccaattgttaaaagaacatggcgtatggaaagagccagaataggatccctgatgacactcccttccgaagctttacgtaaacagacatttcctgagttagaataccttcctattcgccatggtattttcccaaaacaagatgataaggaagaagcgagtcaagtttctgatgaggtcatttcctcttccttaggaggcaacgatttttgtaacgctcgtcaggtgcatggaacgagcgtacgttatgtcacccccaaaactcccaagagagcgcctgccgatgggttattcacaacgactcctcttctctccctacacatttaccatgcagattgccaagcagccattttctatgacccagaaaaccatgtgattgctaatgtacacgcaggatggagaggtcttgtaggcaatatctatgctgtcactgttcgcctgctgaaaaagacattcaacactcgtcctcaagatcttatcgtggctatatctccctctctaggtcctgatatggctgtctatccagattataagagactgttcccttctagttttttccctttaatgcctaaagaaaatcacctcgatttccgagcagtagcaagaaaacaactgctctccgaaggactatccagtaatcatattttcatctcagaacgctgcacttgttctgaatctaatacctttttctcgttcagaagctggaaatctcgccaccagcaggatccgtcagcgattcgttctcgaaaaaataatgtcactgcagttcttcttcttcctagataacgagtaatgcagcctctctctgacgcttctacatttttagcaaaagctcgggttgttctaattgctctttaacattcacaaggaatcctacggcttcctttccgtctataatccgatgatcatagctcatagctacatacatcatatcggctatcacaattgcatcttctctaaccacagggcgtttctctatcttgtgcatcccaagaatacctacctgtggaggattgataatgggagtggatagaagagaaccatatacccctccattggtaatagtgaagcctcccccttctaactcatgaatagcaagtttgccttcccgagcacgagaagctaaatcggcaagctgtaactcaatctccccgctagataactgatcacaattacgaattacaggaactactaatccacgatctgtccctatggcaatggaaatatcgtagtaatgtctgtaaacgatttcgttatcttcaatataagcattcacccgaggatattttttcaaagaatctacaacggctctaacaaagaaagacatgaaccccagttttaccccatacttcgcaacgaaatcttcttgtctttccttacgcagagcaataagcggccccatatggatttcattaaatgtcgttaacattgctgaatcatgtagagattgcaccaatctacgagaaatcgtcttccgaatagcactcatagattctcgagattctctatgatcagaagaagctggttggatctcctttaatggaacaaaagttttcccttctgcaggaggatcctgtctcactgatgaagggaaggcaataatctgcgcatcgctttcctgctctacaagactaaatggcatctgctcatggataggtgcggtatcttgactcttttccgcttcactaataatccctacaacactaccaacagcgaccgtatcccctacggaaacgctccactctacccttcctgagcaaggagcgtaaatgagctgattcaccttgtcactctctatctccagaatcccttgattctcctgcaccaaatctcctgatggaatcaaaagtgcagaaatcgtcacttcactaatagattctgcgatattgggaatacgaacctctatactcatgctctactctctacctatagaaaacagggtttccattaacatcgataattctttttgacttaaactcgcagatcctgttgccgttgaactactcctaggacggcaaacgcactgcaatttgctagggaaaatctcgtcagttgctaatgcaaaataactaaaagcgcccatattttgaggttcttcttgcaaccatacataatggtgaacttccgtatatttgcttatcagaaccaatagatcttctaagtataatggatacaaactctctactcgtatacaagcaaaacgacattcaagatctttaggaagagaagcacgatagtcgtaataaatcttgccactacaaagaacaagaacttttgcatgatagttaggattctcgtcttccaagaaaggcttgaagcctcccttcattccaaactctgcgatagaactcacgcactgcggatgccgcaataacatcttaggagaaaaaatgataagaggaagagagaggtctctcttcgtatgctcccgcagaatacgaaaatactgtacgggagtagaaggaagaacaacttgaaaattccaatcggaagcgagctgtaaataacgctctatacgagccgaggaatgctcaggtccttgcccctcatagccatgaggaagcagtacaactacatcggaatgtaaatcccatttctgaattccggaagaaatatattggtcaaaaatgatttgggctccattggaaaagtctccaaactgcgcttcccaaataacaagagtcttttctgcttgttgtgcataaccatattcaaagcctaaaacagcgtattcagatagaggggaattgtataattccacgctgccttgactcggagacaagtgatataatggagagaatgtatcccctgtctggacatccgtccagactaactgtcgttgactgaaagttccacgaatagaatcttgtcctgacaaacgtaatgaaaaaccttcttgtaataaggaagcgaacgccacctcttcagccattccccaatcataaccgatctctccatcagccatgctcatacgcttatttaataaagatcgaatctttgcatgaggagaaaaatgctcaggaatatcacaaagtttggcactcagatcaaacaaggcttctttgtctaacgatgtatccacattatcgacaagaagctctccagctgccatacgagtgcaatgcatacattcatctagccgttcgacacctggatctttcagagaagcgtactcctggtttaaaacatgcgctatctctgtgtctattctctccaactcgttggaagaaatgttccattcaggatggtgtaaaaggatctctttgaataattctgacccttgttttttctttttgatctcttcgtataaaaatggagctgtaacagaaggatcgtcactttcattgtgaccgtattttcgataacaacagaggtcgataatcacatcacaatgaaaacgctcacggatatgtatagcatactccatgacctggagacaggctaaaacatcctctccattcactcggaatacagggatccccatcattttagctatatctgtacaataaggagtagaacgagactctcgaggctgcgcagtgaaacctatctgattattcactacaatatgcacagttccttctgttgaataacctggtatcccactcaactggaaagtttcatatacaacgccctgacccgccaaggctgcatctccatgcatcaacacagctaagcaggcttgctccttcccagcctctccctgatgttgaatcgctgctacagcaccttccacaacaggatccacggactctaaatggctcggattcggcaataaagccatcataacgttctgttccggcctattggcaacatatcccttgtggtactttacatcaccaacagtttccagccctcttatttggggagcgtcttcaaactccatgaaaatctgccggtaaggctttccaaaaatgttagcaagaacgtttaatcggcctcgatgaggcattcccatcacgtaacgattgatgccttgcttaaccccacaagcaatgagatgctccaacatgggaaccaagctctctccaccttctagagaaaagcgcttttttcctgtgaatttaacctgtaaaaattcttcaaaagctactgctctttttacgtctcgatatcgcgccagaagaacttctttagttaaagagggcttctctccttccatgagtttccagacatattcttggatctcaggagagcaattcaatgtctcaacagagatgctccgacaatacttctcttttaatacctgaataaagtctgctatacgaacataagattgcggtaataatcctaaagaaggaatctcttcttgaggatcgaaattacgaaccttttctgtaactagagaagattcttctgatgaggatattggagacacttgcccctgtaaatagccgtaataacggtatatcatcaaaagactgtgtgcttttttctcttgcaaagacgtaaagaattgatcatgagaagattctgttgggctcccctccgtcttcccaacttgataaccttcaaagaaatatttccatgaagaatccatcggctcatgcttctcaaatcgctcgaacaaagattctatccagtcaatatctgatgaatgcacatgcctagcaaagtctgaatccataagacgaatctatcgattgaaggtgatacttttagaaaattcccatatcaaaatttttatttttcaaaaaaagcaaactttgctttttttttaagtatcgaataccctagcctcctgacttcttacaagagctagcagagcttggcttatcagttgaacaaatactttggaatgagtattttactagccaaaatctctcctgatctatttgtttatgcctgctcactttttgctctatctgagcaaaagatgcagttacccttggtaggaagcaagtaaattggctctcagggggtttccggtttcaatcatagaacaggactatttacgaatgaaaagtgagcgtttaaaaaaattagaatcagagcttcatgatcttacccagtggatgcaacttggccttgttcctaaaaaagaaatcgagagacaccaggaagaaatccgtctgctagaaagcaaaatccttgaagagaaagaacgtctacaacttctcaaagaaagcggtgagatcaaagagtacgtaacccctcgaagaactccagctaaaaccatttacccagatggccccagcgtttcagacgttgagtttgtagaatcctcggatacagaagtggatctcgatgccggtgacacaattgagattgacctaggtgatgaggcaagagaagaaagcggaaacgaactcgactactctagtgaagacgatgaggatcctttcagcgatcgcaatcgttggcgccgaggaggcatcatagatcctgacgcgaatgaatggtaagactcccttagctctttacatacatatccctttctgctcgaagaaatgtcattattgtagtttctatacgatcccgtataaagaagagttaatgcgctcttattgtgaagctgtcattaaagaggggctaaaaaaactagcccctctacgttgttctcactatattgatacagtattctttggaggagggactccttctttagttccccctgctttgattcaagatattctcgtagctctagaagctcagcatgccacagaaatcactcttgaagcaaaccctgaaaatctttctctggagtatatccaggctctcgccttgacctcgatcaatcgcattagcattggcgtacaaacattcaatgatcccctacttaagctactaggacgcacacactcttcatctaaagcgattgaagcctttatgctctgctcccaatacggattttctaatgtgtctgcagaccttatttatggcctccctacacagtcgattagtgattttattgttgatcttcgccaagctatttctctcccaatccaacacatctctatttataatctaactatagaccctcacacctccttttacaaacaccgtaaacgtattcttccatccatagcagatgacgactccctagctgagatggcactagcagccgaagagctgctagagaatcaaggatttactcgctatgaacttgcttcctatgcaaaaaaccaagcggcttctaaacacaatacctactactggacagctaagcctttcttaggattaggagtttctgcctcacaatatctccatggcattcgatccaaaaacctttctaggatctcgcattacttacgactgcgcatcaacatctaccgactttagagtctatggaagagctccctccaaacgaacgcattaaagagactctagctttgcgcctccgtctctgcgaccccatcccctttggagttttccctcaggaactcgtagacgaaatattaatgcacccgtctataggttctctatttactaaggatgacaaagctttttcattaaataaaaaagggcgtctttttcatgattctatagcagaagaaatcatggcttcttctttttcattttaaaaataaaaaattaatcgatattaaaaccaataaaaaatcgattaatttttaattgaaaaaatgaataaaaaagaacgaattaataaaaaaaacgcatctacgaaaatccaacgaaatacacccactagagctttactgagtattggttcacaacagctctcttcattcactaagctgagttttaataacgaagctaagttaagcggagtagctactccgactcgtgatacggatgttgtgccactacaataccttcaagcacgctatctatctaaaaatgacccaaatccagattatcttcccattcatggaggaagcatgactgggaacattaatatgggaacacattccgtatttaatttgaagcaacccaccaaaccatccgcaactcttccagaagaatcctctaaaccaaaagatcctcgagaagaagagggttttacaaaaaaaacagccgagaaacaagaacaagcgatcaaagagtacaacacaaagctggcagaataccagaaaaaaatcgatgattacaatgcagcatgggaagctttttactcagaagcagctactgtgaaatatgtcaaaggtattgttgataagattttgaataataacaaactaagcacagctctaaattctgctactgaagtagaaaaaaaaatcgcattggctcaaaaagctctcggaattgaaattacgatcaaccccgacgctgataccgatcctgtaccagaaacacctaaacctactcctaccacagatacagaagaaaaggaatctcctcctttatcttatgacgatctcccttcagtaattaagaatgctcagtttgtggtgacacaatctcagaataagcttacaggggatctcaagatgaccaacgcacagatcgccaatatcaaaactccggatactggtgacagtaattatgcagccaatgtaacctacctggagtccaaactcaaacaacctaagagagcttttctttccaatactcttccaactacgacaagttctccaacaatctcattcaatggatacatcccatggctcagcacaacaaacggatcttcctctcctacagaacctgattttaagagtgaactagccgacaaatgctttacagcagaacaagaaaatctaaaagtaaaaacggcaggcctactggttttatctgtaagagggacgtggagtcctacaactgccacaatagctgatggaagtacacaaacacccaagaccatatccgtgaacctaacagtcactccagacaattctagtggaaccaatacccctagtagcggatcagactcttctggagacgcttcagcaactacacttactatccctctgacactatactctagggaatctgtacaactacaacttcctattaagaccgcatccgacataaaaatggatacctcctcccaaacttctaatggaggaagtggttcagtatcatcttcagcaaccgaaacgctcactatccctctgacactatactctggggaatctgtacaactacaacttcctattacgactacatctagtgtaaaaatggctacaactacctcccaaacttctaatggaggaggtgatacctcatcacaaataacactatcatcttggtcttgggaagcagctctatatccaacggatgttaccgtaaccaataaaacaactcctccaacaacaaaaacaccttcgtctccatcacctaattcaaaaatgattaaaaataagatagtatagagatttacgaagttaaagatttaaaaaacgaaataatgaacgatataaaaaataatatttcttcttccttttggaaccctaataaagtagtgacaaaagtcttattaaaggttagtgagacaggcattgagtctactcctggcattgttaaacataaccaacccatcacacaatcagagaatcctaaagatcccacagatgcagtcacattcaaatatctaaaagaaaactacaccaaagaaaatgaccctaatcctggtttcttacccacaaaagggggcacaatgactggggacattgacatgcagggaaacaatgtcaccgacattgtgatgtacaagcaaaacggtcaacaagatcctgatgatggctctgctgtcactatcggttatttgaatgagaaagcagatgaaatcaaaagtaatgacaaaattacacgggtgtcgcaggcctatcggatattaactcacaaatatccacgttacaccaacttctcggtattgctgaagatcctgacactgtcactaacccagatcttctgaaaacaagtggagggactgtttacgaaaatattgatatgaacagtaataccgtatctgatctaggaactcccacaaataaagataccaaaagtgctatcaatgtagagtttgtacaagccaaaatcacctctccacaaatggcttttctaaaaaacaacgatacaaacctttccaatatcaccgtttctgaatattttaactggctacaagctcctaccccaaatcctgcaccaactactccagacaacagcaacacaccgaacaatccaccatcctcttcaaacggagcctcctcatttattagagagctagctgccactactactggttcaactgataccgaaataaccccggctgccgagggcactgatctcccaaacactacattctcggaaaaatctcctttatgggaggaattcttttcctatccagactcttcacgatcagaaatggtaattcaaaaaacgggtattcttaccttttccatgcaaggaacctggaaccatccaaacaacacaactccaacatctacagatcctatttctctagagctaaccgtaacccctccaaaaacagacacaactcctaaatctccatcatcctctccaaagaaaacaacttcagaagcaacgtcatctcctgcaactaacggtccgacaactgcatctataacgaaaactttctcaaggaagtataacctatccgcaactccatcacccactcctactacccctacaacacctgatcctattactaaaaaattctcgctcgcttcaggacaatcttgcacactacaaatacccgtgcaagcaactggatctgtattaaaactgaaatacgttaatccaaataataacagctcgggaggaagttctggatctggaggagactcacaagaagaaaatcctacgtcatcatccggtaccaataatgctccagccagccagacaagcagaatacagattcggtatgcatcaaccacaactacagattcaggatcgacaacaaaaaatccaataaaggctcaagccgatgaaagcaccccaccagaaacaacatctacaggtattactttgacatctttttcctggtctttggtattaacttcaggagaaattactaaggcaaaatccacgccttcgacaccatcacagccttaaagatcacatcgattcagtataaaatgttaagggagattctctcccttaactcaaatagttaataaccagcgcccatatatgagatagctacataactcttagaagctgtagctgaagtaggactcacctctgtatttttaccaggagttaatgccaaagttagcgtatgttttgaaagcgctttgtcccctgggactaaaatgtatgcactcccaactacagttttcccatccgaagagcctaccacggaaaatgctggtgaaggctctggatcagttggggctgtagcatccccactcgtaggctgagctgccacatctcctccagcagatgttgaatcagatttctttctgagagtccctgtacaggtaacagctccattttgtattggagaaccaaactcgtacgcaaaggtgataagataaagacctcttcgcaaaagcgaataagtcccgttatcctttttgatataattgtctgcattactagacttaagaggattctgtacacttagtgaacctgaaccagaatccggggattgctccaccaaataaggcacctcttgtcccgtccactctgggaaggtcgatgcagtggttgtgcttacacttgcacctgctacaccccctgatactgagtccgttcccgaaccagatctagatcccacgtctgaacctgtatgtgaacctgttccttccgaaggagcattattttgtaaatctttcagtatggttgtgaggtcggcaacagaaactatattctgtaacttatctttcggagtagctgttccaatagttcctaatccccccgctttcagatttgttatcgtaggatctggagttgttggcaaagctccttgttttttctcaaaacgcaaggtccctgtcatagcgttcttagcgcttaacaataaccacttagcatctgtaggcttctctagagtcacagaaggcgtctgtccagcctgagattcctgagggctaccgagatctttgatgagctgctccagactaccttctcctgaaccagcatacttagtgattctatcaatcaaatcatccaaccgagctctatactctccgacaacatcttgtacaatccctacagaagctgcatattcattcccgaggaacatagcggatccccaagaagaaggaagccctttgatggtattccctgggcttgtccccatattaatgtctccaaccatcgcccctccagaagtcggtaggaacaatcccgcgatcgatcgagatcctttctgtaagtatccttcaagctgagagagtacaatcacattttggtcttcttcccttttagctaccttacgaacttgttgattcttagcgtctagcttgacatgagctgtggtgaccatcgcatcaacatcggcagaagcgtccccttgattctgagatagcttgcattcaaatagcattttagtaacaggattcgtgggatcggcaggctgatcagaaggtgtcgacggaacagacgaagaaacgcgttctttaattatttttttgttcatgttttgtcttttaattaattaaattctaattttcttttaattagaaaaaattaaattaacaaacaaaacaaactagcggatactgtgaaatcaaaaagaagtaataaatagaaaaatagctggaacttttttcaaacgctcacgaacctcttcgatatcagaagattgattccatacggctatgcttcgcgtagaaacgtattcttgatctcccattaaatcaatcgcaacacaaagctcgccatgatccggaagctgatctaataacgcatcaaacgtatatggattacggtacggagtctctatacagatttgcgtatgggatttcccggagcaacttcgcaaataacgagatctttctttaggattttggggcaaataaccatgaaatgtgaaattttgccctggtagtccagagagcatcaacgcttgcgtaatcgagcaagggccagatacagcatgcacgggaatccccaatgtccgagctcttcggactaacttagccccaggatcagcaatacaaggcaaccctgcatcagaaatgacgccccaagactcttgcttcttgagaataggctctaaataaaagtcacaagccttaacagaagtgtcattcttgctcatcacggcaagaggaaacctatgaggctcttctactttccataaacttaagaataaccgcccaccacgatcactttctactattaatccctggattttattccgaacaatctctccaaccgaagaaggaaggtcctcagatcttttactacctaaagtattgggaagaagatacagcgccatagccacaagtgtattctaaatcattagactggagactattctaaaagatgcttacgaaaaaatatacagggaaaaaatcccatcaaataaaaatctaaagtcgtgaaactagcatttctaatgaaagcatgggatcttggaagttattcttaattaaactttccgtatggaaaaacaggttcaaaccatttaaaagagccggctctcctgcagcaataaatatttgtgttttacgctctttcgactgctctgccactgccctcagtcctaagaggtactgactacgtaaaaagttgagaatcccagaggctcctctcccatatcagacaccaaagatctcatcagactgtgtgcagcgacacggtctttacgaagaagagcatctcgcaacttccacagagagatcgcctcttttttctctacaaatgattgaatatccgaagcttctatagattccttgtctcccatctgacaaatcaacttttgaaattcactaagaatttcaaataaacctgtctgaggaaacttactcacaaaaatctttgcaactcctaaagagcaagaaagctgcaactctttagaacgttttatcaaaaccttgagctatgcgagcatctcgctcagcaaaatactctccaaataaagataaacaaagagcattagaaagcttcgaagataaagaagagaacaactctgctttatttgtgaaaaggaacaacgtaagattcgggttaggatgccgagtgtaatctataataaactcttgtagagaagagctcattttctctgcttgataaatgcctatagtctcttgggaagcgaacaaaccaaaatgatccgtccaagataagagctcttgttgcaacaaacgctgtccgtcaaaaaagctcttccttccagaaatataaagttccgaaaagatatctttgtcctcaagagatgaagagccaatcacaatcactctaaatcgttcacgttcaatatactgaacaaaatctttagtagacgttatgtgaatactattctggctgtttcccataatccatcgccaaaacccaataattctgggattattctttttgttcccagattttatcttcttaaggcatttcgactcagccaataaatacaaaaaaccgggaaaagagaattcttattcccggctacttagaaaatcatcgaaagcgatacgactatctagcgactaatttcattaattgttgacgccagctgtgagctgtacgagaacggttaggattcatttttcttttagctgcagaagcacaaacctttacaccagaagcagctacacgtccacaagctgcagtatgtttatgttttttcatacaaactccagcttttactgctacggaagatttttttgttgaagctactctttttgctacagtcttcttagctacagcttttcttactggagcctttttagctgttgctttcttagctacaggcttacgagctgctacagtttttttagctactgttttgcgagctacagtcttcttagctgcaacttttcttactggagccttcttaccggttgctttcttagctacaggcttacgagctgctacagtttttttagctactgttttgcgggctacagtcttcttagctacagcttttcttactggagcctttttagctgttgctttcttagctacaggcttacgagctgctacagtttttttagctactgttttgcgagctacagtcttcttagctgcaacttttcttactggagcctttttagctgccgccttcttagcgacaggcttacgagctgctacagtttttntagctactgttttgcgggctacagtcttcttagctacagcttntcttactggagcctttctagctgttgcttncttagctacaggcttacgagctgctacagtttttttagctactgttttgcgggctacagtcttcttagctgcaacttttcttactggagcttttttagctgccgtcttcttagcggcaggcttacgtactacagtctttctggcagcagtttttcttgtgctgcgtttcttttgtactcccaacatgttcattcccctaattagacaggtaactactacttatttgatctatcgacaaggagaatgaaaaactttaataaaaaatggttagtttttaactttttattaaaaactaaccacacatattatttaatatcgctaaacaataactatttagatagaaatttctccatataatgaattaaacaacgcacaccaaatcctgttgcatatttggggtaaggcaactcttctttttcatggtaagcagtaccggcaatgtccaaatgtgcccatgctactggattgtcttcgaggaaacgttgtaaaaatagcgctgcagtaatcgatcctgcacgattgctgccgatatttttcatatctgcaatatctgaatgaagtgcctggtcatatttctctaccaaaggcattctccatagagcttccccggtctctgatgaagcttctgcaagatctcttgccaacacgtcgttatttgcaaaaaatccagccacagattctcctaaagaaacaaccatagcacccgttaaggtagcaaagtcaatgatgcgggtaggattacaatatttcaaagcataggagatggcatctgctaaaatcaaacgcccttccgcatcagtgctgccaatttctacagaaaggccggtcattccaacatatacatctcccatcttataggcagccgatccaatcgcaattctctgtagctggaatgatcccggtcacattgatcggaagctccaaggaaagctaaaagcagaaaaaattcctagaacggtagccgctccagccatgtcttccttcatggtaatcattgccttcccaggtttcaaatctagtcctccggaatcgaatgttacccctttaccaatgagtacggttctatctttagatttaggtttaccttggtaatccagaacaataaaccgaggctcaacagcagcgcccttggcaacagcagccaacaatcccattttttcttttaatatcgccttcctatctagaatttttacatccagactcgcgaactcccctgctagaccttttgctaccgcagcaagtttttctggagtgacttcatctgcattggtattcactaaatctctagttaaatataccccttcaaataggctctcttcttttctaaagatcttgtcccctaccttagagacaatacccattacagtcactttctctaggaaaggcaaagacgtatccactttgtgataggttgggtaattatagttcagagatagcacccctgctgccaagttcgttaaaaactcttctacggagaagcgcaactgtgaaattgttgggaataaaatatttacagtcttacacttagcttttcttaaaacagtagtagcctgagcgtaggcttctaaaacggttgttccggatacttcttcgctcttccctagaccaagaagaacaattttttgttcttttgtgtgatcatttccaaaaagaaaagctgtttcccctttcttccctgaaaaattggataatgcgttttgatagacaagcttgtagtcctcatcaacaactgcagcttcttgagctttaggattcttcatccaaaaaggaagaacaagagcatccgctttcgatcgttgatcccaactcgcttgagaatagagtaataccacaataacctctttgttgaatcgattgagtcaataattaaacaccagtagaacgcgttttgcccatttccgtctcaagctggcggcctgacccattctctgcagtagaaaaggccagaacaagcaaaacaacacggttttcatctctacattattccgagatgaaaaaaaggactataggaaagagtagtctttttagcaaataagctctgttactctatagacaagaagattcaagagcttcttaagatatgggattgaatcaaatgaatagaataggcccctgttactgaaaagaaatctcttctaaaagaggcccaggaaagaacagcttgtgaagttgtaactaaaaaggaacatcctcactagcatactgttggtcttctccaaaccctgcatagacttccttatcaagcgcagagtctgtatctaaactttctccatcaaatccaatagagacattatcattagctctctgacgaccttcatctgaacctctagcatcaggacgagaagatccggaattaaattttaatgtatctacgcttacagaaatagaagcttgtggagaaccgtctctacctacatagctttctaaagaaagctctccagcaacaatgactgaagaacctttcttcaaataaggaagcatcttatcataacggttgttccagatattgcatctgcaccacactgtttcatctttagatcctacacgagattttacacccaaacgtaaaacaacaacccgtttacctccggatgtcattctttcttcaggatcggcagctagaaatcctaccaaatatccgaacaacataaaaaaccatccttatctatacgaaacttcctgtgaatttctctttttcaaataaaagacgtcccttcggaacctctttatcttcagagaaaactgtacactaggaccgattttttcgtgaatacaagtattctctatagagtattgcggaaaataaccaaaaaaaatatcctgtgacaatgtcccctagttggatctacggctanattaagtttaccgaaactaaagcgtgttttanaagcgtacgttcaacacataatagaccgaagggaacgagcttgcgccttcttattttcttaccagctagacgacctagttgattaggaaactccgaagagggatgtcgcaccagcctcgataggaaggccttgcctaacagcaaatcacctgatcgcggctctaatcatttactaacaaacctgcttatgctaggtttaaaaaaaacaggtacgaaggagattccctcatgtccaggcagaatgctgaggaaaatctaaaaaattttgctaaagagcttaaaactccccgacgtggccttcgatcagaataatacgtgcattttgtttgttgatggagagttttctcttcacctgacctacgaagaacactctgatcgcctttatgtttacgcacctcttcttgacggantgccagacaatccgcaaagaaagttagctctatatgagaagttgttagaaggctctatgctcggaggccaaatggctggtggaggggtaggagtcgctactaaggaacagttgatcttaatgcactgcgtgttagacatgaagtatgcagagaccaacctactcaaagcttttgcacagctttttattgaaaccgttgtgaaatggcgaactgtttgttctgatatcagcgtggacgagaacccactgttgataccatgccacaaatgcctcaagggggtggcggaggaattcaacctcctccagcaggaatccgtgcataaaagttttgctatcatacaacaaaaggaagagggtcttcttccttttgtgtttaagccccccccctcttctcttcatttcttcggttagatttttattaaacttacttgttctagtttttatggaatctttgtctgttcgttccactatccctttacctctaggagccaaaaagctctccgctgatcgctaccgtttttctctattttcttcacaagcccagcaggttactcttgtactattagaccctcctttctgaaattccatgaaattcctctatcttctaccgaccacaggactggagccatctggcatatcgaaattgcaggcatttcctagtgaatggtcgtatgcttataaacctacgtggtacagacttgagctctcaaaagtttgctacagattcttacatcgcagacccttattctaagaatatctactcccctcaactatttggatcccctaaacaagaaaaggattacgcatttagttacctgaaatatgaggattttgactgggaaggcgacactcctttgcaccttccaaaagaaaattacttcatttatgaaatgcatgttcggtcattcacccgagatccgtcttcccaggtttcccatcctggaactttccttggtatcatcgaaaaaatagaccacctcaaacaactaggcgttcatgcagttgaactccttcctattttcgaattcgatgaaaccgtccatccatttaaaaatcaggacttcccccacctgtgtaactattgggggtattcttcggtgaattttttctgcccctctcgccgttatacttatggggcagacccttgcgctccggcccgagagttcaagactcttgtcaaagcgttacaccgtgcgggaatcgaagtcattctcgatgtcgttttcaatcatacaggctttgaaggcacaagctgccctcttccctggatagatctaaaatcctattatatggtcaatgatcatggggatctcatgaatttctccgggtgtggtaatacagtcaataccaacacccccactactctgaaatggattcttgatgctttgcggtactgggtacaggaaatgcacgtagatggatttcgttttgatttagcctcagtcttctctagagatccacaaggagtccctctccctttaacccccattttgcaagctatatcctctgattccattttatcagaaactaaactgatcgctgaaccttgggacgctggaggtttgtatcagcttggacacttcccctctatatcaacccgatggagcgagtggaatggatgctaccgtgaccatgtaaaagccttcctgaatggagatgctcatcaagtaagttcctttgcttcacgaatatctggatctcatgacatctatcccaatgggaaacctacgaactcgattaactatatctgctctcatgatggcttcacactctacgatactgttgcctataacgataagcacaatgaagagaatggtgaatacaatcgtgatgggacttcagcaaactatagctataactttggctgcgaaggagaaacgacagatcccaccatttgcgctctacgtgaacgccaaatgaaaaacttctttcttgctctctttttatctcaaggaattcccatgatacaatccggagatgaatatgggcacacagcttatggaaataataatcactggtgcttagacactaagatcaattactttctttgggatcgattagctgaaaggaaagaactgttttctttcttatgccaagtcattgctctgcgcaaagcttataccgaattattcaatacctctttcttatcagaagatacgattacctggctaaatacaaaaggttctcccagagagtggggagccgatcattatctagcttttganttgaaacacctgaactacagtttattcgtancgttttatagtgggaatgaacgtattgagatctctttacctaaacctagaaaagaacatttggcctatgaaaaaattgtagatagcacaacaggattcttttctcagatattatctcccaaactctctcttgaaccttatagctctttggtagccatcagcagaagaaaaacctccttggaatctagataaaaaaagacccagctcattagagatgggtctttttgctaccaagcttcttaggatatgcctctaagcacctttacaatcatcttcccaagactcaatcaccacgagatctgcatctttatagaatttttctaaaatctgccgagcattgtagccttctatagctaagtggtctacatttgctcgcaatagatagtctgcattaaacactagcccttccggattatcgagaaccaatcgagaggtccagtctacagcctcctctacaccataaaactgcgacgtaacaccaaatcctccataacgatcctcttgagcattgacatgccagaagctatgagaatttccagcaagaagacgctcataaagagccgttctctctaaaatcacacaagctgacaaagcttccttatctaattccttcaaatattttacggaaagagtggactttagatagtcttctaacgcgagctcgttcactatgaacaaacagctgcgatccgttctatgaatatagatagcacccttgtattgaataccattaacaaacagcgaggctgctccatcaagaggttcgatttttagacactcaacgttgggataattctctccccaacgaatgcctccatacaaagcatgcgccgcacaacgttgtccttgagaagaaacccgtaaaagctcaccatctccgaatactgaaaaagctcccttagcctcaatcaaagctgtagtactttcactgagcaaaagaactcggatttttggttcgacaagaatagattgcgatagggcatcggatactttaacatctgcatctccaacaccgcttacaccacaaaaaactcctagcagtacgagtagatttaattttttcactttattcttctccccacctgtccttagggttcctgttaagatgttcatatgccaaaggggttgcaacccgtcctcttgcggttcgctgaaccaaacccttcaaaatcaaaaagggctcgtacatatcttccagagttctgacatcttcccctaccgccattgcgagcgttttcattccaacggggcctcccttgataaaaatcaatcatcacggaggagaagcttaatgtcaatctcgttttaaccctaagtttatctattaataacatagctaaagctttttctgctacgggcgactattaatacaatttccctctcgcatttgagcaaaatcacgcacccatcgaagtaaattattagccaaacgtggtgtccctcgagcccttctagcaatctctaatagagtttcctgattggcttctatggcgagcaactgagaggaacgagaaagaatggaaacaagatcttcatcagtatagtaatctacacgcccagtaaaagcaaaacgcgtacgcaaaggctcgcttaacattccagcgcgagtggtcgcacctaccaaagtaaatggagctaaatcgagacgcactgagcgagctccgggacctgaatccaaggtaatatctactttaaaatcttccatggcaggatagagatactcttcagcagctttccccatgcgatggatttcatcgatgaaaaaaatatctccctcttgtagaccggtcaatagtcctatgagatcggaaggctttaacaactgcggcccggaagcaattaccaagccttttcctatcgtgttagccataatatgtgccagcgaagtcttacccaaacctgggggaccataaaataaacaatgtccggggacttcattccgttggacagcagctcgaagaaataaatccaatcgttctttcaattgtttttgcccacaaaactctgttagtttctttggccttaaagaaaaatcaaactttttatcctgatgtaaaacagaaattttatgagtcatataagtattcgcaatagtagttatttattcgctaatccaaatcaagaaatcgtattttgacatcctccaacggctgaagtcaagagggattcccctatctctaatccttctttttctctatataaaagactatttaaagaaaaaaacctctgcacaaaggcattaaaaagttgcgtcttttcatacaattgcacatgctgtagtgttgagagttttatctctttttttctaactaaagtcttttcctagaaatatagataacaaacagtcgagagaatttatgggaattaaggaagataactggattcgcaaaatggcaatcgaagaaggtatgatagagccttttgcagacagtcaagtgaaactgcatccagagactggagaaaaactcattagctacggcttgtcaagttatgggtatgatttacgcatatcgagagaattcaaagtcttcaccaatgtgtacaattcacttgtcgatccgaaatgttttacagaagatgcgctgatttccatcgtggatgatgtttgtatcattcctcctaactcctttgctttagctcgcagcgtggaatattttcgtatccctcgtaatgtccttactgtgtgtattgggaagtcaacctacgcacgttgtggattgattgtgaatgtcactccttttgaacctgagtgggaaggatacgtaactatcgagatttccaatactactccacttccagcgaaagtctatgctaatgaagggatagcgcaagtgctcttctttgaaggagatgctgcttgtgatgtatcttatgcagaacgccaagggaaatatcaaaaacaacaagggattactattccgtttgtttaaccctatgtttcctggacgagtatggcaagtaagaaacagacttcttggttcaggtatatggaagaatgtgtcattcgttcttggtggcttattctttgtcttcttggaggtggttttgtctatgacagagccatctcccaactatgcacacaagagctgcgattacagcagcgcatgtttcatttaaaatcccatttaaaagaagctctcgagaaacagcaagagttgagcacccatctggcttcttgggatgatccgaaagttattgagctagcacttattcataaactaggtttggtgcctaaaggttatgaaaaaatctgcttccagaactctcaaaaaacgaaaagaaatcatcgaaaataaaaatcttgttcgcaattgcttgactttttattaccttctcatgcagaatgtagcttgaactgttccggagtagctcagcggtagagcagtggactgttaatccattggtcgttggttcgaacccatcctccggagtcttttttctctcttatagatcccaaacattatccgtagtttcttcttatcatcgttaaggtgatggagtctttttttattcatttttcccgttcacccccaattggtttgcaactcttggtggtagaccaactgcaccgcgaaatagcgttctaattcagctaaaattaaaaaaaattctatcgacccctctcgtaatacaggaaagcccaaatgctaaaaaagctccaagggagtatactgtccgaggcgacttttctaaactcctcaattttggcatcattgaggcctcagaaatacgaaaagtccctatgaaaagtgcgttgcattgcactcttagagaggattaaccatctatattcccaatagaatgtcacaccctacagacttcttttaaacaagttctctctttggttgctgaaaagataacaaccaaagcttttgtgattttttctgtgttattttccttaattataggattcatcgcatcgtgtggattcctttttgctggcccgccggctttcatagcctccggactttgctttgctctgcttgtttccgtggttagtttttttgggtgtcagaagctcatcccttacggaattcaacatctgatgtcgtatgtaaaatccatcccctctctctcatcttctctcattgattttctaaaaacggaatccaaaagcatttcaagcctataccccaatcctggcttaaaagaatgtttcaagggcgcctctcctaaatataaaaagtttttctttgatcacccagaaaagcttctttctgcagcttttacagactggacaccacaaatcatcccttcggattcagggcaacctcgaaccattatcctgtcgcactccagtttgcctttctccctcacactatccactctggattttgaaacgctacatacctatgncatcaagtccaatgctctcacctgtcgagtgggttatgcacaccaattaccttccggcaatcctgttatgcgcgaancaaagaaggagttctacaacaacattatgatacaggaaatgaaaccttcttcatttctattcaggaaagcaagcagctgcaacaagaagagctctttaaaaaactctttagtcactatgcacagatcatagaacacaacctatctaatgagattttattgctagaacccctcaaaactcctctgcacacaccaaaagcacgcactctagagttgctagcactattctgcgctttagaacagttgcgttaatacaaaagttgcggattggagaactaagaaactcgctcccatattcccgttggattatgaagatttctttactgtattcatgaaaaagcaacactacacgcttcccggtaatgtatcgaatatgcgtatcctatctcctgtacgacctgttagcgagacagcactaaccaccattattatttctggattagaagaggaagataaattgggtctactaggacaagtgcaacagttcttatttgatgctgaggaagcacatcctcaaagaggtgagagcattttaatacaaaacgtgctcgacgacattactcaatagacgatggattaagaactgcttgtactcctctagactcgaagaatgtgctgcaatttgctctctcgcctgaataacattatcttcttgcaaggagcaaaactctgggaggtactctatatgaggaccagaaagcacgactagccccttatcgaggcgtctggagagaatagctgcaggttttccaagaagattattatagcgcgcctcgatgcatatttcggggaaatgttccgcattttcgaaacagcatcccccattaaaaagagagaaactctctccaggaaaatcagcgaaaactagtggagcggctaaaactccagaggaacttgtataagaaaaggcgctttcataagcaggaccattagcagctcccgggaaaaaacctaaatctcgcttagcaacaaataaagatcctgtaggctctagaaattcaaaccgcgcgcaaccaaaataagctcctgcgcaaaatacctaggtaacagcctccctctcttacgtagttatcgatacgcgctgtccccagtccatgcaacacattatgataaggtacatcagcacctcctggaattacaagaagctgggttgtatcttcccaaagaggctcatgaatcaagaaacgtccattcacgcgacatacctccatctggaatggagcagctacctgcttcaaccagcgaacagtatggcgcaaatagtaaggagaaactcctttatccgaatacactaagatacgcttcatctctttgccttacaaaaagctttttctcattataccaaaaaaaacgctttatcaactctgattctataaggaacttcaaaccatttatgaaaatagtttaaaatctttactcaaaacagtaaatagcccttcttggtactgtttacgaaaaatctttatgggaatataattgccctgtaatggtcctttcgggctaaagctccctcaaacgaagaggagaaaaaagagaggctttttttaccaactctttttgtctttacctgactttcgttctcgtaagtcctttattttagtaatttcttagagcgcagtttttaagctggagagccttttaagcatgatgtcctcccctcatccaatgtcctcttctcgtaatacacctttgggagtcttctatagcctcctagcctgcttctactggggaatggttttcgtgatccctagtatgctagggaactttgctgacctagatattgtgctgacccgctactccgttttcggaatctgttcgctgatcactattctgtataaacgttctaatatcttcaaaacagttccctttttcctctggaaaaaaggcatcctgtgggcctttcttattaacatagcctattatttcggtatcgcacaagctgtacgttattcaggatctgcagtgactgtgatcattgctgggttagcccctattgccattctcttctattccaatattaagaaaaagatgctctcttactcatttcttttaagtatgagtggcatcattgtagttggaatcattctgtcgaatgtctccgaattccaatccgaatccagttcttctctgcctctctacctcttaggattcggatgtgtcacagcagcgactagcatttgggctggatacatcatctataaccatgactttctcgagcaacattctgaaatctcccccgacacatggtgccatatgctagggatcagctctctcatcatctgtctcccattaattatcttaggagatactttcggtattacccatgtcactcgtaattttctatttcatacccctctttccgaaagatgcctatngatcgttctttgctctgctatggggatttttcctcttcgcgagctatcgcagcttggaacaaagcttctcttcatctgtctacagctcttttaggggctcttcttatctttgaacccatctttggatggattctttcttacctatgtaaacgagaaatgccatctttccaagaaggtttagggttctttctgatgttaggagctagtctctgtctccttctagctcagaaaaaagccagtgaacaagaaactccttcagaaactcttataaccacggaatccgaagcaaattaaattttaataccgattttcaaaatcctctttaaagcgattctgtttgtattttaaaggttgctttttgcctaccaaatcgctttaaatcctctaaaaacattctgagaaagtttcatttttccatggacttcttttgtgggttaaatataaaaaataccgatcggagccttattagaatctataatgctgtccgacaccgacttaagcctttctaaaaatcgaatacttccaagagagttaaaaagatatgggttgtgaagagaaactttccggtattttggagctgatcctgccagaagatcccctgtccgatcaaacagggtacgccttcctacgagtcccttacaaaaattcactagtaactgtttgtggccatctcccgctctctttgttcaaaatcggctcctctgtagacttaacaggtcattggagtgtagatgctagcggagcattagtgtttcgctttacctccgctgcaacctatagtcctgattccggaatcatagcttacctgaatgctcaaatcaagggcgtaggccccaaacttgctcaaaaaattgtctcaaccttcggggaagacacgttaacagtactcgattcctgtccttctaaattggtagaagtagatgggatttctcctgcccgctgcgaagatttttctaagcaactccaagagcaaagagacctacgtcatgctttgttatttctacaacgacatggaatagccattcattatggtttacggctgtataaaaaataccaaaatcaaacgatcgagaaggtctgtcaagatccctttctgcttgcaaaggaaatgtacggtataggttttaaaaccgctgatcttattgctacgtgcttaggagtccctctaaattcccctaatcgtatcgttgctggaattcaatactctctagatgaacttcaagaagaagggcatacctgctaccctcttaatgattttattgttctcgtagaaaaactgttgaatgaagaagctccagaggagatcatacggaaagaggaaatccgtacccaaatccatttcttgtcacgccagaagacagtctatgtcaaggaactcgaacaagatacctatatttggtcgcgccaactttttctagctgaacaacaaattgcgattgatattcgaagactcttgttttcttctaaacgaatacgatctatcaatacccaggaagcgattctggaggttgaaaatcttctggatttaaaattggaagaaaaacaaaaagaagctcttcatgccagctcttcacaaaagattcatattatatctgggggaccaggaacaggaaaaagtacaattacacgtgctatcctttctatctttgaaaagatctcctcccctaagaaaataatcctagcagcacctacaggaaaagctgcgaaacgtatgacagaaatcacagggaaacgtactcaaactatccactctcttctccagtatgatttcaaaaccttgtcatttcgaaagaatcacgaagatcctattgattgtgatcttgttattgtcgatgaatctggaatgatcgacaccattctcttacaacgttttctagctgcactgcctgatcatgctatcctaattctaattggagatgtgcaccagcttcccagcgtaggccctggtaatgtccttaaagatcttattctttcccatcacatcgaggtaacctacctaacgaaaatcttccgtcagttgcaaaattcgaatatcattacaaatgcccataaagtaaaccaaggagaattcccggttctcaacagctcttcagggaaaaaagactttttattttttcaaaaagaagaccctgaagaagcgattaaacacatcattcatctcgtttcggattttgttcctaaaaaatttggtatctttaccaaagatattcaagtccttgctcctangagaaaaggggtattaggaatactcaatctaaatagagagttaaaagcagcacttaatcctaataaactgtttatccaagggaaatttcactccttctctacgggagatcgcgttatgcaaacgcgtaataactataataaagaggtattcaacggagatatcggttatgtgacctctattgacctatctacaaagagtttgatcgtttgcgtggatggccgctatattagttattcgcaagcagaactcaatgacctgataccagcttatgctacttccatacacaaataccaaggaagtgagacctcctgtattattcttcctattcacacctctcattacgtgatgctgtatagaaacttactctatacagcaattacacgagggaaaaaactagtcattttagtaggaacaaagaaagcagttgctattgctgttcgtaatgataaggttcaacaccgatgtaccgggctgcaacaagctatgcactcccttcttaacaaaccaactcctcttttctctccttacactatttgtagaccgtctctaggataatcccctcggtatatatttaagaagctatctaatattagttgcagtgatgtattccgagcggattgctttttgcacaaaaaaaagaggggttctataaatgaaacccctctttctctccgtgaagattaccgtggagaatcactctaccattgtgaacaataattcaggctctttcagagaaaatttctcttccgagtaatcaaaaaaggaatctgtccaaagagagtgtaatctatctggatcttgggaacctagatctaaggaatatggagctatcatttccaaaatcttcaatgctgtttcaggcataataggataggaaatgagagctagcaacttctggcagtaacaagcacagaatagaatagcgcgtacccgattccagttaccctctttagccaatttccatggagcttcatcattgaaatagccattccctaaagcagctaattccataatcgtggaacacgccttacgcaaactgtattgtgcgtaatgttcggctgcatccttagcaagtttttgagattttgagataaaatccaaatccttttgctctaattgaggagaagaaagctctgtgcatccattcttaacagcaaaagctagaactcgattcacaaaatttccatacttccctacaagctcagaattgcatcgcgtcttgaactcttggaaagagaattcgctatccgaagtctctggagcaatcgctgccaacacataacgcagtttatccaaggaatacgtttctaaaaacgcatccatgtctataaaattcccatccgatttactgaactggaaaccttctaacaataaaaattctgatgttacaagagcatccactttcttatagggaagagattgtcctatttccatagcagggaaaataaccgcatggaaagaagtattatctttacctataaactgtgcgtaggtcacagtatcgtccaaccaaaacttcttccaagcttcagggtctccaatcgatgctgcccaatccatagttccacttatgtaaccaattggagcatcgaaccacacatagaataccttattttccaaatcaggaacgggtattccccaagacaaatctcgagtcactgctcgaggacgtaaatgctcgatgtaatccgtaacgaaattacgcatatgaggacgtagataaataccttgcacgaaagcaagcaaatcttctttcatgcgctccaaatgcaagtaagcatgttccgtatcacgtaaagataaagctgcccccgttaatttagaacgaggctctttcagatctctagcttcgtaatcggcaccgcactgctgacactcatctcctcgagctcgatcaaacccacacttgggacaagtacctacaacataacggtccgctaaaaacttcccttcttcctcagaatacagctgttcggtcacctgattctctaccagtccgcgttcctgcaagtttcgatagaaatcttgcacaatagcaggatgataagcgttcgtagttctggaaaagaaatctacagaaattcccaatttcttgaaggtatctttatgaagcttatgatacatgtcgacatattcttgataccccatgcctgccaactctgcattaagggtaattgcgattccgtattcatcagaaccacaaatatacaaaacctctttgccttgtagtctctgaaaacgcgcataaacatctgcaggcaaataagcaccggtaatatgtccaaaatgcaaaggaccatttgcgtaaggcaacgcagaagtaataagaatacgggaagattccactatttcacgtcgctccagttgtacagagaaggatcttttcttctggatgttccgaaaccttgttctcttcgtctctctcctgtagcagacaaatgtctctctcgatcatctctttcagcgtattcggactgaatgccataaagatccaggaagttcagcgcctcaatcgcgacgttagaagaacgaacatctcctctagcaattttgttcttagcttgcttaattacgtaattaaccaaactaaaggggctatcaaatagcttattcagtctttcattagttaaacgatcttttctagccatgactcatcctatgttcttcagctataaaaatacttcttaaaacttgatatgctgtaatcaaatcatcattaaccacaacataatcaaattcgctagcggcagcaatttcgacagcgctatgctctaatctttctttcttctggaaatctttctctgaatcccgagcattcaaacggcgctcaagttcttcttgagagggagcttgaataaaaatagtgactgccggcatttgcttcttcagagccaaagctccttgtacatcaatcacggctatgcagtgcttacccttttgcagaactctagaaatctccgccttactcgttccgtaataagtcccaaataaaaagacccattccaaaaaatcttccctatctaaagattgcttaaagtcatcttcagatacaaacaaataatccacgccatgcacttcgcctggacgagccgaacgtgtcgttgacgacaccgtcttctcaaatgcatcaggaaactctctttgtagcatatgggtgagtgttgtcttccctgctccagcaggagcgctaatgataaaaagcttgggaaagaactgaaccccgtcttgagaaaagggggaaataacctttactgacatactccctctnngaatactctctttcacaggagagaaactttttctatgatatacacaagggccgaaatgttttagagcttgtaaatgagctgctgtcccataccccttatgcttatcaaaaccgtactcggggtactctacatgaagcttccgcatcaactcgtcacgatattccttcgctatgatagaagctgcggctatcgatacggaacgagcatccccttttataatcttaagagaaggaattttatgaggcaaaaacaacccgtcaaccaataaaaaatcgggagtgcttcgcaaagaagctatggcttgaaccatagcctccttggtagcctccaaaatattgatctcatctattcgctcaacagaaataacgccgaccccgcagtcgacttcaggatcttcaagcaacagttcgtacagataccgtctttgtttaggagttaatttcttgctatcatcaatacctaagaaaactttccctctaggtaagatacaagctccagcaacaacagggcctgcaagaangccctctcccagcctcgtctacaccggcaacttgtgagtacccttgctcaatagcttgattctcaaaaatgcttttttcttcgaaaagcatcgcctgctcaacggtcgatttcatataaaggcaatctcttgacgttgagaacagcagaaagggcttaatgccgctctcttttctttactatttcttagcagcccgagaaccgataagctctttaactttagcagccttaccagtttttcctctcaaataaaagaggcgtgcacgcgatacttttccgcgttttacaacttcaatacttacgatcttagggctattcagtagaaagctcttctccatcccttcaccgtaagcaactctatgaagagaaactgtttctcctgcaccaccgcctttacgggccatgactgttccttggaatacctgaacccgctccttgcctccttctgaaatgtttgtagccacacgaatcgtgtcaccaacacagaaatcagcgagatcagttctgcactgctcgtcttgcaattccttgattaagttccccattgtatttcacctaaaaattctttttctatttctgtacacaagagacaacccaaatatggccatctaaatcaaaaacctgtcttaaaggaaaccctcccgtcccttgttcaccaagctctcctccgagcatttcccatcgttttaaaaaacgaacaaaatcatgatcagtctccagctctataaatactgtggtcgggcctcttgtttcttttgtctgttgcaggtacaaactcgtcttccctaaaaggaataatttatctccgtcccaacactcttttccaaacatcctggaatagaacttcttagcttttcgaagatcttgaacttctaaaactacagaaaaggttttgggagaaactacctctatcctagggagatcctcttgagtacttaaacaagcactgttaccataaaaatactgcagatacagatctggtcgacgttctctagttctctctagactaacctgttttctccaatccgcaatcttctgatggtctccacaaagcaacacttcagggaccgactcaccctcaaaaacccgtggacgagtgtactgaggaccttctaacaatccattttcaagagagtcgtactctgcactttcttggttccctaaaattcccggaatgaagcgagcaagagcatctacgagaactaaagccgccgcgcacccattggtgagaacgtaatcaccaatacttatctcctcatccacttcggcagtcaacgccctttcatcaattccctcatagtgtccacataacaataccaaatgcgaacacgacgccagttcacgacttttctttgcggaaagaagttgtcctgcggagataagtatatgaccttggacttctttcttcttatgcttctaatagcctgtaccacaggctctgccatcaaaagcatcccctctccattatagggagagtcatctacctgcttccatttccctaagccgaactctcgaatatctcgggagcgaacagataaagctccctgtttaattgctcggcctaaaatagtcgcctgtaaaggactagcaaaatagtccgggaataaagagagaatatctatctccattccttatgtccttatctacttagcagctgcttcagcctttcttgcagcaagacgctgacgataagctcgtcttttttgtctaacgaccgctctacgagcaacttttttagccattagttcagcataaaccccaggagctccttgtttcactaaagccccagccttctctgtaagctcagctccttgattcaaccaataaaaaatccgttcgcttttcagctgataattctgctcgctatgaggatcgtaccatcccaacagctcaatatatttaccatctctaggagactccacatcagctagtactaatctatatacaacatggttcttacgtccttgttgtcttaaacgaatttttaacgccacagattccctccagacatttttttacccatctgttccattttctctcgggtcattcccttaaaaaacttcttagattgcatcatttgcttacggaactgattgacatcacctagcgtcaatccacagcccgcagcgattcttttcatccggctcatactcaattccactaactcctttcgttcctctggagtcatagacagaataatcgcttcatttcttttcatttgtttctcggattcttccaaatccttatcgctaggttttgcaccaccaaaacttggcatcatattcatgatcttacgcaaaggccctaaacgacgaaaagcaagtatctgcttatgaaaatcctcataagtgaacgttgcttttgttaacttttcttctaactctttattctcttcttcagagatacactctcgcatcttgtccactagactgatcgtatctcccattccaagaatacgttctgccatcgactgtgcgttaaaaggacgtagatcttttatcttctctccacacccttcaaatttaattggcttattaagcaaggacttcacagacaacaccgctccagctcgagcatcaccgtctgccatagacacaaccacacctgttaagcctaagcgctcgtcaaaagcttttgcagtaacaaccgcatcttgtcccatcgctaagttcataacgaacaaggtttcgcacgggctcgttacacgagcaatagctactaactcatccatcaacgcatcatccacatgaagccgtccagcggtatccacaaggactaaatcatatccttggcttttcgcatgctgaaccgcctccgccgccatgtccacaggatcatttccttcccttcggaaaaaatctgctcccgtttgttttactaaaccttccaactgttctacagccgaaaaacgtttcaaatcacaggaggctaccagcactttctttgccttcttttctcgaagaaaatagtcagcaagcttagcacaagtagtcgttttccccgctccctgtaacccgcagagtaaaataacagctgggcatccccgtaacgaaacagcagtctgctctgaagcaagagaagatgaaagctcttcatgcaaacacttgataaactgttgcccaggagagacatgtttccaaacttcttccccaacaactttctgcttcactttagcaataaaatccttcaccgcctgataattcacatcggcatctagaagagctaagcgaacctctctaatggagtcggaaataccctcctctgtcaccctctttgcggtaaaaagtgaggagaaaatattagataatttttgcgataaagaactaatcatctctcggaaaagccagaaacctccccagaggatacagcatcattagcttgattntcaaggaaaaaaaacctatccaattgcgcataatctttcaacacgcgtcctcggattcccttggcatgaaaaatttgctttacatcctctccttgtgttgagccaatctctagccagccaacgcctccagagactaaaattttatgaatatgagtagctatacgatgataaaattctaacccagaaacgcctccaactaacgctttccaaggttcatgacaccgtacctcaggatctgattcaaaaaactctttataggataggtaaggagggttacaaacaagcacatctgcaggaaaagagaaaggatcaaacaaatcccctaaaagaaagtctactgcaagcgcattgcttctagcattggactctgcaatggccaaagcttcaggactgatatctgatagcgtaacacgtacatgcggacagtgcttcctcactgccaaaccaatacacccgctcccacagcaaacatcataaaatgttgtcttctccttgtgcatctgcagataaccaatgatctgctctacaaaaatttctgtttcttgcctaggaattagaacttgaggggttacttgcaactcaacccctaagaaatgcactttaccgtggatgtatgccgtaggacaacgatcccctcgcttccgcagacgcttccaataaagactttgctcttcgctcgataacttcgcctgatggagagcgcttctagaagaaatctctaacaaatccatcaagatatcttcggcttccctttgaggaaaccgaatccctcgagacaacaaatactctgaagcttctctaagcagtttcttcatgaccgaatagctgccgatgtacgtgggttacaagagctgtcgtaatcatatccaactccccttccattacacgatctaagttatataaagttaagccaattcggtgatcggtcacacggttttgaggaaaattataggttcgaattcgctccgaacgatctccgcttcctacctgagcagaacgcatagcagaggcttcttgcgcgcgcttctgcacttctgcatcgcgaatacgagcttttagcacgcgcatagccttagctttatttttatgctgactgcgttcatcttggcacgtaacgacaacgccagaaggaatatgagtaatacgcacagcggaatctgtaacgttgacgtgctggcctccggctccagaagaacggaaggtatcaatacgtaaatccttctcatcaatgaaaacttcttcgtcatcttctgctggttctggaagaacagctaccgttaccgcagacgtatgtaccctaccctgagtctctgtttctgggaccctttgcacacgatgtgttcctgcttcatactgcaagaaacgtttcacagaagccccagaaatccccataacatattctttgtagcctccgagatctgactccgatgcagagagaacttcgcattgccaccccttacttgctgcataaaggtgatacatgcgcacacaggncccctacaaaaagagccgcttnatctcctcccgttcctgctcgcaactccataatcacactgagatcatcatctggatcaggtggaataagcaggttttctaactgcttcgataggcgttctacagcctcttcccctacaagaactccttcttctagcatagctactatttctggatccttctctgttgatnaagcgagtttatcgtcctgaagaattttctttgtcgcaaccaatgactcatgagcatttttaatctcagaaagacgcgcatgctccttgctcagcgaactatattctttaggattactaaagatattcggatcggatatctgcttttcaacttcttcaaggcgctttaaacactctaaaacttttatttccatgaacgacttcttctgcctttactctagcatctctctaacaaagaccagagtgtacattggcaatcaatttttggggaacactagactttactctgaaaagtcagattcaaaaagagagacttattaaaacaaaaaaagcggggtgttcgccccgcttttctctagataacagaaagttctgctcaaattattttttcttcttagcaggagatttcttcttacccttgggaagaacatcttccacaacggtttcaggcttaggagcagactgcttaatgccactgtatcgtttcaagaacttatcaactcgaccctcagcatccacaagcttcttgcttcctgtgaagaatggatgcgaagacgaggaaatgctgacgtagcatacagggtattcttgtccttcaaaaacctctgttttatctgtctgataggtagacccacaaacaaacttatacccagtggaagaatctacaaacagaacttgtctatactcagggatgagggttttttttccatttgacaaccccaaaatcactatcttagtatgtgaaaatctcacataacagaagggagagccatacccgaacatttttatgaaaaaagcaagaaaaaatgcaccctccaaaaccttcttaaagtttttatttttttcttggcatttttcatatcctatccctcggctgaagcccattctcctctccaatcatcaatccaagaaaaaattctaactgcccgccccggagactatgccgtcttaagccgaggatctcaaaaatttttctttttaattcgccaaagttcttcagaagcgacttgggtcgaagtgtctgaatttgcctccctaacacagcaagaaaaaaaattagtagaacagtcttcctggaagaatgccttccatcaactccaatcttcaaaaaaagtgtacttgttacgaatttccaaaaatcctcttatgatttttgttctcaaaaatgcgcaatggatgcctctctcagaaaaagatcctttgcctttctttgtaaaaatccttcggactccctttatctccagccccctctcacttaattaaatacaaagggaaagaacgcaccccctggtctccgcgaacatctttgaatggagaactcataacccttccttccagtgcttggatttctgtttggccaaaaagattcttctcctctatcagaaaaaaatattctcatatatttttctaaacaatgaacggttagcggtttcctctatgggactagtattgagactcctacagggacagtgattattaagaccattgaaatggggcaccaagccgcctcatcctatccagctcttcccaatttctagccatcttcatactttcatcgaaaacggtttcaatgtagtgccgaaaaagctttttatgtaagatgaaccttggcttaaagacctccatatgaattaagtagatcctgccctaaaaaaatctaaattttttcacaatagaaagtagtgaagagaggtctctcctaacataaatactgttaaatctaatgacgagcagttacatgagtcgcttatattccctgaataagagtcgtcgcattcttcattcttcctttagattgctgaaaagcacaaaaatgctctctcatccggaaactcaaaaagaactacaagaagtcttgaaacagcttgaagaggctattttggatcagaatagggaagatgcttccctttttgctaagcaagctcaagccatacaaaaaagattccctaaatccaaactccgagctacttttgatcttatctatgctttgacgtttgctgccattcttgcttttttaatccgccagttctggtttgagctatatgaagttcctacaggatctatgcggcctactattcttgaacaagatcgtattcttgtttccaaaacaacatttggactccggctaccttttagtaacagaagtattggctatacacctgaggctatcactcgaggagaactggtagtcttcactgttggagatcttcctatccctaatgccgacactaagtattttggaatcatccctgggaaaaaacgctatataaaacggtgcatgggtaaacctggagataccgtatatttttatggagggaaaatttatgggatcgattgcgacggagagcccatcttcccccaaaatacagagaatctntaccacgtcccctatatttcttttgacggaactccagaaattcttacccattcagaagagcaaacagatgtgatctttaaccaatttcacacaccttgtggaaagatttctctccctcaacaggcttcttatggacaatttttctataagaatgcttggcataatgatactccctatgctttaaaagatcctcataatgagcctgttagctatgccgatctattcggaataaaaaattttgcaatggttcgcatccttaccaaaaaacaagctgctcttactcatgtccttccctctcctctttcggacacctacctagaaattgcccacactcctaatgtttcctatccncaccctcacttacgtccatttgaaacacagcgaattcctactatcgaacctatgaaaaccttgcttcctttaaggaaggaacatattcatttgattcgtaataacctcacaacatcccgttttacagttgtagatggatatgcttacaagtaccaacctgctcccatgaatacctcaggcatggtcaggatgtttgccctacctatgccaaatattcctgacggatgttatgaattttctaaaggagacgtgtttaaaatcaatatgggtggctttcgaacaaaactcaaacagccgcatcctttaacgcaattaagcaattctcaggtcattgacttatttaattgcggcattagtttccacacgatctatattcctaaaaaccctcaatatgctccgttccctaatcgctatgcatttttcaatcaagggaacctgttcgttatggattctccagtttttattgatagcgatcctgccttacagaaattcattgtgtctgaagaggaaaaagaacttcaatcatctgaagacaaaccttacatcgcatttattgacagaggtcctcctccagaatctacagaggaatttgtttcctttattactaatttcggtcttaaaattccggaaggccacgtgcttgtcttaggagataattgtcctatgagcgctgatagccgtgattttggttttgttcccgttgaaaatcttttgggatctcctgttgggatcttctggcctattaatcgtctaggattgttatcttccaatataacgcccttgagtttacctggctacctcgtaaatggattggctctaggagcttttctttactgcataggattatggtactatcgaaaaaaccataggctattcccttaagagcaaaaaaaagagatcttttaataagacctctttttttgctcaatgatagtgatctcaacgctcaactcgctccagaacgaaggacactgcgtgaccgttaatatcccactcttccccttctttataatcgatcacagaaacggaagtggttaatgtctcttcacaaatatactctttgtgtaaagcgaacgcttcctgaacgataacaggggcatgtaaacgtatagcaatgcgatcagaaacgtgtaatttcccatttcttcgcatagtgttgatcttattaaccaactctctggctataccttccataattaaaggctctgttaactgacaatccagtactgctacaaaagaagctgagcttctcgctacaaatccttcagccgatgcccaagaaactgtaatgtcctctttatctaaagaaatggtctcttctcctagagaaacaaccatctgccctttgtgcataaaagcctgaatttgctcttgaggcaatcctgctagagctctttgaatttctggaagacgattacctaccttcttccctaaggttcggaaattaggcttaatcaaagtggttacatactccggagtttctgaacaaaaatgtacgtctttcacattaagctcttctccaatcaaggatccaacttgagataaagcctccattctctcctggcttcctacaatatacacgttttgaagaggttgacgtactttcagtttatgctccttacgcaaagaatgccctagagctacaatctctcgaatatcctgcattttcctttccaaattaggaagaatcttttctaggacaacgtgaggaaaatcacataagtgcacagactcgggatccgtttctcctcgtaattgctggtacatatcttctgaaataaaaggaatgaatggcgcaatgactttagaaaagactaccaacacttcataaagtgtagagaatgctgcccgtcgatctgtagaatcctcggcatcccaaaaacgtcgccgcgacctacgaatataccagttagttaaatcttcaatgaaatccacaaaaggatttacagcagcatgtaaatcatattgcgacatactttctcgagttttccctaacaaactgtatagagaagaaagaatccagcggtctatttcagcaagttctatattgtctgtttctttaggatcaaaaccatacaattccgcataagtattatagaaagccaaagcattagacaacggcaatagaacttgcttaagcacagactctacccctttatcggaaaagcgaagatcttcagctttaacgaccacgctattcaacaaatacagccgcaaagcatctgctccatacgcgtccataatcatttttggactaggataattattcaaccgcttcgacattttatttccgtcttccgcaagaataatcccatttacaattacatttttaaaagcgggctgatcgaataaagctgcagcaataacggttaacgtatagaaccaacctcgagtctgatctagtccttcagcaataaagtcagctgggaagcaaagcctccgtttcttctgctctttcaaaagggtaatgattctgagcatatggcatagctccagaatcaaaccaacaatcgaaaacataagggattcttcggaaagatttcccgttctggttaatttctatctcatcaataaagtggcgatgcaaatctacaatcttctgtccagataatgcctccagttcctggatagatcctatgaccaaaagctctccatcgtcactacgccaaataggtataggagtcccccaataacgatttctactgatagcccagtcacgagctccctctaaccacttaccaaagcgtccttgtttgatatgcccaggagtccaatgaatggattcattggcttttaacatcttactctttaccttttctacagcaacgaaccaagaattcactgctttgtaaattaaaggagagtcagttctccaacaaaacggatagcggtgacgaactgtaccttgatagaacagtttattttcgttcttcaatcgacgagcgatgcctttgtcagcagacttaatatattcgccgacaaaatccttcacctcagcggtataacacccctgattatcaacagggcacactagaggtacgttatgttcctggcaagcaaaaaagtcagcttctccaaaagctggtgccatatgaacaatacccgtcccctcactttcctcaataaaatctgcaggaagaatacgaaaagcccctaactcctttttatcttggaaataagggaaaagcggttcgtaactttgtccaacaagactctttccagacaattgtcctatccattcataagattctcgatctgggaaccaacgaggcaaactttcctgtcccaggatatattcgtctcctgattctttgtctttaatacggacataggtgagctcaggatgcacagctagcgccatatttgaaacaagagtccaaggagttgtggtccatgctagaagaaagccttgattgtcttgcaaagcaaattttacaacgacagaagggtcgtctacttccttataattttggccagcttcgaaattggataggggggtacctagcttggtagaaaaaggaaccactttggtcccctcatacacaagtccttgatcatagagagagcggaatacccaccagacactctccatgaaagataggtccatagtcctccatgttgcagaaaaatctacccatcggccgatcctatccacaaaatatttccattcatccgcgtatcggaaaacaatcttgcgacattcttcgttaaaattcgccacaccgaaacgctcaatagctcctggctcggtaagacctaaagatttctctacttcgtattcgactggcaccccatgacaatcccagccaaaacgccgaggcacataatgcccatccatcgacgcataacgacatacaacatcttttattgtacctgctaacaggtggccataatgcggtaagcctgtagcaaatggaggcccgtcataaaaagaaaaagtggggcagccctctcgattgtctaaagttttttgaaaaatatcttgctctttccaaaaagatagaatcttttcctctttggcggaaatactaatcttatcttcgttatccattctttgattattcacttatgggttttgatgctttcgaaagtttgatcgatctgcttacaaagtttgcagtttaactgctttcctaaacaggtatttcttaactaacggattatgatcgattcgccttttaaaccgttaattaaaatatgcttatcgagcgagcggaagagagcacaataaatggaggaaccactcttttactcctaggccaaccccatataatcgcctgaatcccctctctttcatttccctctgcctcgaccacaatccgcttttaatgaacaagttacattgatttctcatcaaaatattgcggaaaagactcagaatccttacaatcctcagctctgggggtgtaaaggtttcgacttagaaatgaagcgttaattgcatgcggagggcgttggctggcctcccaaaaagccgacaaaacaataaatgccgaacctaaggctgaatgcgaaattatcagcttcgctgatctcgaagatctaagagtagctgcttaattagcaaagttgttacctaaatacgggtgacccggtgttcgcgagctccaccagaggttttcgaaacaccgtcatgtatctggttagaacttgggtcctttaattctcgaggaaatgagtttgaaatttaatgagagtcgttagtctctataggggtttctagctgaggagacataacgtatagtacctaggaactaagcatgtagaggttagcggggagtttactaaggacgagagttcgactctctccacctccataggtttcttcttctgtttttgcctagtggggaatcttggattttcgtgtcctcccaaataacgagtccaccgagttccccaagaggcatacagaaggagaggccgttttttattgaaatttttccccgattctgttagaatgtctctctggctttcagtgatttttctcttacgtccgcattttttgcctctgtacttctccccgcttcaaaagctagaagctttatctttttaagggagtattcttcgtgtacgttttttctaataccttttttttcatgcagcatgcccataatgcggatagcttcccggcatgggattgcttacaacacaactatcttcgtcgtaatgcgctgacatctttttgcagctatgtgcccattctgagcacagttgtagggattcgcaccttgtataacatgcgcaaattacatcaagcctttgtacgacgaacaggaggattcctctgtcaaaatgacccgaacattccttgcaataagttcccctgctctatcattagaaaagaatggccacaagtgcacacaaaagcgatgcaagaagtctttggaatcaaagctttagtttgccttggatcccttattctaaaaatcttccgggctgttaaagcttttttccatagaactttttcgccctctctacttccagaacaggatgcctctattcaattgccagactctcctcaatcaggaatcccggaagagacattatcagaaaccccgcgtagctcttagcaaaaaagaaaaaagaagaagagtcttgttacctaagtaacaagactcctattgaacttgcttatgccccttcttttactgacaaaacaatataggcgggaaaagcaaaatgattatttggtctagagacacactctaaaactacaggttttcctaaccatttactcaaatcgatactagtagcatagacaaaggccactacgtcttcaccatttttcaagagataatcgccaggattatttttaacgatgtgaggatacacttcgagttctccggtcagcactcgtttcttcttctgttcatctctataaaaagattccatagtgagctgatgccgaatctcttcgggctgaagacttacccaaacagcaaataaagaacgctcaaaactctctcttccttctataacaggagaggccttaacgaaaccttttttacggatataatgcgataataaagaacctttgacagagcttaaatcttgagccagctctgtaacaacagctgggagcaggaacaggaaccgttgtaaccttttgttcttctatttttgtcacaactggggtttcctcaacagctggagaaactacagcgatntcttccaaaactttatgctggatccctgggactttcacagcactcttctccaaggattttgctaggaaagcttcttgaaacctctctaaggctttttgtaccaacgattgtaaacctggaacatccttaaattcttcagactgcgcaagattcattttcttataaatggcgtctaaatcaatatcctctatctttttctgcaactcagcatctgcaaaatccatagcggaactcaatagatctaaagctaattttttttgcccttctttttgattgtataggtccaaagccccaacattcttcacaaaattcttcgcaacataaaaaacacattgcttgggaagagcaatttctatccacttaccctgagctgcgcccaaagtctttacaacagttcctttagacaatcttgctaagataggagcagaagtcgaaggctctaaccgaacattaaccttctccccttcaatcacattatcgagaacaaaagttcgaaatacataaccacgaactccttcaggagcagctactacgtagtagtctttgctctctcctagaacagctagacagtcacctttagataactctttaatgataaaactatccgtatgcggagccaaacgtaaacgcacacgatttcctttgatctctcctgtaaacggagagaaagccgctctatcaccgacagaagcctcaacttttgctttggaaagatccgcagcacataagcaggcatctgccccacaagaaagggcaaaaatgagcatagaaatagacaacgttcgcacgcaaaaactcctgcaattcgctaaaatctgagcctccaatgaggcattcacagctctagaagactcatcctctagagagggaattattattgacttaaaggaaaaagtcaaccgcgactgttcgatcttttactctgaaaacgccagtcttctttggactattcttaagtataaagaacagctttcacgtgttcacagtatggctgcccacatgtgcatccaatcggcgttnctaaatacacattaaactgctcttctggattcagaggatctgtaacngtgtacatcttttctccactttgagagatatcccatgaacganaagtgagatcctcatccgatactccggcatcctcttcttccactgtagctcgtccaatttgacaatgcaaacagttgcaatgaggctctggcttagctaaaatagaagttggtcctatagataatgaacgcatcatttgcgctatcctctccagtaaatcggtaggaagatcaggatgatccttatgttctggagaatgttgcaacaacatattaatcgaaccagctcctcctagtaacatagaaaccaagcccttttgagaaaaaacctgtacttcgcatccattagccatttgttgaatagctcctaacaaagagctaattttttcctcttccttgtttttctgaggcgctgtggactctaaatatagcaagtgctcttggaacacctcatcaacaatcgcttgtcctcagattaggtatagagactgtctctccatcaattaaatggagtttcaaagtaatatccccttccgtccctccatcacaagactctatgaaagctatctgattccatcgagcagaaatgtatggggaaatacaaatgaactgatcattaattttgactttcataacaacctccaacagaaggactcgctttcctcggcattgtagttaaggggtacatttttgacaaacagattagcacacgcggaggttgattgctaaaaaccctctctcccgacttctctctaacaaagacatgttttaatttttctggatatgatacacaatcaaagtactatctcccccttacacttgagtcatttaggaatttgtaatgaaaaaaacctctgttattgataccagcgttttgatttacgatcctaaggccctttcctctttttctaacactcgcatcattatcccttttacagtaatcgaagaattggaatcctgcgcaaagtttcgagatgaatcagggaaaaatgcttccagagcattgagcaatattcgtctattactagagcagtcggaaagaccctcctctggtcaaattttattaaaaaacggcagcgagttatgtattgaagtctctcctctagtcaatctttcaaaccacgagaaacagaaaaaacacctcacgctagagctactccaaatcatttctcaacgagagcctgttgttttcgtaaccaaaagtcttggcagacgagtccatgcggaagcactagggatcgaagctaaagactatgaaaataaatgcgtatctttccgatccctttaccgtggacatagaaaactaaaggtagcgaatagcacaattgaatatttctataaggatggctctatcgccttcccttcagatctatctcctttaccttctcctaacgaatacttttttctttctggcgactctgataactattccgctgttggtcgctatagctctaaagataacaaaatcctatccctcaagcctgctccagaaaaaatttggggtgtcaagcctttgaacatagaacaacgatgcgctctagatctactactaagagacgatattaaacttgtgaccttgatgggacaagctggatccggaaagacaatactggccttagcggcagcaatgtaccaagtgtttgagaaacctaaatataacaaactcttagttagcagacccattattcctatggggaaggacattggatttcttcctggtataaaagaagcgaagctcatgcattggatgcaaccgatctatgacaacatggaatttttattcgatgtgaataatatgggcgacttttcagaaactttgcatagtttaatggaaacaaaaaaactcgaaatggaagcgcttacttacatccgaggacgctctctacctaaagtatttatgatcatcgacgaggcgcaaaacctcacaccccatgaaatcaaaacaatcatctctcgagccggaaaaggaacaaaaattgtgttaaccggcgatcctacccaaatagatagtctatattttgatgaaaattccaatggtctcacctacctagtaggaaagtttcaccatttacctttgtatggacatatgtttatgacccgaacggaacgttccgaactagctgcagctgctgcaactattctttaactttctcaaagaaaaattgtgatttttcgctatccccatctcttttgtttgcacaagatacaaggctccttttcaagagccttgtaccctactgcaattagtaaatcgaagggaaatctgttttgcctctgaacacccggtatatgtatatcgcgtaagcaacgacaaacgggagcccaattaaaacaatagtgactaggtgttgtaaggttcgcgtttccgcggctgcgttaaacacggtcatagtataacgattatccaccgtagatactaataaattagggaagagcaatatgttatacgcaagtattggagacaacaagttgatacaagagagaacaaaagctttcccgtatttaccaatagagaccgctctcttttctgcataacagcaagacaacgttactaccgataataagatgatgagtggatacgctggcataccaggagcgccttcaatacgacagcacactcctagggtctgaggcatccctaaaatagtcgcaatgagcaaggaaagatacaaaaccaagtaactagacagaacataaaggaaaatttatttttcaaacgttcgtgcagcccttctgtagttttcattaaagcaaaactaatcccatgtagagcaaatgcagcaactacaaataacccacataatacttgataagggcggaaaaatagtttccaagataaagaactatacgaagtatctggagcgatcggaaatccaactaataaattcccagctaatgtccccaggaaaaagctaatagacatccctgagatagaaaagagaacatcccagaacagcttccatcggttagactctgctttactacgaaactctagagaacagcctcggaatatgtatagcatgaccatnntccaaataggcatgtaaaagatggaaagcagggttccataagcggtcgggaaccctgcaaacaatccagcaaacatgatgacaaaccatacttcattgccatcccatacggggcctattgagtttaagagtagcctacgttctttctcatctttagaaagaaaatagatcgtgctcaatcctaaatcaaatccgtctcctaaagaataagcaaatacagcgatgcaaagaataacataccaaacaacaggaagaatcgttgctaaagaaaactccataaagaaggccctcacaaatctacttctataaggtcttgctcatctggtccctcacctatctttttcaaaagaagcgagacaaagacacttaataaacaaataaaaataatcgaaaacagaatcaaagactgccaaatttgccctgcgttcacgataggagaggtcgcatctttagtttttaataagccataaacaacccaaggttgacgccctacctctgtagaaatccagccgatttcattacataactcaggaaatagcacagagagggaaagtatccataagatccccttcttgcagctccaagattttttcttatacacagcaaaggctatcagagctaaaagtaccattactccccataacatgaccattaagtgatacgtttgaaaaacgaaagcgacatttggccattcgtctttagggaactgatccagtcctgtaacaggagtttttgcatttcggtgaacaagaagcgataaaccagaaggaatggggatcccaatgactcgctcttttttcatatctacaatgccgagtaaataaattggggtgtgttcttgagtcttaaaaacaccttcaaacgcagcaagcttggcaggttggtgtttagcgacccctcttgcagtgacatctgctgaccaaagctgcaaagccaaaacaagaaaagcacaaaacatgctgatttttaacccctgattcgcaaaatctttatgccgctctttacgtagatagtgagcactaacagaaagaacaagaaatatcccagataaccaagcgccaagaacaacatgtgtaaaacgctgcaaagcagaaggagacaacaccgctgcccaaaaagaagtcatttggggaactaacataccattacgcatgaccatttcataaccggaaggcgtttgcatccaagagttcgcacaaacaatccaaaaagcactcatgtgagcgccgagcgcaaccatacaggctgaaaaaaagtgcattttttttgatactttatagcgaccaaataacaaaactcctagaaatccagattctaagaagaaagcaaacattccctcgctaccaaggaacattccaaatacgtttccagtatattctgcgaatcgagaccaatttgctccgaaggaaaaaatctgcatcaatcctgtgacaacgccaacaacaaaagttaaggtgaaaatcttaatccaaaaccaggtcaactgcttataaatacttttttttgtgaataagtagagcccctccataagaacaatcattatacttaatcccaaactaatggggacaaacagataatgaaatccgataaacaacgcaaactgtactctcgccaatatctcagcactcatatttggctctccaaatcaaaaacttctagtattctttttagtatatatactatgcacgtttccctgtcaccagttgttaaaacagcccttttccacaaaatactttgccattaactgtcttccagctaaactagggatgagtcctttcccaaaggccttcttaagaccttccttgacttcggttcatccgtaataagtttcaaggagttggtacagcttcttgttttgctgaaaataatgaaaacacttcaactgctagggttatcttatatagatgttcgtaggtataacgtattacaccacacctctgttggagatagctttaatttgggtggtccttaattatttgctaaagtttttctggggaacaggcgccatggacctcgtctttggcttgttgtcttttctttgcctatttgttctagcagaaaaacttcatctccccgttattcgcaatttgatgcttcatgtagtgaatattgcggctatcgtggtatttattatcttccaaccagaaattcgccttgctctctctaggatacgcttgcgtagagggaaatttgtcatcaatatgcaagacgaattcattgaccatttgacagcatgcatctatcgcatggctgaacgacaaatcggagctctcattgtattagaaaatgagcgtcttttgaatgatctgcttaatctctctgctgtgaaaattaatgcagatttttcagaagaacttctcgaagctatttttgagccctcctcccatctacatgatggagccgtgttaatgagaggcgagactatctcttacgctagagtaattcttcctcttgctcatgataccacacaactgtcgcgatccatgggaacgcgtcatcgtgcagcactcggtgctagtcagcgtaccgatgctctcgtgattgtagtatcagaagagaccggtgcagtttccttagctcgtgatggaattttaactcgtggagtaaagatggatagatttaaagccatcctgcgaagtatcctaacgcgcaatgaacgaaaaacaaaccctattatctcctggatgcgtaaaaaatgatcaatttcgtctcttggatttctcgtaattggctccaaaaactcgtttctttaggttttgccattattatctgggcgcttgcaaatcaagtccattacgataacgagaacttttcataatattcctgtacgcgttattgatctagctccggaacagactgtaatcggattgcaggcaaatggtctgctaaagaaaaaagttgccatgatgattacagggaataaatctgttgttgagaagcttcgcccttccaatctagagatagtgatcagtgccaaaggacgaactgaaagttggatagaaaccatcgatccttacaacttagtatgcttggacacagacatccatttacgtaaaaatattaaaagcgtcacatcggaagacattttcattcgtctaacccaatttgttaccgaagatgtttctgtcactatcactaaacccataggcagagctcctaaaggatatgaatacctagacacctggcctaagtatttagtacaaaaggtaagtggtcctaaagaatacgtttcttctttaaaagatcatggtttggaattaacttttaaccttaataaagtttcttttgaagaactggaccgcaatcgtctagctcaagggaatcttgatgaagtagtataccttgtccctgaagactggaaaaaagtttatatacctttcgacaatagctacatggaattgaatgatccgcaagcagattttttgcgacttcttttcttaaaacaagaatttattcctcttaatattaatcttccggtccttctatttttccctgtagaaaatagtcaacttgtgaacccacaaaactactatcttgaagagaatgctcctctagtactcaatcatgggatctaccaaatggacctaccgctttatgtaaaagatgtcagccatctgttcctagatgttgtaaaaaataatatagcgctcactattattatggagcctcctgtaaaatctcagcgagaacacttcattcattgggctgtagaatttctagacgagaaaactttagagaatacttttgttcaggcagttatggctcaagaacaaaagacgaataaacatatgatccttgacgaagcaggtattcgacatcgctttagagaatacttacgaaaacttactctatttgatcaaaatggcgaacctttaccttaacggcgcgtacgtcaggaaataaagtgattatttcaagtagcgtcatcctctctaaagaaaaaatcttcctgatgctatgatgagcgtttttcaactgaaacagcgttttatataaagaagcttttacgtagagcctgtctcgatcacaaagcttctttctgtaactactagcaaagtcatactagccttacggaacacatactatgctctttaaaagattacgtacggggggaaaaattctcgtcgatcatctcgtttatggtttaggtcttggagtcctgaccatcttacgattacttcctcgatcctccttacgactttttagcaaagggctcggaaccgctctcttctatttcatctctgatttccgaaaaacagctcttactaatttagctttagctttccctgaaaaaagtttcgccgaacgctatcaaattgcacgccaatccgtacaacagatgatcattacgtttgtagagcttgcaactgtagataaattcgccaaacatatcgatgaaatgattgctattgctacttctgaagatgctcctgaaggtttctttccagaagaagtttcctcacaacaagaacttgaccatttcttttcacgtttagatcgacaagaaggagccattttattctgtggtcaccaagctaactgggagctccctttcctttacattactaaacgctatccggggctggcttttgccaaacctgtaaagaatcgtcggctcaatcaaaaaatcatttcactgcgagaatctttccaaggcaaaattgttcctccacagaatgcaattaaccaagcgctacgagctctccacagaggagaggtagtcggcattgttggggatcaagtattactttcttcggaatattcttatcctcttttcggctcccaagcttttactaccacctctcctgctttgcttgcctacaaaacaaaaaaaacagttattgctgttgctatttaccgaaaacctaatgggaactatctggtcgtccctagtaaagcattccatgcaaatacagagctatccatacgggaatctacagaacagttgatggatcggctcatgcgatttcttgaaaaagggattacatgcaaacctgaacagtggttgtggcttcataaacgatggaaaagaaagctgcgacataaattcaaacgacgttacgcctttagtcacattctcatcattgtaaagggaacttcactacaagcgcttcaaagattcttaatagagtttggagagttttatgcagacgcctctctttccttagcaattataggagctaccgatacagttcttgcaaatagctttgctccctactctttgcaatttttctcttcagaagaagagctgttagctgctccaaactttttcccggccattgtggacttattcggattgtctagaaagactcgcctgcattacaaaagaaccggatcgaggaaaatctttacgcgtaacgaactaaaagattctctcctacagaaacaatcgttaatacaaagttttcataagttactacgaagagtggatacccgttctagaaaaggttgaatagattccctagccaccaaatacaagctgcacctacgacgaagactccagcccagcctagatttaaccaactacggatcgctttctcaggagaatttcttcctcccatggattctaaatcaagcagcatgtccatattctgatcagaaaattcctgaaaaattttcaatacataaggatgctctttcagcaatctatccccatccatatccaaaaaagctgcgtattttttcataaaaccttgggcataaacaggagaaattaatttcccgagatgtcctgcttctatagcctctaatgcagacaaacgaatagatgtggcagcttctacatcttttagagaaagcgctctttcttctctttgcgaacgaaaaacttcccctagatgtaataactctttgtggacatgttcgctcatgtaattcccctggtttgctctctacccataaaaaggaaaggaggctgtcgttactgaaataaataggcctcttagatttcctcttttttagtatcaaagtttcctagactttttctcaagcgttacacttacggttttattcttcgcagaaaattttttcgatcataaagatttcaggatgatagaatatgaagaagaatctacggtaacagctcttccttttcttaaaattagaatcttttttcttaggtgatcatgccctcctctttcgtttcgcaactgtctccttctttattttctatacttcgagaacaacctagaaaagaaagggttcaccatctctatccccccccacactgtatttcaaggaagatctccgaccgttagctgcactgtatatcaatctgggaaaattgtagtacagggtaaaggaactcaagaatttgtagaatttttccttgagccagagattctacaaacgttctcctcacagaacgtacaacaggatttacgttctcgcattggtgtggatgaatctggaaaaggagatttttttgggcctctgtgcactgctggagtatatgcttcttccccacaagctatagaagctctttataaaaccagcatttgtgattctaagctcattcctgatgctaaaatcctttctttagcccaaaacattcgctcgctttgtgcgtgtaaagtcattaccttgttcccagaaaaatataacgcactatatgccaatttccagaatttaaactccctcctggcttggacacacgccactattatcgataatttggctcctcatcctgcaggagcagtctttgctatttcagaccaattcgcctcttcagagagagtccttctacaggctgttcgcaagaagcgctcggatattgaattaatccagcgtcatcgtgcagaacaagacgtggtggtagctgcagcttccatcttagctcgcgaagttttctctcttccatacacgccctagaatctcaataccaaatccgccttctaaaaggagcttctgggaaagtcaagcaacgagccaaagagattcttcataacaaaggacaggttgtattagaaaaagtctgtaaaacacatttcaaaacattcaatgaggtgcttggttcgggcaatcaatagaacaaacttaccttgttagaaatgcaaatttgcagaagctccaaagaacagcgaagaaccgaatttgtagatcttttcgtcttcgttatgagcatttgccaatgaaatatcattccctacggaaatagcctccaaacattttgaggttttgtcctggccaaaaaatcagcttgatattcccttctatttctcttcctgaatactcaaaaattccttcagaggtagccaaagaatttttagggaattttttacgaagtcgtgtcaggcgatatgctactcctaaatcgcaaacaggtgtgcactggtattctgcagaaaaatttaccgggtagatacaattgagtgtgagtctatcttcaggtttataagagaaccctaataaaggccaggcttgcttatcatgtagccctacctcattaatgactcccataatcacagataacgatttcgaagcatgatattttgaagataaaactacctgatagagtcctgagccaatctcaatattttcagggtctaccataccagaaaaaagtacagaccactgccaattcgtaagagctagtgtgtaggctcctacagacaatgtgatatactgataaaaagatttgtcttggaaagcgaaatatcctacagcttgcggatctgtatcttgcagctctttagagcttttccaagagacttcagctcctaaataacgagacgataaaagaaatcccgacatctcggtaacgggaatcgtagcaaacaacgaggtatccgcctgtcgatatcctaaggattgatctgggagagttttgaattttgcgttctctatttgcaaaaactggctctcaaaagaaaaagctctcagaggaggattcttgtactcatcccgatctttcccacaagcatctccgacgatataaataggcgtcgataacaaatgcccgaaaagcgtcatcgtgtggaaaagaactttaagcataccactccatcatacaatcagcttatctccctagaattgggagttcttcctcttgtcaaacaaatatttaggatctggtagatcatactgcttaataaaatttttagcaaacttctggcatagttcttgagaatagaactgattgtacaaataaatcatttagaagcttttcttcgctagtaaatcctagtcaaaactgattaactataaataaaatagatacaatttatcgattttttgtcagaatatctctcgcatataaatttttgtgcccgcaatgcgggcttaccatacataacacctagttggaaaaatgccctccactgttgcacctataaaaggacaggatcactttttaaatttagtttttcctgaaagagttgccgctgcctacatgagccctctagctcaaaaataccctaaagcagcattatccatagcctctttagcaggatttcttcttggtatactcaaactgattactttccctgtgctttgtgctgcaggcttatttgtatttcctatcagaggtctgatctcctgcctattccataaaagctttcagggttgctccggatatgttctagcaacctttctgtcccttttctccttagcgcttaccattgtaggcattgtaagttgtatcacttgggctccaggatttattttccctatgatctctgtcagtatcgctttcgctactgtagagacatgcttccaaatctacacccaccttttcccagctttagaacataaaccaagttcttcccttaaaatcgaaatagcggctgccaagctcccccgttcctcctctgctcccgatctgaactgcccctctttgccgacccagtcagcctccccttcccaacgcttttccgcttaataagaagtgctagaatctatgtaagttaaaatctttacgaccaaataaaaattatctccctccaatctctttggttattttatactagattctagtactcagcgttttttgtttttgggataattttatgactccagtaacaccagtccctccccaatctccccaacaggtaaaagggcttttatccaggtttctgacggcacccgatcgtcaccccaaactacgctatgtttacgatattgctcttatagctattagtattctctgtattgtgagtatcattctctggacacaagggtctgggctcgccttatttgcaatcgctccagccttagctattggagccctaggagtcactctgctagtctcagatcttgccgaatcccagaaaagtaaagagattgctgataccgttgcggcagtctctcttccttttatcctaacagggacagctgctggattgatgttttctgctattgccgtaggcaaaggcgctgtaatcttagcgaatcctctattcctaatgggctctatgactctcggctttgctctgatgtctctgcatagagtgacctatcaatatctcagtaatcgcgagcaatggaaacagcagaagaagctcgaacaagttgagttagctgcctgggagagccatcttcctaaagaaagcaaatcctccgctctggaagaggttcgctattcccctcgtttgatgaaaagagggaagacttggcgaaaacgggcaatcagaagaaaaaactatatacctattccgttggtcgacaaaacattgcaaaccatgcaaccggatgcactcttctcctctacaaccacacattctacagatagtgagcagattctaacttctgtcagtcctcaaagctcagataccgaatcctcctcttcttctagcttccacactccaccaaatagcgataaagaactgtccgactcgaattcttctgacagcagctcttcttctgaatatatggatgctcttgaaaccgtagctgcaggagatgtctcaggaataacccctccatccaaaccctcttcttctccgaaaacgacacgccgcgtcgtaaagctctctcgcagcgagagaaatgctcagcatcatcgtaataaagaccaagagcaaagacaagacagcagcgaatcttcggatgaggaatcctcttccgattcatctcaaaagaagaaaccctctcgtaaataatattggaaaagcgataaagccttttaaaaagagaaccctctccatagttttatgaagagggttcttctcttttatgccttttttgaggatgctgcaaattacatatctcgcatagctgctaatagcaattcgtttactcgcttaggaggagctttcccttctgttcgcttcatgatctgtccaaccaaaaagcccaaagctttagctttcccgttcttgtaatccgctacagacgcggtattttgagcaaccacctctttaacgatagcgtagcgcatggtcgtccgtcataggtaacaacgaaggatgtctacgcaaaatatcttctgggctttccccaaaagaagagaccattctatctgcaatttctttagcgattttccctgtgatcactccacgaactatgaagttcaccaattgcgctacccattcaggaagaatccccgtgaatagcagcgtcttccctttagctttacaacggcccgcaaattcgactgtgatccaattcgaaagagcacgatagttcttacaagacatagttgctgtttcaaagaaatgagccgtatgtcgatcaccaacaagaatcattgctaaatcttcagcgatatcaaagtctgtaatgtaacgcatatatttactatgaggtagctctggtaatgtttgacgcacctcatcaatataagtctcggtgatctgcaaaacaggaagatccggctctacaaaatacatataatcttcggctcgttccttgagacgcatcagaaccgtttttttcttttcaggatcccaacgataagtcgctgcaggaacaactttttttggatcctcattgggatggctaagatactcttcaatctgacgacgtttttcagcttccaaagcttgtgccataaaggtaaatgagttcatgtttttgatctctaccttatttctaagctccctacttcctcgagggcgaacagaaatattcacatcgaaacggatagaaccttcttccatattacaatcggaaatacctatgtagccgaggatggataccaaagcattggcgtatgcaacagcatcctctgcactaaacatacaaggcttggaaacaatctcaattaacggaacccctgctctgttatagtctacaccagcaaaatccccaaaatgttttaacatccccgcatcatcttctagatgtgtctgcgctagntcaaaggttttctcttctccttctactacagcacgaatacatccacctcttacgataggatgctcgtattgggtgatctgaaagtttcttgggctgtcaggataaaaataggattttctatcaaaacggctaaataaagcgacatccccctctacagcgcagccgaacaaaacagctttacgcacagcatccttattcaagaccggaagagatcctggcatccctgtgcatacaggagaaatgttcgtgttgggttcatcaccaaaatgattacgtgcgggactaaataatttggattcggtattcaattcaacgtgaacttccagaccgatcacagactcccattcagtatgtgctatgcccatattattctattcctccgtcaaaaagtccattcactgctttaggatataattgtttaatttgcgagtgttcctggaagctgtatcctacttgacaaatctgctgatccgaacctctttccccaataaattgaacacctaatgggagaccttctttagacagtccggaaggaacggaaatggcaggtaaataggccaagtttaccgctacggtataaatatcctgtagatatagagaaaccggatccaaaacatcctgatctctgatggcaggcgttgcgcatacaggcatagcgatcacatcacagcgctcaaaagcagcttgaaaagcgtctattaagcgagcacgaactgccattcctttcttataaaagatgttttgtctttctgctgaaagcacataattccctaaaagaattctacgagttacttcttttccaaagccttctttacgagaacgcgcatacatttcatgcatgttatcagcctgcgcacaacgatgaccataccgaacaccatcaaaacgggctaagtttgtggcagcttctgcagaagcaacaatatagtaaacaggtaccgcatgtttcaaaacactgagatctacatcaataatgcgactgccttcacgttccataacagcaagagcttcgaaaaagttttctttacaatcttcttgcagtccgtctaggaatcctctaggaactccgattaacttaggaacttccaatgacaaggcttgcgaaaacgtccctttaaaaaagtctctcgtagtggaatctttgggatcacgaccagcaaaggcatccattgccagagcgacatcctctaccaccgttgtcaatggtccaatctgatctaaagaggatccaaaagcgactaatccgtagcgagaaactgctccataggaaggtttaaatccaacaactccacaaaatgctgctggttgacgaatcgatcctccggtatccgatcctaacgcgataggacagaacctcgccgaaactgctgccgcggatccacctgaagaaccccctggaactcgttctaaatcccaaggattattggtaggatgaaaagcggaataccgagttgtggatcccatggcaaactcatccatgttcaacttacccagtaaaatcccgtcttccatctctatacgtctcaccaccgtggaatcaaagggagccacgaagttttccaacattttcgaagcacaggttgttttcactcctgtgatatgaatattatctttaactccgatagggattcctgctagtaaccctattggatctccttttgctagtttgtcatctatacgtgaagctctaagcaaagcccgctctttacagagagaaagaaaagctccaatctgttcgtcatgactttctatacgatgataaaaatattctgtaatcgctgtaactgaaagctctctgttcactacagcatctcttaattctaaagcactcttacgatacatagcgattccacctatttgataactgtagggactttgactaatcctcccaacgacacgggaacgttagataaaaattcttcttgagtaaaatccgaagtcaccatgtcttctctaagatcctctggaccaacgaaatgatgcactgtagcttcaagaatgatatccgaaatatctatcgcgattacttcctgcattaaagcaatgacgtcattcatagatgttacgaactcttccacgtgggcatcttccaactccaatgcagcattctttgcaaaaaaaagaattcctccttggttaaaaaagaacccggcaacctccaacccaaaaaagggcaaacaagaacctaaaaaaaaaaaaaaccctccgaactttttaaaacaaaaaaaaccttactgaagcgtcttttgcgacagcaaaacgcatctttaatagagagaacaaaaaaagactttattaaattgtaaaaaagattacaaagtcagagttaagtatacatctacgttggagagacgtcatgctttgtaaagtttgtagaggattatcttctcttattgttgttctcggagctataaacactggaattttaggagtaacagggtataaggtaaacctacttactcacctgcttggtgaaggaaccatgtggacacaagcagcttatgtagtaacgggaatcgctggggttatggtctgcctaaacttcttgaaatgctgcttcaaaaaacgtcatgaagactgctgctcctctaaaggaggatgccaccaccatcatatggatagagaataaaacgccttcctttcagattatacatcccatcttggtataatcttgaagagggctttcttttttgaataaaaaaagaagcccaccaaagagaatttcttcttggtgggcttagttttttgatacaaacctatggtagataccagtttattccctatcgacttctctatcccaacgctgcatcaggttgctaaatgtctgtgacccgttggtaagcatatcacgcagaatcccttccacctgctgactattgggaatacgctcttgcggctgtgtcactacataattgtacattcctgctacaaaagaagcataaactgcctcacggaaccctgcttctacatccatattctgtagctgatatctagaaggcaaaggtggagtaggatatgggcttctaggcaaatcatagtcgctagcacgtgggaggtcataatctgaagctcttgggtcctgatagtgcccttgctgtaccgcaaaagatcttcgtgtttctagatccatattcataacttcatagataggcatcatgatttcatagatcgaggcagatccttctccttcaatactaggaacccctcttctccaatcatctacccaaggaatatcgtaggttccatcagcaccttgctctattcccatatcatctgcgaatctagccaaagtctctgctaacgatgcaccttcaggagataggtcatcgcgaggagcgtagcgatgcgtcgatcctttacaacaagagaagcaacggcgaatcgcctctcctgcggcaactaatcctcgtgatactctagcgcagagaactcgcacatgctctccaaagctcccaaatgagaactcgatgctattacattcatttacaaagctctgaaaagcttgttgtgctctagaaggtccttgcgtctcatcgcctcccattcttgatgcggactctcgagtccatcccgattcttctatctcagtacgagccgcatcacaagtttcttgcaaacgtctaaaacgctcttctaaattctctaacatcggcatggattcttccaaagtagctcgtgctcgaagccctgtttgaatctctctggataatacaacgtctgagaaattgctcatgtccagccaaaaaccagtgtcgacgttctggagattcgctacctgaggaccatcgtaaaacatggaattccctacagtatactcacctggatttttgctctgataattaggtgttcgtcggcctaaaggatcatttaataatttttgtgcagcacctttatcttgtagatctctaactcttttatcccatctttgagcaatttcccgggcggccgctaccccgtcagggccagccaaatcgtgcgcttctaaataatccgcgcactcacttgtgtaagcagccatcaaacgagcctcgttcacatcaagattcccaaaaactacatccataggagaggtctggcgtaaaacccgagttctccagaaatctgtgaacataagacgcagccctctagctgctgaaggagaatactcctcccagaacttgcaccacgagcagtacgactacttgatccggattctacggctcttgttgcagacgatcttcttgtagagactgaaccccacgcacactgaacagctcgtcttactttgtcagctactcgtcctaaacctctttggaaacgactgaacactccacgcgaagctcttggcgtctctccactcgttggggtgctctcgatcatagagctgacgtctactactggataaggagattctctattttcgttactaagagatgaatatagagaatgaactcgatcttcaactttattattacccttcgtattttgacttctgcgattcgatccatccccattatgagaagggattcgactattcccgttgcctcctactcccccgatgctcataacaaaccaacccaaaactaaaataaaaacttattttaattttaaaaattaaaattaaaaaaatcgataataaatataagatttcttaaaagattatttaattttttaaaaactatctaatttgataattctgatttttctaatttcacaatccaaaaatcttccttaactcttcatcttgaaagacatgaaacagagcccttgaggaaaaagtctgtaaattattacttttttttgacataacctcttcttttagactcttagggggaatcccatgcgacctgatcatatgaacttctgttgtctatgtgctgctattttgtcatccacagcggtcctctttggccaggatcccttaggtgaaaccgccctcctcactaaaaatcctaatcatgtcgtctgtacattttttgaggactgtaccatggagagcctctttcctgctctttgtgctcatgcatcacaagacgatccctttgtatgtacttggaaattcctactgttggttcgtatctaaactccatatcacggaccccaaagaggctctttttaaagaaaaaggagatctttccattcaaaactttcgcttcctttccttcacagattgctcttccaaggaaagctctccttctattattcatcaaaagaatggtcagttatccttgcgcaataatggtagcatgagtttctgtcgaaatcatgctgaaggctctggaggagccatctctgcggatgccttttctctacagcacaactatcttttcacagcttttgaagagaattcttctaaaggaaatggcggagccattcaggctcaaaccttctctttatctagaaatgtgtcgcctatttctttcgcccgtaatcgtgcggatttaaatggcggcgctatttgctgtagtaatcttatttgttcagggaatgtaaaccctctctttttcactggaaactccgccacgaatggaggcgctatttgttgtatcagcgatctaaacacctcagaaaaaggctctctctctcttgcttgtaaccaagaaacgctatttgcaagcaattctgctaaagaaaaaggcggggctatttatgccaagcacatggtattgcgttataacggtcctgtttccttcattaacaacagcgctaaaataggtggagctatcgccatccagtccggagggagtctctctatccttgcaggtgaaggatctgttctgttccagaataactcccaacgcacctccgaccaaggtctagtaagaaacgccatctacttagagaaagatgcgattctttcttccttagaagctcgcaacggagatattcttttctttgatcctattgtacaagaaagtagcagcaaagaatcgcctcttccctcctctttgcaagccagcgtgacttctcccaccccagccaccgcatctcctttagttattcagacaagtgcaaaccgttcagtgattttctcgagcgaacgtctttctgaagaagaaaaaactcctgataacctcacttcccaactacagcagcctatcgaactgaaatccggacgcttagttttaaaagatcgcgctgtcctttccgcgccttctctctctcaggatcctcaagctctcctcattatggaagcgggaacttctttaaaaacttcctctgatttgaagttactacgctaagtattccccttcattccttagatactgaaaaaagcgtaactatccacgcccctaatctttctatccaaaagatcttcctctctaactctggagatgagaatttttatgaaaatgtagagcttctcagtaaagagcaaaacaatattcctctccttactctccctaaagagcaatctcatttacatcttcctgatgggaacctctcttctcactttggatatcaaggagattggactttttcttggaaagattctgatgaagggcattctctgattgctaattggacgcctaaaaactatgtgcctcatccagaacgtcaatctacactcgttgcgaacactctttggaacacctattccgatatgcaagctgtgcagtcgatgattaatacaacagcgcacggaggagcctatctatttggaacgtgagcatctgctgtttctaatttattctatgttcacgacagctctgggaaacctatcgataattggcatcatagaagccttggctacctattcggtatcagtactcacagtttagatgaccattctttctgcttggctgcaggacaattactcgggaaatcgtccgattcctttattacgtctacagaaacgacctcctatatagctactgtacaagcgcaactcgctacctctctaatgaaaatctctgcacaggcatgctacaatgaaagtatccatgagctaaaaacaaaatatcggctccttctctaaagaaggattcggatcctggcatagcgttgcagtatccggagaagtgtgcgcatcgattcctattgtatccaatggttccggactgttcagctccttctctattttctctaaactgcaaggattttcaggaacacaggacggttttgaggagagttcgggagagattcggtccttttctgccagctctttcagaaatatttcacttcctataggaataacatttgaaaaaaaatcccaaaaaacacgaacctactattactttctaggagcctacatccaagacctgaaacgtgatgtggaatcgggacctgtagtgttactcaaaaatgccgtctcctgggatgctcctatggcgaacttggattcacgagcctacatgttccggcttacgaatcaaagagctctacacagacttcagacgctgttaaatgtgtcttgtgtgctgcgtgggcaaagcatagttactccctggatctggggacacttacaggttctagttcccttgcctagcattgcgttttagagcttgagaaaagtcttagaggcccttctctaagacttttcatttttttctcacgtcgcgtatcacatttaagttctccgacagaagtgtttcagagcaaccgcatctgtaagctcacagatcccaactttgtctcgaaacctggcgattatatcttcttgcattctaggcgagaatctccctcccgatgttccatagccgggaaaatctccgtcccaatagttcaacatcaaaccagctaacctaacttgagcactctctaaacaggcatctagttgcgctctatctccaggagataaagtctctccttccaagatcgcttcccaacgtactcctgaactatataccgcataacctacaactaacaaaccacgcgtagggatatgtgactgcatccagagcgagagcgcagtaatcgatcctgataccggcttttcttttggacaacagcaacacagtaatttttttaattgtctccagcatcctgtttgatgatatctttttcgtttttgattataaaccttagcgttctctgtgtgcttagctacggttaagcatgtttgcacagcctgtactattgcttctacaagaggagaagtctcttccataggcaaattctccgtgctggtgtgagaagtgcagcaatttcgtaaaggacaaaccatgattcaccttgattttgttaaaaagcaaaatggatttaataaaaacaaggctattttatctgaattcaggagtattttttattattaaaaataaagattaccatcctagtatagaggttgtccttacaacatgtcttcttacgagctcacctagaacataattctgtctttatgtactctgctaaagacctgttcaaaactagacgtgcgtaaaagaattttttatgaaaaaaaagctcatccttttgtttgaatcaaacaaaagatcctgctctctaaaattctagagagccttcccttttttctataccatccgccctcccctatcatcgaaatgcatgaacaacctcaaataggagaaggacacaaagaattcctgggatcagaacccacttctgaaaagaaaaatctttattaaaagattctattcaagcccatagatacaaaatgtgccgtttgtcgacgacgagcatctaatgaatagttcatataagctcttccaaaatgatgaatatacaaagtatcatgaacctctaagaagaaggcatgccgtgctagcggagatccttgtataggcgtcttcactccattggcaataatttccatattgcaatgtggagtgacacgccaaatgtctggtntatatcccatatttaacgtcagtttagaaagaggagatcttcgtacatgagaaactgcatgaactacaattcctattgggagagacatattatgccccgctcctcgagcgaaatatctagttaaggaaccagtttcttgtgtagcactggaccatcctccagccatctcaaaacgcataaaccctgcaagctcataatctctagcgaactgacgagtaggaatgcagtactctaagaaattatgctcagcacctacaaacgcataatagttattgttgtgccaatgacatttcgaatgatcgaacttctgcgttttgtcattaaaatactgcgtatgcattctgtgcacagaatagccataagctgtctcccagtacacaacagtttctgttcctttaatatctacgtaacttcttccgaaacaggacaacatcgtcatgttccctgcatccttggagtaatacattcggctttttgtttgaccatatagttgtccaaaagccactccgaatatggacccattttcgtaatggcaggcagcagtcgcctggaatcccccatatctagctaaaaagccatcccgatcatcttgcgtataattcagaatataatccccgagagcatgcagagatgctacaaatccaacatctctagacacatagtgttctttcaaaccattagtaaaggtttcttaatgcagatcccgctacccaaagagagttgggcaccaattccccctttctctgaggatctaatcgatactccccgtagttggaagcgggtctccatgtcagatataaggtattacttgtattaggaggcaccatacccttagcatcaggagctaagggaggtttcgtccaatctgcagaccaagaaccttgatacccgtagtgcgcagcatctgcatcaacatcacaaacaccggccaccataaccccggatctagtactactagaagatagggtaacaaaaggaatcgtcagcgatcccacaaaaagcggattatcatagacctccgcctcattctccatcactaggtctaaagtagagcctcttttaacagtaactgttccatacgcacccagtatggcagtcttatagttaggagttaaaaaggattctaaatcaatccccaacttagatactgtacaagtataattattatttgcagcacctgcaacggcagacaacgaagctccggatcctaaactcactcgtccagaggtggctgtaatggtcccagtagttaaggtagctccttccgtcacaaccaactcccctcctgacacagtcagagttcctgggaaatttgaagtagagttaagaacttgaagtttttctgaaggagtcaatgactcggcggtaaaaatcacagatccattaccggactgattaattgtgactgcagcaggcgtagaagaagaagatggtgatggtgtcgatgcagccgctgctgaattaatttgtactacaggatcatgaaagatcagtttcgataatccggaagcattcaaagcaactgttgttccactgcttaaaattcttactgcgctgcgctctccaggacgatcactagtcatattcccagaaaaaacaatatccccatcagaagcgcttaaagtgagcttgccagtcgaaccagagctcgctgcgcttacgcagatggcgcctccttccgcagctcggtttctttcaaacagaatcgatcccccattcgtgctcatattgatagtaggagcataaatagctccaccgcctttttctgctgtattgttactaaagacaaccgaatcatctgctacaagcgagaattctttcgttaggatgcttccgcctctgccttttgcaaagttgtaatcaaaaacaatagaacctttattgccttcaaactttacagaatcatctggagagcaaataactcctccaccgcctcctgtctccgtattctgatcctgattagtagcagcaagaatccttaaatcatcgtatgctgtgttccctcggaagaatatgcctccttcattgtctttgaaaagcacaatgcctttataaaccactccgcctccgcaagaggctacgttatctgtgaaagaaactttccctttacagtttttaactgtaaaagtcgtacttgatggtgtagcggaaccactgcctccaccaccagcattattattattcttacctcgaaaaactgttccgaaattcccggcattattatcgaacatgaccccttttttgacgcctgagatctccaaactagtctctacagaaaaaatagaccctttccgagcatcactaactgttggagcaggcggagttgatgatgaggttggcacagtagataaaggagaataccccacggagttatcccagaaaatcacttcgcctgctccggaaatactcacggttttcccggagatcattcccttttctccgcaagaaacatttttcgagaacatcagactcgaaaaatctctcagagtaagtgtctctcctgctgaaatgaaggcataattttgaagaactggcccttgagaatctgtaaatgataatgtatggttttgtccggtaatcgttaaattgtcgccattagctgagataatcgaaccttcttcagctcctgcatagacattgacaaaagcgcagtctccattcaagtaaacatcgtctcccttaaaaggagtggttacattaggcgttaacacttgaggagagctcgcgaatccatacgaataggaacacaaacaagctaaaaaacaaaatgatgtagatctcaaagaaaaaggcatcgctaacacttaactatctaaccaatatttttagaaccggactctacttcctgcactcaaaccatagcctcgagaagcatctcgatactcatatcttccatggccatatacttctatattacttgttagagaagcatacatagatcctctaaccacaactccatgtcttgctaaatgaaaggcatctgttgtccatgtctcttgatgggataggagcgttgtctcagtaccagagatggtgcgataagcatcacagatataagccgccataaagctatatttattaggatgtgtactagaacatcgatcaaacttcactccaacaggaactgatagatttaggagatgtccgctcttgaatgcccgagcttgatcgccttcctctgtaaaagattcatgatcggcataagaaaactcagcttgcacgaaaggacgcaactcattcaaatagagctatgatggagtaatcacaatcggtaatcccgctccaatctctccagccagacagttattatcccaacgaacatcgctctcctctgcaaatgtatatgaggttttcatatgctgattcccaaacccgtagctagcacggataaacgcatctccgaacaaataggatccacataaagcttgttgggtagatagataaacggatcctatgcaagcatgatgattggaacgacacactacataatctttagatctaccaaatacttcggtaaatgctagaccaaacatcgatgatccaaagtaggagtttgctcctaaggaataacccccactaatataccgatatccctgacctaaagcatcgcggtcatgatagaagaaattcgaaactccagaaacccataatcctcgacaataagagcgcccatccacacttgcttgaattgctgaatgcgcagatcgtatatctaaaatggatccccataaactatttggaaccaaagaagctactcgctcaggcccaggattatacccagttttagtccatgtagctttcagagtataaggaccattatttgctgtattaagaatcccacgcaagcttccagcttccttgatagccatacttaggcatctcattccctagagtcaaatctgatggggcattagctgggggcttagtccctaactgtaatttcaggacattgattttttgattagaacctagccaatcatacctatcattaagctgtatcatccaaatcctcaaaaaagataggcccactaattgtaacagaaccagcagttgtgctaccaatgactgcaggattgagaatcttgcgctggaggattggtaggaggattcgtaactgcattgtttgctaacaaagaagaaagagacaaatgcagattggaaagcgtgatcaactgattagcggcaggaggctgttgtggtggttgtggagttacaaaatccaatgtactcccagcttccatatacagactcccacctgtctgacttagagaattcactgataattttgccttttcacgaagaacaatccttccttgctctatcgtaacattttggtacaaagtactgcttccattagcaaaaacaatatcccctgtgtatccttcaccatcgttaatttttagaagtttggaagactgcgctggctggttatttccgtttgccatctcgatgggatcattaaagagaatctgatgccctgctttagctcttaatgtcgttattttccctcccgatcccatcgaaatggcttgtgaggacacagttacgccattaacatcggcagcattctctttggctgttcttttaagattcccatcgaaaataatatctccataatcagcagataaactgagctctccagattctcctaaataaatcgctccaccatcattagcgatattccttaaaaattgtacagggccacagttagcaaccgagagctttttggcataaatagctccccctttcccagcagctacattgctactaaagaaaactactccctctccatcaaaggaaactgatccagagttattggatcctacctgcgcaccattcttacagaagatagctcctccatctccgtaattattactcgtattagaagcctgtccacttgttggttgcttagcagcaatgtaaacaggaaaagcaacattgttgagaaacaaggtttttccattattcaggaaagcaacgttcccgtaggagtaaatccctcctcctactcgggctacgttcccatcaaactctaccgcagtatttctggaaaaacttactactggatcttctgttgaagtagatgatgacactccctgctgcccatcctgaacagcagcaatccctccccctcttactcctgcaacattcgctacaaaggcaataggagcctcgttagccatagcagagaaactggtgactacttgacaagctcccccatcagcttgagcagtattttcttggaagacacaaagcttgctaattccttgaaccgttaagctcttagcatctatagctcccccatctccagagactaaattactatagaatgagaacttctcattattgagtaacaaaagatctgttttagaataaatagtaccattagacggtgtagatgttgtcgtcggagtctggctacccttattagtcgttgcagcaggcagtacggcaagtaatgaattgcaattggaaaaggataattctttaaaaccctcaatagtaaacagtccatcagcagcgctattacttagagctgccccatttgtagaagtccgtatgttctcgaaagtcaacgagtgtcctctccctaaaacagtaaaactccctaataagttcccaaaaacaacttaaaggcaaagctgcaatagaattgtcaaggattttttaatgttaactctcctgcagaaaaaacagtagtcccactcggatctcctataacagtatagggaaatgatacagttaacgtctccccatcgtaaattccttgaggaaccatgatttctgctgcatatccccccccatttaaagagcagcaagaataagctagaatcattgaaagaaagaacttatggaaagacgtttgcatcacacaaaagctgagagataaaattaattactccgcttcataaaaaattaataatttaatatcaataaatgttcttatcttcagcgcattcgtccttttctctttacaaaatccaataattacactatttgcaggctaaaataacatcccccctttaacctgcgatgattaaaagaacttctctatcctttgcttgcctcagttttttttatctttcaactatatccattttgcaagctaatgaaacggatacgctacagttccggcgatttactttttcggacagagagattcagttcgtcctagatcctgtctctttaattactgctcaaaatgtcaccttttcaaatataaactcatggggaagaggagtttgcactattgcagacaatacgcaaacgcaaatcttttctaattctattaacactacctctgctgctggaggggtttttgatatggttactatctcattcacggcctctaataatgctaacctactcttttgcaacaactactgcacacataacaaggggggaggagctattcgttctaaaggccctattcggttctcgaataatcaagacgtacttttttataataacacaacagccggagctcaatatacggggacaggaaataaaagcgaaaaaaataggggtggtgcgctttatgcaaagaatatcactctgacagggaatcgaactctcgcctttattaacaatatgtctggagactgcgggggagctatcgccgctaacactcaaatatcaataactgatactgctaaaggagttttatttgagaacaatcacacgcttaatcatataccagatacgcgagccgaaaatatggctcgaggaggagcaatctgtagcagaaaaagctcttgctctattagtaataatctcggtcccataatttttaactacaaccaaggtgggaaaggcggagctattagcgctacccaatgcgtcattagcaataatgaagaaagaattgttttttcaaacaatagttccataggatggaacaaatctactcatgcaagtaacggaggagccattcaaacagcacaaggatttactttacaaaacaataaaggtcctatctatttcgatagcaataccgctgctcatgccgggggagctattgactgtggttacattgacatccgaaataacggtcctatctattttctaaataactctgctgcctggggagcagcctttaatttatcgaaactgcgtccggccacaaattatatccatacagggacaggcgatattgtttttaataataatgtcgtatttaaatttgatgcgaacttattagggatgcgaaaactttttcatattaataataacacgcagacaccttatacactatcccttggggctaaagaagatactcgtatctacttttatgatctttttcaatgggagcgtgtgcgagagcctaataatgctcaagtatcccccagtagtagaaatgtaatcactattaatcctatagaagagttctctggagctgttgtattctcttataaacaaatgtccagcgacataaaaactcttatgggaacagaacataattatattagagaggctcctactaccttgaaatttggcactttagccatagaagatggtgctgaactagaattttttgacatcccttttacccagaatccaactagtctacttgctttaggaagcgacctacgctgactgttggaaagcacggtaagctcaatattacaaatcttggtgttattttacccattattctcaaagaggggaagagtccgccttgtattcgcgtcaacccacaagatatgacccaaaatactgataccggccaaactccatcaagcacaagtagtataagcactccaatgattatctttaatgggcgcctttcaattgtagacgaaaattatgaatcagtctacgacagtatggacctctccagagggaaagcagaacaaccaattctatccatagaaaccactaatgatgggcaattaggccccaattggcaaaattctctgaatacttctctactctctcctccacactacggctatcaaggtctatggactcctaattggataacaacaacctataccatcacgcttaataataattcttcagctccaacatctgccaactctatcgctgagcagaaaaaaactagtgaaacattcactcctaatagcacaactacagctggcatccctagtattaaagcttctgcaggaagtggatccggatcttctactacaactgatgtacaagttacccgacacactcttactgtaaactggaccccagtcggatacatagtagatcctattcgtagaggagatctgatagcgaatagcttggtgcattcaggaagaaacatgaccatgggcttacgatcattactcccagataactcttggtttgctttgcaaggagctgcaacaacattatttacaaaacaacaaaaacgtttaagttatcatggctactcttctgcatcaaaagggtataccgtctcttctcaagcatcaggagctcatggtcataagtttcttctttccttctcccagtcatctgataagatgaaagaaaaagaaacaaataaccgcctttcttctcgttactatctttctgctttatgtttcgaacatcctatgtttgatcgcattgctcttatcggagcagcagcttgtaattatggaacacataacatgcggagtttctatggaactaaaagatcttctaaagggaaatttcactctacaaccttaggagcttcccttcgctgtgaactacgcgatagcatgcccttgcgatcaataatgctcactccatttgctcaagctttattctctcgcacaaaaccgggtgctatccgagaaagcggtgatctagctagattatttacattagagcaagcccatactgccattgtctctccaataggaattaaaggagcttattcttctgatacttggccaacactctcctgggaaatggaactcgcttaccaacccaccctatactggaaacgccctctactcaatacactattaatccaaaataacggttcttgggtcaccacaaatactccattagctaaacattccttttatgggagaggttctcactcccttaaattctctcatctgaaactatttgctaactatcaagcagaagtggctacttccactgtctcacattacatcaatgcaggaggagctctggtcttttaactatgaaaaaagcattcttttttttccttattggaagctccctatcaggactagctagagaggttccttctagaatctttcttatgcccaactcagttccagatcctacgaaagagtcgctatcaaataaaattagtttgacaggagacactcacaatctcactaactgctatctcgataacctacgctacatactggctattctacaaaaaactcccaatgaaggagctgctgtcacaataacagattacctaagcttttttgatacacaaaaagaaggtatttattttgcaaaaaatctcacccctgaaagtggtggtgcgattggttatgcgagtcccaattctcctaccgtggagattcgtgatacaataggtcctgtaatctttgaaaataatacttgttgcagaccatttacatcgagtaatcctaatgcagctgttaataaaataagagaaggcggagcaattcatgctcaaaatctttacataaatcacaatcatgatgtggtcggatttatgaagaacttttcttatgtccgaggaggagccattagtaccgctaatacctttgttgtgagcgagaatcagtcttgttttctctttatggacaacatctgtattcaaactaatacagcaggaaaaggtggcgctatctatgctggaacgagcaattcttttgagagtaataactgcgatctcttctttatcaataacgcctgttgtgcaggaggagcgatcttctcccctatctgttctctaacaggaaatcgtggtaacatcgttttctataacaatcgctgctttaaaaatgtagaaacagcttcttcagaatcttctgatggaggagcaattaaagtaactactcgcctagatgttacaggcaatcgtggtaggatcttttttagtgacaatatcacaaaaaattatggcggagctatttacgctcctgtagttaccctagtggataatggccctacctactttataaacaatatcgccaataataaggggggcgctatctatatagacggaaccagcaactccaaaatttctgccgaccgccatgctattatttttaatgaaaatattgtgactaatgtaactaatgcaaatggtaccagtacgtcagctaatcctcctagaagaaatgcaataacagtagcaagctcctctggtgaaattctattaggagcagggagtagccaaaatttaattttttatgatcctattgaagttagcaatgcaggggtctctgtgtccttcaataaggaagctgatcaaacaggctctgtagtattttcaggagctactgttaattctgcagattttcatcaacgcaatttacaaacaaaaacacctgcaccccttactctcagtaatggttttctatgtatcgaagatcatgctcagcttacagtgaatcgattcacacaaactgggggtgttgtttctcttgggaatggagcagttctgagttgctataaaaatggtgcaggaaattctgctagcaatgcctctataacactgaagcatattggattgaatctttcttccattctgaaaagtggtgctgagattcctttattgtgggtagagcctacaaataacagcaataactatacagcagatactgcagctaccttttcattaagtgatgtaaaactctcactcattgatgactatgggaattctccttatgaatccacagatctaacccatgctctgtcatcacagcctatgctatctatttctgaggctagtgataaccagctaagatctgatgatatggatttctcgggactaaatgtccctcattatggatggcaaggactttggagttggggctgggcaaaaactcaagatccagaaccagcatcttcagcaacaatcacagatcccaaaaaagccaatagattccatagaaccttattactgacttggcttcctgctgggtatgttcctagcccgaaacacagaagtcccctcatagcgaataccttatgggggaatatgctgcttgcaacagaaagcttaaaaaatagtgcagaactgacacctagtgatcatcctttctggggaattacaggaggaggactaggcatgatggtttaccaagatcctcgagaaaatcatcctggattccatatgcgctcttccggatactctgcggggatgatagcagggcaaacacataccttctcattgaaattcagtcagacctacaccaaactcaatgagcgttacgcgaaaaacaacgtatcttctaaaaattactcatgccaaggagaaatgctcttctcattgcaagaaggtttcttgctggctaaattagttggtctttacagctatggagatcataactgtcaccatttctatacccaaggagaaaatctaacatctcaagggacgttccgtagtcaaacgatgggaggtgctgttttttttgatctccctatgaaaccctttggatcaacgcatatactgacagctccctttttaggtgctcttggtatttattctagcctgtctcactttactgaggtgggagcctatccgcgaagcttttctacaaagactcctttgatcaatgtcctagtccctattggagttaaaggtagctttatgaatgctacccaaagacctcaagcctggactgtagaattggcataccaacccgttctgtatagacaagaactagagatcgcgacccagctcctagccagtaaaggtatttggtttggtagtggaagcccctcatcgcgtcatgccatgtcctataaaatctcacagcaaacacaacctttgagttggttaactctccatttccagtatcatggattctactcctcttcaaccttctgtaattatctcaatggggaaattgctctgcgattctagagtaatagagggggctccggcccccttatcctcttcccgtctattttagattttaaagaacaaactataatttcatgggatttcgctagagggaagtcttaatttccccatggcaaaaaagagtatatctcctaaaataatgctttctttagcaagttaattaagcaaatagccctatgttatctcccaccaactcaacttcaaagacggcacctgttcctcctcgggattcgtcgaaaccagttcttatctctgaagaacctcgaaaccaacttttacaaaaagtagctcgtacagctttagctgttcttcttgttgttgttactttaggattgattctcctcttttactccttttctgatctacaatccttcccttggtgctgccaaacacacccttctactaaggagcaacctaccatctctattccagtacctcttccgtctcctcctcttgccgtaccgcgtccttagtactcccccccctcccgtcatatcacgtcctagtactccttctgctccaaagccctctacacctcctcctcttcttcctaaggctcccaaaccagttaaaacgcaagaagacctccttcccttggttccggagcaagtgtttgtagagatgtatgaagatatggctcgacgacagaccatcgaagcgttggttcctgcttgggattctgacattattttcaagtgtctatgctatttccacaccctttacccaggtctcattcctctggagaccttccccccagctaccatattcaactttaaacagaaaatcatttcgattttagaagacaaaaaagctgttttacgaggggagcctatcaaaggccctctgcctatatggtgttcgaaagagaattaccgccgccatttacaaagaacaaccctcctccctgtgtttatgtggtatcaccctactccaaaaacactntcggataccatgcagactatgaaacagctagctataaaaggatctgtaggagcgagtcactggctacttgttattgtcgatattcaagctcgtcggttggtctattntgatagtttatacaactatgtgatgcctccagaaaatatgaaaaaagagcttcaatcctttgctcaacaactagaccaggtgtatcctgcctatgacagcaagaaattctctgtaaagattgcagcaaaggaggtaatccaaagaggctccggatccagctgcggcgcttggtgctgtcaatttttacactggtatttgaaagatccccttacagacgctttgaatgatctccccgttgattctgtagaacgccatgaaaacctagcctcatttgtccaggcttgcgaagcggctgttcaggatctcccagagctttcttggcctgaagcataaactcttttctaatctaaaaatctttttaaataagaggccatcgagagatggtcgctcttatttcttactatttttcatctgctctttttataagcagcagggatattgtttttttgaaattaataaaaatttttataaaatgtttgtttttgattaattttaactggaaaaccccattttcagatataattatttgtctgtttaataaatgaacaatttattatggaaccaattcataatcctcccccacaaacatgttcgtattctagaccttcaactacctatacatctttcaaagatgcttcttgcgatactaaagttactagaatcatcatagcgctattcctcatagtgatctcttgcggacttattctctgcgcatatacattccgtgaccttttagatgcggattacttagcacaagagggaccacagcaagcaactaagcttttacaacaactagatgacgtcttaaccggtcctcctcttcctatctgggataacgaacatttgttccaattctcgtgcttaatgcagaacaaacacaggcgggttctccctatagacatctgtaatccgcttaccaaattcaatttcttagaatgtatttgtaactgcctcatgacgaaacaatccgtcaacgtcaacgaaaccgacatgtgcgagcttttctgtcctccgacttgcacaccagaaaactatcgacgacttctgtgcacctctagtgtattcccattcgttatgtggcatgatccttctgctgatacgcaagaagctatgcttacgaaaatggatcagactatgagctctggccgagtaggaaatagtcactgggtactggttatcgtagatatcgagtatcgatgtgtcacattcttcgacagtttgtgcgactatgtagcctctccacaacaaatgcgggaacaattagaaggacttgccgtctcccttggagctatctatcccaaagaaggtggagcagactccgatcaagaagaattactttctcctttccaggtacgcatcggatcgacagtaaaagtccaatctcctggagaattcacctgtggagcttggtgctgtcaattcttggcgtggtacctagaaaatcctgactttgatcttgaagagaaagtacctacaaacccatctgagagaagagctctactcgctgattttatctctacaacggaacaagctatgtcctagatactcatctttgagctggccaactacggattagagaacaaatcctactgtagcgttacagagaaaatcagagtagctgaaggaggcagctcaatatctaagccccagcagtcgggaccactttcatcatccgcttcgatcagtcctgcagcctctctctcttgtctcgcgatttcaggtgtaaggatttcaggctctcgaaaacctttccccgatcccccgaatcttgtgttatctgtattcatcagcaaatcacaagattctagggggagtatgggaagtaagtaatgaggaaagtatcctaccccaaaatgatgcacgcaaagcaaagctttcttagcatccgcgtctgcaaagcggagataagcaacaacgccattacgcacatcactaaaatcgacccaacggaaagaggagggaagatggtccgcttgccacagttgcgggctctgcacatataaagcatttagctcttgcgaacacaaatgcacaccttgatgataagaaatatctaataattcccagtctagctcacgaccgggggaccactctctcccctgaccgaactctccccccatgaaaagcaatttctttcctggttgacagatctgataacctaataataaacgcaactgagcaaactgtctccaagcatctccaggcatcttaccgattaaactgcgtttcccatgaacaacctcatcatgggaaaaaggcagtaaaaacctctcactaaaagcataccattgtgggaaagtgagatcgctctggtgataaggacgatatgggaaatccttctcgaaataatgcagtgtatcatgcatccatcccatattccatttgtaatcaaaccctaatcccccttcttcgacagatacagtaatcttagggaaggttgtcgactcctctgcgaaagtcaaaacacctggatatttctcatgaatcacagtgttgaattgctgaagaaaccgaatcgcatcaaggttctctcttccaccataacgatttggaacccattctccagcatatcttccataatctaaataaagcatagatgagacagcatccacacgaataccatctacatgcattttatcgatccaaaagagcgcacttcctaaaagaaaattgcacacttccggtttagcataatcaaaagtgtaggtgtgccagtgaggatgcaacggactcggattccgtgtatattcatacagaggagtgccatcaaaaccactcattgcaaatgaatctatagggaagtgtcctggaacccaatctaaaatcaccccgataccatgctgatgcatggtatctataaaatactgtaaatcttcaaaagagccataacgacttgtaggagcataatatcccgttgtttgatatccccaagattcattcaaaggatgctcggttacgggaagcaactctacatgcgtataatgcatctgcttgcaatagagagctagctgatctgctagctctttataattcaaaggttgtccttcctgccattgccaagaccctacatgaacttcatagagattcatagggccttcagtctttttaatgcgctcttctaaccactcgctatcgttccattcataagaatcatcgataacaacggaaacgctccgaggaggaggaccaaaaaacttcccataaggatccgatttaatgagaacctgcccagattctgtgaccatttcccatttgtaacaagctcctgctgtaaggccaggaacaaacagctcccaaactccttgatctgaaaccttatgaagaggattaacgagcccatgccacccattaaaatctccaataacagaaacacgttgagcatgaggggcccaaacaataaatcttactccaggtactccatcaatttcacaagggatagcacccatgcgttcatagatacgctgatgagtcccttcatggaataaaaaagaatcgatttccccccaaagtaaagggaaggcataaggatcatgagccaataaaccattttgatgatagactcgataatcttggggagaaattcctttcattacaggaagagaaaaaatccctgaatggtgcgactctgcctgttgaatcttacctcgcaactcaacaaaaacggtctctgccccagggcggaaaagaactatccgatcttgattcaaactttcagaaacaattcccaaaagatcttgtggactgctctgtttaccagaaacgagaagttccacgtgttgagtatttaagaaaaaaggaccacaatattttctgcatttatttacaaaaacggtcccatagatacgtggttccggcttttatctccactttttctaaaagattttttattttacaagagataattctaccttgttcttcgacacggaaacgagacgaatacacacctggactaatgatcgcaagctccctagaaacgtgagcttttaaaatcactcttcgaatggttttcttagaccattcgaaagaaatctccccaatattctcaaaatacaggccaatccaccgaccgcaagggaattctggaggaagcgcaggcagtaaggtaacaaccccatcactctcttgaataaaaatcctccgcatactgagagctgcagctctcagtaatgaaaaaggaacagcctcattccctggtctgggatcttccgatactatgccttgatactcttcatcatacaaacgtgggagcaatgttttagataaccctgcataaacgaatctctctaataaagaaaacactctttctttattaggttctgcaatagctgcatctaatgtatccaatagaagcgcaacctcggtcttctccatggataggttaggctgattttgtaacaacgctccatgacggaataggaaaggaaggatctctttaagatcttttcttcttctaattttttctanatcggcgtgtttatgcactccaaaagaaacatattctccagaataaaaagaagcggatggcaaatccgctatagaacgcgtataacacccgtttggagaaagataatacttatactgctcagtcattacagcgactcctccgcgattcaaattttgaaatactgcgaaacgctgcaggggaccttgaataggaactctaccttcatttaccagctcatgcgaagaagaaaaaattctccaaagagatggaaatacttgcgcatacaaagtcgaaccgggaatagggattttagctccgggttccattatgtaaggtttgaaactttgtgctatcttgatcataaaactcccagcgcctttgtactatcctctccagaccttatatttaatcatctttctttcagtaggatggagagctattccatggtaccttttagaaacgttattatcaacatagcgacctcctacactcgtaattaaaagaaatcttattttgtcaggaggaaatacgctttcttctattctaaaaatgtttatccctataaaaattgctcgtgcttttatcttgcaaatattcctaataaacaaaatgactccctctgccctctttcacaaacgactgatagaacaatttacgatctttctctccgtggatcgcggaatctcccctctttccgtacaagcttattgccaagatgttctcttatttttacaacgcgcctctattgaggctaccgatagaatcaaccaagagagtgtcttcctatttgtagaaaaatgccataaagctaaagaatctgaaacgactttagctcgcagactgatcgccctaaaagtctttttccatttcctaaaagatgtgaaaatgctcgatcaacagccctttatagaacatccgaaaatctggaagagactcccttctatcctttccacagaagaagtgaattctttattagatcaacctttgaatatccctaatttagacactcatatagcaagcagagacgccgctattctgtatacattctatgcaacaggaattcgtgtatccgaactatgtgatctttgtatcggggacatcagtgatgattttattcgcgttactggtaaaggaagaaagactcgactcgtgcccatcagcatcaaagccaaacaagctattgacgcttacttaagctctttcagagatgaactacaaaaaaaaatccctctgaagaacatgtatttttgtctatcagagggaaaaaactcgatcgttcctgtgtatggaaacgcattactttttatgcaaaattagtcactaccaaacgcatttcgccgcattctctgcggcatccgtttgcaacgcacctactcaataaccacgcggatcttcgtattattcaagaaatgcttgggcattctcgcatttcttccacggaaatctatacacacgtagcctcagagagcctaatcgaaaaattccacacctaccatcctagagatatctaagatctgcgacgaggttttttcttctttttctctggaacaggtttcttacaagggcactcgtgcttctcttgaaaactctctggtgtatcctcgtctacacctgtattgggataataatagtcatactggtagggatagtaaaaactataaggaatccgctccccttcctgttcttcaaattctactcctgcaacaagaacgctttccgaaggttgaactagagatcccgaatacaccgcatcagccccaaaaacagcagaactcaacgaaaccatccccaaaaggattgacagctgtttcattcactttcccccaccttttctccgatgccgcagaaaaaaccacagactcgggttatccaaataaacacactaggtatctgaacaagaagatttttagaaggaaagccatgcccaggataggacttgaacctacatgccgcgaagcactggatcctaaatccagcgtgtctaccaatttcaccacctgggcatagatgagtgatagagaaaaccatggtatctctatccgcttattttcgcaataggttatcgtcttctgcgctcttttcttctatatgtgcaaaagatgttaggttctttcgcacacctttctcttttgatcagaaaaaaaatacaatattccctctccattgtatcaatatttccgctttttcttcctgaccatactacctgtccctccacaaatgccaatgatgtactccctaacctcctattaatatattgaaccttagacagtaacaatgctgccgagctctataatccaacttgcatgaaaaatactttttagataagttccctcctttctaaaaggcctggatacattaacttctgtaactatggatactcccacacccctttcctccgtaccgacaaacgcttctcttaagggagaaccagggagctcctctcaattttcttctgcagaaaaaggggttctaaaaacaagcataggagacgttgttctgtctcaatctattgaagacggtggtaatgagactcagatctctctggtaggtgttgtgaatattaatatggctcaagaagaactccccgctcttgttagccctcgaaccttcattttccttcctcccgagactgtcgagctggaaattcagattgcagaaatgttccaagctctagaagagaccccttcttctgatagtcgatccctccaacagaaggaaacctctgctcaaacacctccagcaccttctgggaaggtttccatattttctttacaggcgcagggatcctcacagactcgctccttaccttcttctcaggagtccctatctccccaacaaccagctcgtgctatacagggactgaatactcccttctctccagcagcgcgctgcacaataagagccgttcctttgtctatcgtgcctcaccgtagagcaaatccaaaaccttctcaaagtgttctcatcatagctctcgtacttaccagacaggccattcaacaggaacggctcaactttcttcccaggaatgggaattttcttctcaaacagttaaaacctgctcaacaggaagagaaaaaagagacggtcaacaagaaagacattctgatcaagaacagaatagtgatcattcttaccaagaggaagatctctcggatgatatgcaagtgtcttcttctaaaagatcctctcatccggaagatgaaaatactgaggaagtattttctgtctctcactttgcttatcatgcggcccctcatcctgcgtccaatttagatcaggagtcgaatcagagtactttccaaaaaagaccgccctcccctatgtccttgttttcttcccagaatgctacggaagaagctcctaaagaagctcgtgtcgaaaacgttttcttacgattcatgcgactcatggctagaattttaggccaagcagaagccgaggcacacgagttgtatctccgcgtcaaagaacgcacagatagtgtcgatgcgctgacgttactcctgtcaaaaattaacaatgaaaaaggagccattgactggaatcaagatgaggaaatgcgcgctctcgtagatcaagctaaaaaactaggcgtcccaattggagactcctacgactggtctgaggaaggaaaaaagcttctgaaagaaaatatccagatgcgcaaagaaaatatggagaaaatcactcagctagaacgcactgatatgcaacgccatctccaagaagtgtctcaatgccaccaagcaagatccaatgtcttgaaacttttgaaagaacttatggacacctttatctacaacatgcgtccctaatgcgtcatttagcctatctactcgataaaattgctcgctcttaccctcatatgtgtccgcnncccgataatatggaagcgtactntgagnattnnatccccaataaagatatccctctggacacctatcaaaaaattttcaaactgtcctcagaagatcttgaacaagtctacaaggaaggatacaacgcctatttacaaggagactatgaggaaagttctaccgctttttactggttgattttctttaacccatttgtgtctaaattttggttttcatttaggagttcgctccatatgcgccaaaaatatcaacaagctcttcatgcttatggtgtagctgctttgctaagagaaaaagacccttatcctcattactatgcctacatctgctacaccctgctcaataatcctgaagaagctgaaaaagctcttgatcttgcttggcaaaaagtaaaaacaagctctgcctatagctctttaaaagaagaaattttagcgatcaaatcgtacgcctaaaatagatcacaaaggactcttattattatgtcatcctggtttgctcaaggacagacgtcgctctctctcaaactctcgatctaccagatgcttctctggccgtccagacagaaaaattcccttattcttgctccatatctaaggagagcgctccttcttgcatccgaaagatctttgcgcatcttgcttctcaaaaagaatctgccccgctttctttctctagactacagccgactacacctaaagagcgcatcttattctttggaagctctccctcttctcaactctcctctactgtacgcactacaacatcttctccttggaaccttttttcaaacagccaggctcgaaactccacgcgtaaactatcagaaaaactgcacctttcatcagagcttagtgctagagacagcacaaaaccctcttcttcggagcctgttaaaccttcagagaaccttcttcacactcctgaacaccacaaggagtcatttagctctctcaaaaaggacaatctgtctcctatcatggaagaaatagatagcttctccgctgaaactgagtctctagaggaaaggttagtgacacaaaaaaaagaagaaaccgttgcacaagaacaaaaacatcctctacttagaacctccacccctccttccaaagcatcaggagaaagtcaagactcgtccgagcactcttcgaaagaagacccttattctcagcaaccttctcacaaaatacaaagaagaggaacgagccaaaagagttgttcctatcatcacaccacctactgtagggatcttctctttaagctaccttctcactaaacaaggtatccttgcagatttttctgcctattctgcctacaaagacaatctagaaacgactcagcaagaattaaccatgttgcaccaagaacgaatcgaacaggtgcagaaaattgttgataagtctaaaaccatgcgattttgggattctctagcgagcatcgtcgctacaatcatcccttggatagaaatgggggtcgctgtaaccatcatagcgcttggaggtggcatcctttcctggtgttcccttttcgcagctttaatcatgatagtcatatcccttttagaagcttttgatggttggagagctattgcaaaacatcttcccgggaatgatctagaaaaaaaaatgcgttatctaggttatgtcaaactggccttaactgtttttagctgtctgctatccctttctgccctttatgttgctaaattgggaatgagtcctctgttggaaggcgttgtaaaatctattgcaccagcattatccggaatgcttggcttgacacaaggtgttgccctctatttacaatcaagcagtcaaaaaattcgtgcacgctgtactcaaatcgatgcacgcatcgaattaataaattgggaacgggatgaatattttttacgtgctgaacaactccttgactctatgcaaacctcttttgaacaactcacagaaactttacaattacaacgagaaattgaccaaacgtttacagacgccttacgatagcgatccttcccatgacgataacagtaccgcaagagacactaccttcattacaaacaatagcaacaggagagcagacagagacttcttgtgaagaagcctctgccctctccaatgaaatacagctgcttgaaccaggtcaagcagcaatccttcggagcctttccgatctctgtttatctgttattgagcagacagaaaaaactcttcctcattcgaaacattctccttctttccgagaaagctgtcctttgaaatatctgtctcaacaaacttctgcttcttctcgaacacaagaatctgccacagcagaacagcagtctttaacacccacccctacacctcaaaagactccgacccagactctacataataagccttctaccccgatatctcataaatcttccgtacaaggacgcatacagacatctccccaacattccactcctttacgaagtatacctgttatcatttcgttacccaacacgcaacaggctcttaccgatcgggaacctattcaaaactcaaattgtagccctacactctctgttactatcttcaacaaagaaagctcttcttcctcgaagaaagattccgctgcttcaagagagcaatcttcttcccattcttcctcattgcaaaagaatctctcttcacctcgtgcagcacttcttagcccaatggctctatttgaaacaacagcccaaaaagaaactctcgcgagagaaggactcttacacgaacgagaagacctatctcaagaaggagatcgtgaccatcatcaatcggatcaacaacaagaagaaaaagaagatcttgccatctctgcaagctttctttctcatagtaaaaaacgacgcgagcaccactttgatcctgagtatttaccagaggaaattcgtgagtttgctctctctgaagcccagctcagtcaattgcttcacatacgcctgaatcatctagatattctgcgtatctgcgcggaaatcatgaaactgatgctcaacagccgtgaacaggatcttcttgaacgccgatctacccgaacacacttcatgcaggaagcgaagaaaatcgcggactcctttgcaaaacaggctcgaattacaaaatggcttggcattgctacagctaccctgggtattttcggaggtatctcccctatcattggggaagtaggtggagaaggacttctcaatgtcattcgaaaagcaacaggtggttggcaacaagcctcatcaaaaacattttttgagggatggggaaagtgtgttctttctctgtctgaactagctaaagtctcctccacagtctatgatctccggcccaagccagtacgaacaatcgctgagagttataaagaactgtttcgcttagaacacgacgaaatgcttcgatcgatagaagagcttaaagatcacggccgaaacatggatagcttcttgctacagatcttacaaacgcaacatgatgcagtccgcagcctctaccaatagctaagtgagaaaaattccgtcagatgagataaactcatctgacntctctaattataattccttaggcaactgaaatactgtatcttcttctacaaaaagatccatttctatagacaaatcaggaatcagctcttgtaatttcattaaacaagcttgcacaacatcttctggagtagaagccccagcggttatgccgatatttcctgaatattgtaaaatttcttctgtgacttcatcaggatgattgacaagtctagcagtaactcctcgtctctctgccacttctctcaaacgatttgagttggagctttgcctgtcccctattacatacacaaagtcgacctgaggaaggatatttcgtaaagctccctgtcggttctgtgtagcatagcagatagaagaactgggtaatgtaaagattcgaggataacgagccttcaaagccgcaacaatatcagcagcatcatccatactcaatgtcgtttgcgttacataaaacaaaggatcttgagcactaaaaggcagcgcttcaacttcagcgatattttctaccacagtgatttgatcgggggcttctccgcgtatcccaataatctcaacgtgctttcttttgcctataaggatgatgtgatacccttttttagcgtacattttgactgcagaatgcactttcgtaaccagtccacatgtcgcatcaatagcaatcaatcctctttccgtagcttcttctcttaaggaagggggaactccgtgtgcggaaaaaatcactcgactattacgaggaacttcttgcaaatcttcaataaaaatagcccctttctcccgtaatttatctacgacatgccgattatgtacaatctcatgctttacataaataggtctcccccacttctccagggctacttcaaccgtctgtatcgcacgaataactcccgcacagaagcctctaggcgaacagagtataattttacgcatgcatcacctttccatttattaatgtttaaacacaacaagggctttgggactataaatccgcaaagccccctcttactatgaacgaaaacgccagttaaaaactaccatcttccgcaagaataatggtaccgtcgttattgatcagctgacaaaccaattttttgaccttatcaagatactcggaatagcctttatagcgaatatcattcgctgtaaaaggcagatcgatatgcggttcgactccgatgttctcaatgaaggcaccatgctctctaacagctaatgatcctgttaaagaacaagtttttattccagttctatttgggaactgcacattaaagacaaatcctccagctccagctgttcgagtaccaacaataagagctcgatcattgtctttcaaaactacagggaagaagtcagcacaagaaaagtcttgctcattgatcaaaacacaaatcggtttagagtattgaactcgaggatgtggatgaatcttctcaaaaccaaaaagaggaataggtgttgataactcgatatcccctttactccaacaattcaatacttgacgtccaaagctttttaaatactcggcaacctgtagatccacagtatatccttccatgttgtctcccagagcaaggcgagactccacgtttgtgtctacgttttccaacagggttaaccaatctaaagcatcaaccacttcatcctgagtcagaatcattctatgtttaggaagttctaaaggacggtctgtcaacatggaaagcagtgcataaagataaaggacactaccacctgggttgttcgtttggtcgataatcaaagcttctgtattagaagaaaatacttgaataatcttagcaaattcttcccaaggaggcggtcctgaaggatcaaaatcttccatgtcctgccaactatatgtaggaattcttagaaatcctactttatggctcttaccatccccatcagtcaccgaagaaatataagcgcggaaaagaccctccgactcccatataacaggcccaatgacagggagaaacccatcgtactcccaatattgtacccgcttttcaaaccactcgttgcataatgattgcgaagctctgcccaaaaatgcggaaccattggagagtagaatagcgaactagaccgatgaaacgcatcatctttcttagggaaaaagcttctcatcgatttctgtaactgtggagccctgatagaaggagctatggtagccaaatctcctacaccttcaggaacataacgccatttcacacgaacttctctcgtagtaccaaaaggacgacgaatctttaaagtagtgcgcccagaaggtactttgtgccctaaagaggccatgcgagaaaatagtgttcttaaagcagccgactcttcagctgcagtccctttgtgattgcttccatatagagtagcgagcacatcttggacaggcgccccatccacctctagcaactcatctccaacacggatctctgaagaaaaagtcatgatatctacaaagtagaaacggccgtcactacttttttgtacggtataaggaaggtaagcactttctatcgcaaagaaagttactccagcgtgaaagtcatttaatcctccgataaaatcagcaaggacctgctggcaaaaacttgttgatggattttcttgtgtacgaagcttctgctgtgcagaaacggagctttgaacaagatcccatcctaagtattgctctttccatgttttaggagcatatttaacctgtaataaatgctctaaaaaactcaaatcttgaagagcattcttgcaaaccaagctttctcctcgtacaggagaatgtatggcagaagaaaaggtaagcagtaatagccaaatcctattcattttcataatcgatgttctccaaaaacccatttttccattcaaaaaggggcctagaataggcagagaacccttttattaaaagaatttttaaagaaactctgccatactgactacctcaaacgaacaaattcacacaattttccattagaaaatagactgctagacctccaaaataactggctaaagcaatccaagaagcgtgtttgacataccagccgaaactcactttttccattcccatgtaggcaacacctgcagcggatccaatgatgagaatacttccccctgtgcctgctgtataggcaatgagtttccaaagaggatcgttcataggtaagtcatacatacctattgttgcagcgactaatggcacattatctaaaacgctagagactaaacctaaaagaacagcaagcgtgttacgagaaaacagcgcatccatactcacagataaatcccgtaatacatgagagtaggttagcgcattaacagccaacagaatccctataaagaatgtaacagaagaaatatcgatacgcgttaaaatatgcggcatacgcaaatgattacgcccctcaccatgaggagagtgaatccaatcactcaccaaccaaactaaacccagccccaataaagcccccataaaaggaggaactcctaatacagctttccacataggaaccatgagcaaagaaccaaagccaacacaggcaatcaggttactcttagggagcgccggttctctatccaaatcctctgacaatcctgaacaacgacgtttttttagtaataattgcccacagattcctgcgatcactacacagacaacactaggaagaaatagcgtagtaataatacccgacgtagaaatcttatcgttaatccaaagcatagtcgtagtcacatcccctaaaggggtccaagctcctcctgcgtttactccaatcacgcatagagctcctagtagcagccgatcctctcgagctttcaccagacgctttagaatagaaataataataataatggatgtcaggttatctaaggctgcggaaaggaaaaaagaaaggataagtaatacccaaagcagcacgcttctggattcaacattacaacaacgcactacaatagaaaatcctctatgagcatcgatgagttccacaattgccatcgcagcaaataagaagaaaatgacttgtgccatgtctgcaatttcttcgaccatcatgacgtgatcaatgtgcggtatatgggaaaaacaaactaaccacatcaagcctcccatagcaagagatacggcagacttgtttactcgaacaatatgttcaaaaacgatcgcgagatatccgaacagaaataacaaacataactggaactttaacataaagacctcgacaagcaccttactctgaggactttattcagaacaccaagagcccgcagaagcttaggcaaaaataattacgagaaaacacaagactttgcgtatatacgctgatgtacagacagttagaatccaaccttatacacagatcctggactcatctccgagttcttagtataggaaacccttcaaaagaaggcgctatccaaaagacaagcttacaaagacctagatcatcttacacaaaaacagttttcaactctacagtgaaaaccctccgatccttaataaaaaagaaactatcctccaccactttggattaacagattcaaataaaatagtgataaaaaccttcttaaaaaatgtttttcttatctaaaaatctctctgtaatagctctatcttatccgttcaactcgtccgcaaaactgttgcatagaaactctttttcatcgaaagtgttctcacttttgttggtaccaagagactcggggagtgcaattatatcaccctcctcctcttaaggataacaatagcctgtgtttagtcatcccactcgctgactagacaaaccgatcgcgaattggtgatgaaaaacgctaacaccactttacaaatagactaagcttgcgtttctattcgcgataaaaatagaagggctgtcctaccaagagagtttctcacctctcttctcgttggataaattcctttctattataaaaagaaaaccatctttttcgaaccagcagaggctttggtgaaagtttccctatccttcaaacatcttatccctaaattagttacctgcttaaaagaagggtattcttttaatacgctcaaaaaagactttaccgcagggatcactgcaggaattctagccttccctttagctattgctattgcgatcgggattggagtgtctcctttacaaggactattggcctcaattattggaggctttttagcctctgccttaggaggcagtcgtgtattaatctctggccctaccagttcctttatctccatcctttactgtatcggtgtcaaatatggcgaagacggactgtttactatcacattgatggctgggatcttcctcgttatctttggtcttgccggactaggcacttttattaaatatatgccgtatcctgtggtgaccggactaactacgggaattgcggtcatcattttttcttcccaaatccgagattttcttgggcttcaaatgggagatggagttcctttagatttcatcggcaaatgggcagcctattgggattacctatggacctgggatagcaagacctttgctgtgggtttatttaccctgcttctaatgatctactttcgcaattacaaacctcgttatcccggcgtaatgatttctattatcattgcatcgactctagtatggattcttaaaatagacatccctaccatcggtagccgttatggtaccttaccaagctctttacctggtccagttttcccacacataagcattactaaaatgcttcaacttatgccagatgctttaactatttccgttctttctggaatagaaaccttattagcagctgtcgttgcagatggaatgactgggtggagacatcaatcaaactgccaattaattggccaaggaattgctaacattggaacctctttatttgctggcatgcctgttacaggctcgctttcaagaacaacggctagcatcaagtgcggcgctagtactcctatagcaggaataatccatgccatctgtctttcctttatcctactactcctagctcccttaactattaaaatccctctaacatgtctagcagctgttttaattttaattgcttggaatatgagtgaaattcaccatttcattcatctattcacagctcctaaaaaagacgttcttgtcctgctaaccgtgttcattcttacagtaatgactacgattacttctgcagtacaagtaggcatgatcttgcagcctttctattcatgaaacaaatgagcgatctatctgatgttatctccacagcaaaatattttgatgaatccgaacaacctcaaaatgacttgctattttagcaaaaatgaagtaccaccttttacggaaatttatgaaatcaacggaccgtttttctttggcatcgcagatcgtttgaaaaacttattaaatgaaatagaaaagccgcctaaaatatttatcctttgcatgactcgagtgcctacaatagatgcatctgccatgcacgctctagaagagttcttcttggaatgcgaccgacaaggaacattgcttctcttagctggcgtgaaaaaaactcctctcagtgatttgagaaggtaccatgtagatgaattgatcggagtagaccatatcttctcaaacattaaaggtgcgttattgtttgcaaaagcccttattaagttagagagtaagtcttctcaatagatgtcttgtataaacaagtctctgatcttctcccgccccgtgttgaattacttggggcgggcgacatacttgttctcgtatctattcgtgtcctctgttccctaccatcaatcctggaattacatgctcatcaaactctttttcagacaaaaagcctaaagagacacacgcttctttaagactcaaattttcatgaaaagctttcaaagcaatctttgaacatttatcgtaccccaaaatgggactaacgccgttaccaacatcaaagatctttctacattttgctgtagttgccccttatttaccttgagtccgcaaacaaaacaatctgcaaacgatctcatagcaccagctaataagttcactgactgtagaaaatcatagataatgacgggtttcatgacattcagttcgaagttcccttttgttccagaaaaaataatggactggttgttcccgattacttgagaacaaaccatctgtaaagcttcgctttgcgtcgggttaattttcccaggcatgatcgaagatcctggctcgttctccggaaagaaaatttcccctaatccacaacgaggtcctgaccccaaaanacttagatctgtagcaattttaaccaaagcacaagctaacacagtcaatgatccgtgagcttgcaccaaagcatcatgattcgataacgcagcaaagtagttcgaagctggaacaaagggctctcctgtctccctcctcaaatactgaatcaccttctctacaaatccttcaggaacatttaaccctgttccaatagcagtccctccaatagccaactcatagaggtgagttaaagaaaatcctatccgctctaaacaattatgcaactgacaactatacccagaaaactcttttgcccaagagtcattggaactacatccatcaaatgcgttcttccaatttttatatctcgagcaaactctaaagctttagcatcaacaactttttttaaatgttccaataccggaattaaagatccttttatactttgtaccgcagctatatgcattgccgttgggaaaacatcatttgaggactgggtttattcacgtgatcattgggatgcacgggatgtttacttccaagctctcccccatgacgctgaattgctaaattagcaatcacctcattgacattcatattgctttgagtgccgcttcctgtctgccaaacctttaaagggaagtgttcatcaaattctccggagagaatttcatctgtagcagcaacaatcatatccctgcgtttagcatctaagcaccccaagtctccgttcgccttagcagcacattttttaatttttactaatgcatggataatctcaagaggcatagattctttaccataagagaaaaactcttgcgaacntcccgtctgagctccaaatagtttgtcttcgggaaccaacacaattcctaagctatcattctcttgncgcatatgctctcttcccctatgattcttccttcatgaagtcgttttttctatttttatgaaaaaatttattagctatttactcatcatccttcccttgattggactctgggagttttgtgctcaaaactatccgagttttggctttatatgccctcctccatcgaaggtacttacgacagggatccattctttcccggtactattccagcattcttgctatacagcccaaggcattttaggaggattctttttagcattactacttgctatcctcttttctgctaccatgcttctatttccttctactcaaggcttgttgcaccccttgtgtgttctggtgcaatgccttcctatgttcactctagcccctttaatcgttctttggtttggttgggggacaagagcagtaatcatcccaacagctcttagcatctttttccctttagctctgaccattcatcagggaattaaaaattctcctgaggaactcttagaacaatttactctttaccaagcaactacttggcagaaactctttaaattaagaattcctaacggtctgccacatattttctctgggcttaaaattgctatgagtgccgcagatttgcgaccattgctggagaatgggttgcaacacaatctggtctaggtattcttattctggaaagccgcagaaactatgacatggcaatggctctagcgggtttatttgtcctaaccgtgctgactctaagtctgttttatagcgttttacttcttgagcgcagcaccttttttttctttagaatggaaaaaacttccaaaagatcttttgggaaaaaatgggtctttgctctaattccaattactgtattgccctgtcttttctacttaaaagacgatccaaaattagccgctcccgtccctactaaatcctttactctactcttggattggactccgaatcctaatcacattcccctctatgtaggtgtagaaaaaggattttttgtagatgaagggatttccttaaccttacaaaaaaatacggatacttgttcttctattcctcatctgcttcttgagaaagtagattacacgctttaccacagcttaggggtattgaaaactgcagttcgaggagctcctgttcaagtagcaggcagacttatcgacagctccttgcaaggtctgatctatagaaaaaatgaaggcgttgaaaaacttgaagatcttaacggacgcgtactaggcttttgcctcaatgactccaagaacctgcctaatctgctagaggctttacgcaagcatcatgtggttccttcagaaatcaaaaacgtcagcgcagatatgatttctcctatgctcacttatcaaattgatttcttgtatggaggtttttacaatgttgagggcgtcactatcgccttaaagggaacccctaccggttgttttctttctgacacttatggatcccctacaggcccgcagctccttatttgcgggaaaaaagggtctccagcgatgacacctcaaacactccaaagcttgcaaaaagctttatctcgcagtttggatttctgtcgtgaatatccccaagaggctttcgctatctacgtagaagcgactaaagactctcctaaagtgttatccgatgagcaggctcaatgggaagttacccttcctttgttggccaaaactcaggaacctttatcacgagaattgctagaatctctactcgtaacattgtctacaacttgccctgatctgcaagcttccatcgatacttttttctattgaaaccttgattagtgatgcatctgagacaatagcttcttcctaactcaacctctttgtttcaacactacgagttcgttagtcaacaaaaatgttgctctttctcgttgattattaggtttcactaaatctcaatttgaactacacttctgtgtgacgatttcggggatccctcagttacaaaggactgaaagatcccttctttcaatatataaccaccaacctctttacaaacgtctcatggactggtcattttttttgttgtctcaaagctgtattttatttttagcagcagactctacgactaatgtcgaggttcttaatacaatcctaggtaatttatctaaaagaagcaaagcgctgcatctcttgagggaaagtctttttgctcttctcgggtcttttgttctttatcctctattatcagggctcctttactctttgcaaacaccagcatgcgcagtactgttgtcggagggtgtggggttatgttcacaggaatgcgggctattcttcggaatactcaagcatccctttggagtaaaattccttcgttatcccagtcacctaaagtagctcccatagcccttcctctcatgatcgggccttcatggctatgtgcttgcgcccccttagctatgcagcaacttcctttttccattgtttgtgcgctgctgtgtctatcctggctaatgatgacaataaccacaattgttcttcaaacagcgaataaggccggctcgcaaacgatcatcgcaacacaaaccatcctaggcctagctgtcgtgattgtaggcgctcaacttctggtatctggcctacaacaaactttcctataagaaagcacgtgtatttatgctacattcactatttcgtcttactttacttttttatgctctttttaatgctttgggctctcttcccgtttttattgcattattaaaaaatttttctttcaaaaaacagcaacgcatcattttacgagaatctattttcgcactgctcttgctgctactattcgttacttttggtcgaggctttttccgcttactagggatcactttacctgcttttcaatttacaggaggcctactgcttggctccatagccattgatatgatgaaggcacttccttctcaatcagaaactttagagaaagataaagacgaacccgttttcttccctctggctttccctgttatcacaggcccagcaatgattacatcgactttaggccatatggaggaaggtattttcccaaaagaaatcgttctgggagctattgtgctngcttggctattctctctgatcacgcttctcttttctagctctatcaatcgcttatttggccaaatgggactgttagctttggaacgattatttggtattagtttggctttgatggcgggcaatcttatgttaaaagctctttctacggctttcaatatagggtattatatgttacaccttaaagctcttctctatgtcaagagatagggaaatcagaaatcactctttgggttccttttatgaaaagaaacgatccttgctggtgcggcagtaacaaaaaatggaaacactgccattacccaactaaaccagaacgtccccttgataatttacgacaactttacgcctctcgttatgatatcattatcaaaacgccagaacagatagaaaagattcgtaaagcttgccaagttacagctcatattctcgatgctttatgcgaantgctaaggaaggggtaactacaaacgaactagatcttctctctcgagagttacataaacgccataatgccattccagctcctcttaattatggccatccgccttttccaaaaacaatctgtacatcactaaatgaagtcatttgccacggaatccccaatgatatcccgttacaaaatggggacattatgaacattgatgtttcctgcattgtcgatggattctatggagattgcagccgaatggtgatgattggagaagtctctgagatcaaaagaaaagtctgtgaagcttctctagaagctcttaatgctgctatctctattctcgaacctaaccttcctctgtatgaaattggcgaagtgattgaaaattgtgcagctaaatatggcttctctgttgttgaccagtttgttggacacggagtgggagtcaagtttcatgaaaatccttttgtggcacaccatagaaactcttgtaaaatccctctagcacctggaatgatcttcactatcgagcctatgatcaatgtcggaaagaaagaagggtttattgacccaataaaccattgggaggcacgaacatgtgaccaccagcctagtgcacaatgggaacatgctattctgattaccgattctggttgtgaagtactaactcttctagataagtaacttcttcttctagtgcctcaatttgtagcaaaagattttgaataatagaaaaactatccgttgtagacaaattcaaggcttcttcttctttagctcgcttcaaaactaaaagttgctcttgagctaagaagcgttcgcgtctagcttttttcagaaaggaatccttaaccgtaaactgctcccttaattgcaggtacttacccttataagccgctctgtcatcactgaccgaagaactcaaaagcttttccgctgcaatctcttgtttcaaagatgcgatctcctcatccttttggaagatctctttctctagaatttccctaagccgagtagactctaataaatctgctaaggccttatccaagcactcctcagcatagcgcttcccgctattttcctcttcacagagcttctctaaatgagcgatcttatgttcagcatcctgaacccgctgctgataaccagaatccttttcagaattaccctgaaagactttccaagggaaaatgacattctcttcatctccagcaactacacgcacatactcttgatggagagtcatgtaatcttttaaccagctatccctctgatcaataagaatctgtaaatcttcacttgtatgcgtatatttcctggaaacctcttggagttgctcatgcgaaacagaaagctcttgttctaaagcagttatcttactctgggcaagaagctccttttcttttcgttcttgcacttcgcggttataggagtcttgaagggaattgtgcgatgccgtcagctctgataaagatacagccttctccttaatatgtccttcaaccaaagacacactcagcagaagaatcccataagaaataataaaagagacagttaacaatcctccccaaaaaacagacacagggaaattgttacaaagagccagcccgaaaaatatagcccctacaacagagagcccatagccccaactacggaagaaggaaactagagcaacgaaaacgcctacaatacttaaaacagctactaaagaaacggaagagattgaagatacacacccaatctcccccaacaataacactataggtaatgaaaagagccctacttcaagattctgtagaggccttaggaagaaggacttcacagcttttcctttccctctcacagttccgaatcccattagaaccctcttttttgtttagggctgctccaaagaantaacgctttggttaacaaaaagctaaccaattctcgatccccttcatacaccatctcgacattcattttcccttcagccgagggttgcccacaagttagcactacataagcactaatatcatcaccatttaaaaaatccaatcgctcgcagtcttgagtttctgccacacagccccctcattggaaaacaggtttcatttaaacatttctcgcagccttctgcgaaaaaccttaaacacttgattaataatatgtaaccttcctccgctaattccttccaaaatcctttttagggaagaatcgcgggctgtccaaatatccgatttgaacagaagaaaagcctatacccctctctcaaggctgttagcacttaaaagaaagaggcttaaataagcggcttatttttaaaacaaattattatttttattaaagagagaaattgctggtaaaataaaaaataaaaaccaaaaaaattttttagaatatgtcagcaccaacctcacaggtaggagacacacaatacgtctcctcgctacctcctttagagcctttgggaacgcctccaatagcagaactcttgttcagcatttactctcttcttttagaagctgtagaaatacgtcaagagacgattctcacgcaatctaagcagctaaacgacaatactaatatccaacagcaattaaaccaagaaacgaatcaaatcaaatacgctgtcgttggctctggagctaaagaagacgaaaatcacacgagtacaaaaccagaaccaaaactattctgcacaacgctcaaatatccaagaccaattagtaactgcccgacaaaatggacagattatcctctctcacgcatctacaaacatcaacattatgcagcaaatcgctcaacagaactcctccttcatcaaaacattgaactccgtgggaagcacagttaaccaattaaataaacccctgtcttaacccaagaaactaattcgaggcagaagtatgtggcataaagaaccaatgtatgctgtattacagctagctgaaacacctccggttacaggaacaacgaactctgcaacggctgatgagattataacacgatttgctaaggattctaaccctctccatcgttactgtttactacatttaccagtctgttctcgtcgcgcaaaataacttgtctctagttgcagagcaattgcaagctaatgctgccgcgcaaacattcctgaacaatgaagaagcgctatagatatacactaccattccaaaaaaccaagtaaactctcaaaactcctcttatttacaaaacgtacaatcggttaaccaagcagtcggagcatctagacaagcgattcaaaaccaaatatctggtcttggaaatgcttctcaagtgatttccagtaacttgaacacgaataataatattattcaacagtccctacaagtcggtcaggcgctcattcaaacgttctcacaaatcgttagcttgatcgcgaatatctaaagagggtatccaatgagtagtgcaatcatccccactcttcctgaaaaaaatactgtcataccagactctactctaatagagcctacatccatagagattaacaaaaagtctgctatgtatttctgcattgcagtcatgctgaaactctccgtcgcaacgacagattacagccatgctattatggctgtcttacaagaaaatacgctggaacaacaaagaaaaaccaaagaactaatcaacatccccttgttatatgttcctgacctaatcaaaaaaaatggctctgacgacgaatacacgaatcacagcactattcaggcttttcaaacatcgaaccaacagattacagcaaatagagaactcatccaacaggaactgtccgcagctcaacaacgtgctcaagctaaccaaaaatcggtgaacgccacatccacagaatctatgaaaattcttcaagcagtttccgcgctccttacctctctcatcgatctaacgattaaagcaaaccttacaacgtctcttcggactaatatcttggggtgcacaggttttcctatgcacccaaataacaaaccttgcgagacaaaaggaaggttgacagccaaaaacagagcctagataatagagccaatcatcaacacttttgtaaaaaggcctctccttcatgagagttatcttccccgataagtacaaacaaactcccttttggggaaagccctaaaacagcttcccttctagtactagtaacttcttgctccgctccttccatcgcatttttcttacagtatttttttcaagtgcgtgggcctatagaatggctcgctctctctgtaaaaggaattcatcaacattatttttggcaatggctcacctatcctctcgtaacagcagataccttaaagctgggggatcttcgcagccttgagatcacgcaacgcctactcatgcggaatgttttggatttcatcctcttttataaagcaacagatgtaattattcggaaactcggaacaggtagctttgtgtttttactcactacccaagtcagtattgcaggtatcagcatttgggcctttctatggttaattggaagcacccaagctttcttcggaccagaaagtttaatctgcgctcttttgattgtccgcgttttcctagatccagaaaaaagactgacactccctcttttccctatctctttatctagaaaatggagctttgttctactcctccatttctacttcctaattctgattctgtccggcgcctatgcaatcctacttggttcggtactgtctatggctttggcaatatgtttttgctataaagaaaatattcctaatccttacagaggctcgtatcgctagaagactccacgcaaaaggagtcttctagatcagaaaaaaaagaatataatgcggctcgagtctctcctattccattccaaaactccttcttcaaatctaaaagaagggttctcctcaagttcatcataatccataggctgtaaaagatcctctttcgtcaatccaggaacaatcgtcgtccctagcgacattaatcgtctttcctgctccgtatataaatgatcaagtagcgcgagaatttcttccttcatccttagcctttctcttctctaaaaaaaagtttttcattaactgctcagactcttggtaacaaacaccagaacaacactctacttgatggaaaggatgtttttctaaaaaaacatttaaccaactccctccagctcctaaacgcaaatcaggggccccccaaacaattctaggaatacgtgctaactgaatcgctccagcacacatgagacagggctctaaagtacagtagaggatcgtgtctttcaatctccaattctctagatattctgctgctgcactaatacaaatcatttcagcatgtgctgtcggatcttttaattgctcaacactattatgtcctctagcgatgatcttatctccatgaacgatgatacaaccaacagggacttcatcttgttcatatgccttcctagcctcatctagagccttcttcatgaaaaataaatctttttctatacacataaaattagctataacccgataaaaaaggttttcttgcattaagaattagtttgattttttctaaatcaaaaacccctcataacatactacaaagtacctaatcgacatcttatatttctctgcacagagaaaaaaaacttcttactctagcaaaagatgtacattaacaaacctcttaggtataattggtcattacggcatttttagtatttaaggagacatcgaatgtctttggataagggcactaaagaagaaattactaaaaaatttcaacttcatgaaaaagacacaggttcggcagatgtgcagattgctattctgactgagcacataacggaactcaaggagcaccttaaaagatctcctaaagatcaaaattctcgtctagctttgctaaaattagtagggcagagaagaaagctcctagagtacttaaattctactgatactgaaagatataaaaatttaattgctcgcctcaatttgagaaaatagtaccccttttcgtttttaggacaactccatggcttttgagactttttctgttgcgttagacaaagataaaacattaattttcgagacagggaaaatagctcgccaggccagtggggctgttctcgtcaaaatgaacgagacttgggttttttcttcagcgtgtgcagcctccttgtcagaggctgtcggttttctgcctttcagagtagactatcaagagaagttttcctccgcaggaagaacctctggaggatttctaaaacgtgaaggacggccttccgagagagaaattcttgtttctcggctaatagatcgctctttgcgtccgtcgtttcctaatagactcatgcaagatattcaagtcttgtcctacgtttggtcttacgacgggaaaactttacctgatcctcctagcttatttgcggagcttctgccgctttagctatctcagaaggttcctcaaaattgtatcattgcgggtgtacgcgttgggctcgtcggaggaaagtgggtcattaacccaaccagagatgagttaagtgcctccaagcctggatctcgtcatggcaggaacagcttctgcagttttaatgattgaaggacattgcgactttttaacagaagagcaagttctagaagctattgcttttgggcaaacctatatagctaaaatatgcgatgctattgaagcatggcagaaagctatcggcaaacaaaagaacttctctgccgttcttgatatgccagaagacgtacaaaatgtagtttcagattttattagagaaaaattcgaaaaagcattgtcttttagagataaagaagctctagagcaagcctcgaaagaattagaggaatccgttattgctaacttggttcaagaagaaaacagtgatttttctttgttgaacgttaaggctgcatttaagacagcaaaatctaatcaaatgcgagctcttatccaagatcttggtattcgtgtagatggacgaaccaccacagagattcgccccatttccatagagactcctttgcttccaagaacacacggaagttgcttatttactcgcggagagacgcaaagcatggccgtatgtacgcttggaggcgaaaatatggcgcaggattcgaagatctgaatggagatggagccgctcgcttctatctacagtatttcttccctcctttctccgtagaaagttggcagaattggttccccaggaagacgtgaaattggacatgggaaattagctgaganagctttaagtcatgttcttcctgagacatcacgattcccttatatcattcgcctagaatctaatattactgagtctaatggatcttcctccatggcatccgtatgtggaggctgtcttgcactcatggatgcaggagttcctatcaaagctcccgtggcaggtattgctatgggcttaatcttagatcgagatcaagccatcatcttgtctgatatttccggcatagaagatcatctaggagatatggactttaaagtagccggaacagctaaaggtattacagctttccaaatggatatcaagatagagggaatcactcataagattatggagcaagctctagcgcaagctaaacaggggcgtagtcatatccttaatcttatgacacaagttctggcctcccctaagggaactgtttctaaatatgctccgcgcattgaaactatgcagatcaatacctcaaaaatcgcaacggtcattggtcccggaggaaaacaaatccgtcaaattatcgagcgttctggtgcgcaagttgacatcaatgatgacggcgtcattaacatagcagcaagcacccaagaatcgattaacaaagctaaagaacttatcgaaggattaactggagaagttgaagtcggtaaagtttataatggccgtgttacatctatcgcaacatttggagtattcgtagaagtcctcccaggaaaagaagggctctgtcatatttctgaattgtctaaacaaaaagtagacaatatctctgactttgtcaaagaaggagacaagcttgctgttaaactccttagcattaacgaaaaaggccagttgaagctgagccataaggcaacgctggaagattagtcttctataggcgattcgttgaaaaacaaggctaagaaaggtttttcttagccttttttattgtcttgtaactaagcttctcaacactgaaaatcgctatttcccctacaaacatccttacttagagacatttagttagacgctagctttcctcacacacaaaaaaaagagagccctaataaaagggctctctcctaaacctccagaagggaagttatgtgctagtattaaacttcaaactcgtcccatcttgcacattttcttgaggaggcggcggtggaagatcatcagaaatcttcttatacagcatgccttcttccttcatacgagcccgtttcttatcagcatcccaagaatggtccatgatttctttaacatctttagaatccaaagtctcgaattctatcaacatctgtgtcataagctctaactcttctttatgactgttgatgatgtccaaagctctttgatatgcagcatccaatagagttttaagttcattatcaataactttggccgtctcttcagagtaatttttttcatggtaggatccgtatcctgtaggagccgcttcggaatgctcgtcataagctacagttcctaaatgatcgctcattccccattcacaaatcatgctccgtacaatctttgttgcctgagcaatatcttgttgcgctccactagaaacatcaccgaggaaaatctgttcagcagcacggcctcccataagaaccgctaactgatcataaagctctttcttccagtagcttaatttatttttttctggaaggaaatgcgtggctcctaaagataagcctcttggaataatcgtcaccttatctacaggatccgaatgctcaacacaaagccctacaatagcatgccctgactcgtggtatgccgttgtttttttctcttgagcatccatctctaaactacgacgttctttaccatacagaaccttgtctcgagcttctgcaacttcaactgctgtcaccgctgtacgatcttttctagcagccaataatgctgcttcgttaagaagattttccaaatcagctcctgaagctcctggagtgctacgcgcaaccgccataagatctacagtaggatctagcttaatgcgtttggcgtggacagcgagaatttcaaaacgaccttttatatcaggaagattcacaacaacacgacggtcaaaacgtcctggacgcaacaaagccttgtccaaaacatccggccggttggtagcagccataaggatgactccttcgttagtaccaaaaccatccatttctactaacagctggtttagagtctgctctctctcgtcatgaccacctccaataccagcaccacgatgtcttccaactgcgtcgatttcatcaatgaagataatgccaaggagcattacgcttcgcctgctcgaacatatctcggattctacttgctccaaccccaacaaacatttcaacgaaatcagaaccggctatggagaagaaaggtcgatcagcctcaccagcgacagccttagctatcaatgttttccctgtccctggagctcctatgagaagaattcctttagggatacgccctcctaaactagtaaatttagtaggattcttcaaggaaatctacgatctcaacgagttcttctttggcttcctctatccctgctacatccgcaaaagttactttgtttttgtccttttgctaacaagcgcgcaggagattttccgaacgacatagcagaaccgttcatccctttgacctgacgagaaaagataaagtagataaacagcagaaccaaaataattggcataaaagtgaataaataaccagagtaatgaggcgttggctcttcacttctgaaagtcttctctaaaactaaattacgcggttgatctggagctctaaatgataaagatttatttgaagagaatgctgcccattcctgtttagcgccttcaaaccaacgactaaacacttcaggatcttgtttctccaaagctcgagaagagagttcttggttattgaaataccaaacagcttggactaattcgcctctcaacttatcgagctgcacctgagtctcatcactctcccttaataatttgacacatcggttgaaatcttcacgatatagacgtacagagcgtaattgatggaaacgagtcccttcttcaggagaaactagtgctaaggaaattctatgcaacgtctcaagcacagttttatacaaagcaacagcctgatccccttctataacctgagttaaggagttttctacttgctgatgcaaatctttgatttctttttttaaggattcagacccgataccaagagctggagaaagatatttcccaattaatgcatagagatccgaaccaaaaactctaagactttctgtagatttaggcaaagagcgcacccgattttctagcgcagcaaggttcacaatttgagcatctacagggccgtaaaccactaaaggttctaaaacagagagcccaacatccgttcgaggagaaatagtatagcctgcttcagggataggcattccagaaatagctgaaaaccaagtgatcgcattacgcacttcttttgataaaaccgttaaagacttactcgcctcttccagctcaaagtcgatctgatgcttacgttcaataagatcaagatattgataccgaacctgaccttcagcagggaccacctcgcggaaacgaccactaaatgacactaaattatcgttcaaggcagtcttgcgactctcttctggaatgagtaatttcaggttaacaagatgttcgagttgatgactgaagcctaccgaagcctttttagcagagaaaaagttttgaactgtgactacgccaaaaatcactccgaacaagagaaagaaaaaagcagtaggaaaactttttttggattctggatttgtttttttatctttagccataaaactcactacaatgctaatcaaacaggcagataattattcaatatatcaaaatattttattattttgtttataaacctctaattatagagataaaaaacaagaagtgtttttctttcagcaatctgctgaacccactagggaagccccaaaaacactatcaatatatactttctatgattactcccctagcttttaccaaaactgttcgattacgaagccgtaatcttgctgtagagcctgtcataagatgatcataaaccgtttgtaaaaaactttttgaagcaactagtccttcgttcaggaaaaactgtttgcatacccatttagctaaaaacggtgtttttagtaactcttgctctataggtaacaatttccctctctcattatcaacgactcgtaacaaaaaaggagctgtttgctgatccaaatattctctcagctccgcagaatctcctgctaatgaaagcaaagggtcccttatatttttcccgaaaacatcttgtaaataaggaaataagcgctctctcattcgtgcacgcaaaaatcgctcattacaatttgtgatatcttgaacatattgaacttggtgactatcaagagcttctacaatcttatgcttaggaatgtgtaataaaggacgcaataaggcaacgtctctgtacatcacctgtgcagacattcctttaagattccctagatgggcaccttcgaatacccgttttagaatcgtttctgcttggtcatccgcatgatgaccaagaaagacccctgaaaagcacttttctttgcataaccgatagaataattcataacgatagcgtcgcgctgcattctctatatcacgagaatccataggatctgtagcttccggacgatctaaaataaatgggatctgctcttgttcacataaagcagctaaatcacttgcttcctgataagaagtctctcgccatccataatcaacatgcacagcagtaaagaaaatggctcgagacttaagcaagtacatcaaaaacaaagaatcgctacctccagacagagctagcaagtatttttttttcttgtctaaagaagaaaaaaaaccttctaattgcttatcattctcaaaaataaacgggttatcatagcatcgttcttaactatccacagatttacacaatttttctatgcgcatagttttgttagctaaaacgttcaactgattttctattacggaatcatcatgcctattctatggaaagttcttattttccgttatttaaaaaccacagttttctgtacgcttagcctaatctgcatttctatcatcagttctctgcaagaaattgtcagttatattgctaaagatgttccttatgcgacagtttttaaagtcactgcctaccaaattccctatctccttccctttatactcccagcatcttgctttatctcggcctttaccttatttcgtaaactctccgataataaccaaattacctttttaaaagcttctggagcttctcaaggaatgattatcttccctgttttgattgcttcaggagtattatgttgcttcaatttctatacatgttccgagttagcttcgatttgccgctttcaaacagggaaagcaatcgcaaatatcgctatgacatccccggcacttttgttacaaaccttgcagaaaaaagaaaacgatcgcatattcattgcgatagatcactgtgggaaaagtaaatttgacaatgtaattattgctttaaaacacaatcaagagatatccaatattggtttcattgagacgattattcctgatgtgaataaagattctgttcaggcgaaaaatgtcctagtcatttccaaaatccctctcttttcagaggctcgcacatctaatcccaacgagttctatctagaaactctggatgaattccttattccgaaaattacagccacgctattcgctgggaaatcgtatatgaaaactcgtacagactatttgccttggaaacagttaatccaagatgctcgtttgcatttagcagaaatactccgtagaattgctatcggcctattatgtagtactatgactttctctggattagccctaggaacttataagccacgtttccgcaagcccgtgctaatttatgccttattccctatactgaatcttattttccttatcgtagggaaaaatactatccatccaatttcagctgtaatgctgtttctctttccacagctcctctcatggcttattttttcttggagaatatacactgaaaatcaagggcatgcatagatatggttatctggaaacgctatcttctttctcgcttttggatttcgctctcttctttatttttcctagcggttatattttacgcctctattcatcattcactacatgctttccgagaagggaaaacagcgattgccggagctcctctgcagctttctctgctttactatctctctcaaatctctctaaaagcagaattcattctccctacaactcgttgcaattgcttcgacaattacactattttccatgcagagcaaaagagaaattctattactgcaggcttcagggctttccctgaaaactttganacgtccactagttatatctagttccctaattactcttcttctgtatgcgaatttccaatggctccatccgatttgtgaaaagatttcggtaactaaagagcatatggacaaaggcactttagaaaaagcccaagaaaaaatccctgcgctctatctgaaagaccaaactgttcttattttttcttccattaatcgcagagccgctactctaaataacgtgttttggattaaagggcctaaaacgatctatgcaatcaaaaaacttgcatttactactccatcgctcctatcgggcttgaagtgtcctatttttccgaagatgaaaatcacgaagtgtctttgacacagttctttgacatgaaagaattccctgaattggaattcagctattacgacaaccctttctccaagattttcataacaggaagagattgtagtttctctgcatttttacaagccattccttggcatgcagcgaaatttgggctattaactacagtgcctcaaaggatcctatctttgcttaccttattttactatatgctcatctcgccactattatgtatcgcagctgtgatcctgtctgcccatctttgcttacgttttcatcggctccccaaaattacttgggcatatctagtcctctgggaaccattaatattttctttgttgttctgaaagctggaatggttctcgctaacaatagcgtcttaccggctctccaggtgatgtttattcctgcaggctttatgcttttaattaccctttatgcttatcgaaaacttgcttaaatacctgagaattgccacccctctaaatcataggaaaagagcgttctcaggtcttttagattgtggcgattttttcttaaacaattcaaaaacttactcaatagttccacatgttgagcaaatactagccgatctctggctactaatgtgggagctaacattctagcaaccattcgcttcaaactgtcttcatcccaatttcctcgattttcaaagaatgcaaaaccggaaacaaagacagatgcataatctaacccatctttggacataattactaacgtattaggatccaattgctcaatcagattaaaaacaacaaagtaatagattaaatgtagaagcaaaactttatcatttttgaataagattttnntctttgagaagaaaacgttcttcaaaagaaggaacaaataccttctaaagaacactcccatacgctctttcatttcttctggaagaacacagtatccttgggctttaggtttgaaaaattcttgctgtacgagagaaaagaaatccgcaaacgtttctaattccccatgcacttgctccaatccatacaaaaaatcttctggttctggaaatgcactcatatacacagaagagtaatcttgcaaagattcttcaataatgcgacttctcgacgtcgcatgctccggccgccatggccgcgggatgattaccaaaatcttgtctccctgacatgttttcgcatctagaaagtgtaagaactctccattacagttagcataaaggatagagctttgcgaaacagggcttggtgtacgaagtactttgatctccttatctccttgtataagcttaccttcaaggcatgggagaatgcctaataaaatgggatcaaactctttcaagtatgggtcaagcattctatctatagctttgaataatggcccattaggatatttggagaacaatcgatgtaactcatcataaatttcagcaacatactgtcctgcagataaaggctttttcccttcttctggctgaagtttcgaagagatatttaagaaaatatagttagcagcttctacaaaatcaatagtgtgatcatataatttagcgctcaatgaggatactagtgatttcgaatgtttttcttgtaaatcaagaagatctttttcattcaaaagcgctgcagcttttcttagaaaatgcaaaaagtcattaaaataactgagattttcttttctaggttgctgactcactgctgtagcttcataacgagctaaaaacaaagccatcaatgcgttatgtacattcaccgtcaattcggcactcatattcgtaagagctttttgataaaacaaccgaattggcatatcattcgtgtaaactaaggaagaagctaatttcgtgatctcatcactattccacacaattgttttcgttaagggatcattttcatgcatcgactcatggatcttccctntgcttatagataatttgcgctaaagcatcggtataaaaccgcttattatcttcatttgccatgtagaatagttcataagaacgatcccgttttacttcgacaaggttattaagaaattcctctcgatcctggcagttctctaaagagccatttagtatttcttttggctctaccatcttattattcagatgttcacgagttacatcataagtgtggttcagatgacgataatcttgagacagagaccggtacacctcttctttacgatcctctagaaaagaaaagacatcctgcactccagcaatcaaaaagtctgtctctttaatcactttatctacatctttttgagagagagctcctgcttgcttgaaatagtgatctatataatgcatagccttcttcatttctgagagagccttgttgtgagacgatgcctcagcgttcccactggaataatcgtaagaaatcttttttaactgctctaaattctctaaagctttttcaaacttacgagtcttttccatgcctcccccgagagctagtgaaaaatagtctttttattatttcaagattgtcttctagtttattttataaataaattagctttcaaatattttattttataaaaactaaataaaaagaaattataagcgcttattttgcttataacaaaataactaagaacaaaaaaaacccttcagaggaagagcctcaactcttaccccaaaaggttctcgtaaaaaggaatgcggaagaagagggattcgaacccccggaccctttcaggtctcctgttttcaagacaggtgcattaaaccgctctgccattcttccttaagaaaattgccgtaaaaaccgcaaatcgttctcactaaacaatcgaatatcggaaataccatacttgagcatcgcgagacgctctatacccatccccaaggcatacccagaatactcttctggatcaaagcttgccttacgcaagacattcggatgaatcattcctgctccagcaacttccaaccaaccagaatgcttacacaaagaacatccggctccatgacattcacaagaaatgtctacctcgatccctggctcgacaaaagggaaatagctgtgtctaaaccgcaactccactttgcgtccaaagaagatatggtaaaaccctgccaacatcgatgtcaagtctgaaaaagaaatatctttatctacgcagaaagcctctacttggtgaaaaatcacatgcgaacgcgcagaaacgtcttcattacggaaacactctcctggagcgacaattctaacaggaggtttgtttctcgctaactcccgagacgcaaaatccaacggggccgaaccaagaccgtggtgggatccaaatagaaagtatcctgcatctgtcgagcaggatgatcttcttcgaaattaagaagagaaaaattgtttttttcactttcgatattaggagcttcccgaacacaaaatccaaagcgaacaaagatatctacaacatcatcaaggactttcttgataacatgcttaccaccaagagcagcttcttcgctaccaggtaaactgatatctatcttctccttaaggaactcttctgcttcttctttagccaaaacggccttgcctctctcgagtaaaacttcctccacgtattgcttacaagcgttaatggaagcgccaacagtcgctttctgctctatagggcacttcctcaactgatcagcaaaaccgcgaaagattcccttctttcccaggtattttactttcacatcgaaaagatctttagaagaatgcgcaaggcttacatcacaactaaactgctgtttaacagcctcaagttcctcttgaattgtcataaaactctatccctgaacagctgcttccaaagcgagtttagcttgagtagctactacagcaaacccttgagggtcatgaatagccatctcagacaacatttttctnttaaatgaataccagcttgtttgagaccattgatcaaacggctgtaagacaatccatgaattctggaagccacattcaaacgagtgatccaaaggcttcgaaaatcacctttacgatcttttcggtgcatgtagttaaaagccatagcccgcataacagaggaccggctttgacgaaagtgtccctttctatctccccagaatccttttgcttgttttaaaacgcgtttacgacgcgatctagaagctactgaaccagttgctcttaccatatctaaaaccctctatctttaaacgagcatcattcgcttatacatgcccacctgaccttgatccactaaaggctgtttagacaggttgcgtttctgttgcgaagatctttttgataatttgtgtcttttccccggacgagttctttttaattgaccagaaccagtcaatttgaaacgcgccgcaacggacttattgcttttcatcttgggcatggactttttcctgttttttcttagtttttagtgttcccggagcaataacacagatcaaagaacggccattcagtttaggctctgactcaacaaaacctatgtcctctaagccctgacacattctttgaacaaccttatgcccgtgttcgggataagccaactctcgcccccgaaacatacaagaaacctttactttatttcctttctcaataaaggctctagcttgctttgctttcgtaaganngtcgttatcatcgatattaggcttaagcttaacctctttgatacgcacttggtgctgtgctttcttactatctttctcttttttagttatgtcgtaacgatacttcccgtagtccatgattttgcacacaggaggctctgagtttgaagcaacctcaacaaggtctaaatcagcttccttggctaaatctagggcctcttttatactcaatatgcctagctgctctcctgcggaacctattacacgtaccctaggagctcgtatctgcctatttattcttaggtttaaagccacatctaccctgctaaaattagtaatcgctgacggagagcctaaaaaaaaccacaagccacccttccccaagaagagggatttctccttctggtctaaacaatctttcgcattcgcgacataatctaaacgcctccgctctagactgctacatggtacctataaatgaggattattatcaagtattgcgcctaaaacttcactccttcttccataagaagaaatgtgtagaccttttgaaccttcatacaaaacatttttttatttcaaaaaaactctcgatcgcccctggtaagcaggtccgctctttcataaaaataatgactcatatatactcggggccttccttccattttggcgccctaagaaaggaggaaaggctgagccttcgtattacagggcgcatagcgttgtactcttttttaggtgtgatcatgtcagtaatggcttctgacaaagcttgtgcccctgttcgcgcgagccgacctttcccaaagcaaaaattacgcggagctcgttttacaggcgctatacgctctggaaatagatccagaaggagaggattctctcgttagcctgctgatgacccgaaggcttctgtttcaaaaaagaatgctgcttacgccttgatgttttgtcgagcaattcgagcgaaccagcctgatctagatgctttgctcgatggcgaccattcgaaccacaactcttgctcgcttaacgattatcgaacgcaatatttcttcgtatgatgctctttgagcatcaacaaaaccaagattgctgtcctgttcctgtagccgttctaatagcagaaacgactcgccttattaaaaaatttagttattcggaaggaagttctcttatccttgccgttttgggttctatttttgaccacccagccccagccttagatactcctctcgagcccacttctatgtgtggttaaatacctatatttttatctttagcattaccatctatcacattagaatgacagagtaagggaagcgactccgtccaagatatcttgggcttgtgtcgcttcccttgaacagtcaacttttgcattgtatatcccatgaccgactctttccctttttctgttcaagaatctgttccattaagccgcttttccacttttcgcattggagggcctgctcgctactttaaggaattaacctctttgagtgaggctttaaccgtcttttcctatctccacacccaccccttgccctatattattattggaaaaggatccaattgcctttttgatgatcaaggatttgatggccttgtcttgtataataatatccaaggacaagagttcctctcggatacacaaatcaaggtcctttcaggatcttcctttgctctgttagggaagaggctttcttctcaaggattttcgggattagaatttgccgtaggaatcccaggaaccgttggtggagctgtgtttatgaatgctggcactactctagctaacacagcctcttctctcatcaacgtagaaattattgaccattcaggaattttactttcgatacctagggaaaagcttcttttttcctatcggacttccccttttcaaaaaaaaccagcttttattgcctcagcgacatttcagctaactaaggatcctcaggctgctaaacgagctaaagctttaatagaagaacgcattctaaaacaaccctacgaatacccttccgcaggctgtatcttccggaatcctgaaggcttgtctgcaggagcacttattgatcgagctggattaaaagggttgaagataggaggcgggcagatatctgaaaaacatggcaatttcattattaataccggaaatgcctgtaccgcagacatcctagagcttatcgagatcattcaaaaaatcttaaaaaacaaggtatttccttacataaagaagtccgtatcatcccctttcgcctctagccttgtcgtctgcgaaaaagaaataacctaggagcattccttctatttacagaatagtgggtgcatacttcccacatacttggatctagctccgtagccacttgctccacacaacataactctgcggctccttcttgatgcccaggataacaaacaacactgactattcctgaaggagcgactaattctaatgctttgtagatactggtaactgtggactcgctacatgtagtaatctgcttatctccgctaggcaaatatcctaaattataatgaaagagcttagctccctgctcttgaagatattcatgtgaacagagcttcatctcaataatcgctcgttcctcagctaataacccgctttgaaagttagcggttgctcgatccaaagcctcttgttgaatatcgtaaacaaccaaacgacctttccctcgtaataactgagccaagaacaaagcatctttaccatttccacaggttgcatcaacaatagtatctcctggctcaaccacctgtcgaaaaatagaatgagacagcttgattatgttactaaaaagtatatctatccctgttaacatcataagcctcttgaaaaaagatcccacatcatttataaaggatgcgagtcacatggggtattagctcagttggttagagagtcacgttgacatcgtgaaggtcagctgttcaagtcagctatatcccaaccctcttgatgaattccgtacagaaaatctcctgtcctttagatctccataaattttcgaaccaggatcctccgtaattgtctttgacattgatgtaatgagggctctttagacctggagaaaggtacttcaacatcactgtaatcgcatttaccagatagttataatcgtctgttgcaagagttaattgcccaccaactactagagtacgcatcatgtcttgaacgaaaagatcttgaaatagccgatgtttccgatgccgaaacttaggccaaggatctggaaaattgactacaattttttgaaacgatgcatctgatacataatgggaaaaaaaggtttgagcttctccacagacaataagcagattattcacgcgataagtacccattttcgaccaaatcttacggacccgatcaaaacgtttttcaacagcaatccaattaacggaagcatcttttaatgcttgttccactacccaatccccattccctgagcataactcacaacaaatagggccattattagcaaataactcttgccaagtaggaattacaaactcttcgtatcgagaatagtaattgggtacataaaatacatggtttgctatttgaggagagcgttcttcccaaaaatagggaagtttcaaatcttgtggtttcacaggaaaatacttcgtatgcgaaaggctacacctgctccaaccccaaacctcaccactctaacagtagtcataggagaggtgactagccttttccattttaataaaagggctacaagatattatgagaaaattaaaaaaaattcatgggtaaatacatttacttctaacctgaaaatctaaaaattcttatcaggttgccgtatgacaaaaaaaagcctcaactctatggttgaggctntctcctattttgatatcaggactaccaagttaagcttgctgcatgttgatattctgtatcccttgtttcaaagaagtttttctctttattaaggtctattgtttcgctcatccaagggaatgggtttttcgtatgataaataggttttaatccgattctttccaaacgacggtctgcaatatgctgcacataatcgatgaacatcgaagctctcaatcccaaaatccctctagggagacagtcttgcgcatactcaatttctaaatcgacagctcgcttaattaattcgacaatttcttgctgtaactctggagtccaaatctccgggttctcttcttttatcccgttgatcaaatcaataccaaagttcaagtggattgtctcatctcttaagatgtattgatattgttctccaataccaatcatcttattttgtctgtggaaggaaaggatcatcacaaacccactatagaagaaaatcccttccataatgatgtagtatcctactaagtttttaacaaactcctgtagaccctcaacagagtccgtgcgaaaattaggatctaataccttgccagtgatttccatctggaaatcatctttggccttaatcgcagcacgctcgttataggcattgaaaatttctttctcgtctaatccgagtgactcacaaatatacaaaaatgtgtgcgtgtgaaccgcttcttcaaaagcttgtcttaaaagatattgtctcgcttccggattagttacatgtttaaaaattgctagaacaatattattcccaaccaagctctctgcggtgctgaaaaaacctaaattcaaaagaatgactcgccgctcatcttcagaaagacgatccgacttccataattcgatgtctttccccatggggatctctgtagggagccagttatttgcgcagccattcaaataatgttcccaagcccatttgtacttaataggaacaagttggttgacatcgacctggttgcagttcactagacgcttgctatttagattaacgcgtttctgttttccatctaaaatatctgcttgcataagaaccgttaattttattgttaatttatatgattaattactgacatgcttcacacccttcttccaaagaacagacaggtgctttcttcgctctttcaacaataattcctgccgaagcagacttattcttcatccaacgaggctgaattcctctcttattaatatctacaaaagatttttcaacggtcgttgctgatgaagatctcagataatacgtagttttcaaaccttttttccaagccgttaaatacatattcgacagttttttcccgtctggctgggcaagataaaggttgagggattgccccatatcaatccatttttgtcttcgagacgcgcattcgataatccattctggttcaatctcaaaagctgtcaagaaaatatgttttaagtgatctggtatacgctcgatttccaataaagacccatcaaaatattttaggtcatctaacatatcagcatcccagatacctaatttcttcaacttctcaattaaatacacatttggaatcgtgaattctccggacaaattagacttcacaaacaaatgtttgtacgttggctcaatagattgagttactcctataatgttggagatcgtcgctgtcggagctatagccataagctgacaatgtcgcataccatgctctttaaccaaactacggataggttcccaatcttttcttgatgacgtatccatctggagatttgcttctcctcgatagttcgctaacaactgaatcgtatcaatagggagcaaacctctatcccatttcgatcctttataagagctgtaagtgcctcgttctttagcgagcagacaagaagcttgaatcgcatagtaagaaatcaactctgaactgtagtcagcaaattctacagcttcttgcgaagcatagcttatatctagcttatacaaggcatcttggaatcccatcacccctaatccaatagcgcggtgagcaaagttcgcctctttagcttcctttgttggataaaagttaatatcaatcacgttatccaacatacggactgctatagagatcgtctcagagagtttttcctcatctaacccatcccctacgatatgttgaactaagttaatcgatcctaaattacaaacagcagtttctgtctccgagcagtttaacaaaatctccgtacacagattggaacaacgcaccacgcctttatgatcttgagccgaacggatgttggatggatctttaaaagtcatccatgggtgtcccgtttcaaaaaccatgctgagcatttttctccacagatcttcagcttctaccttcttgaataaccgaatctctccggtatcaaccttccgctcatattcttcgtacaaacgctcaaattcttccccataagcatcgtgtaatcccggaacatcatctgggctgaatagagtccatgtccctttttgctgtaaacgtttgaagaaaagatctggaatccagctagctgtattgacatcatgagcccgtcgacgctcatcccctgtattctttctcaattcaaggaaatcttcgtagtcgaggtgccaaacttctaaatagacgcatacagctcccttgcgtttaccaccttgattcactgcgactgctgtatcatttgtcaccttaataaaaggaattactccctgacttcttccattggttcctttaattaaagcccctgttgcacgaatcgccgtccaatcattacctatccctcctgcccacttagatagcatagcgttatcagcaatgaccttatagatattgaccaaatcatcttgtacagtggaaagatagcaagagcttaactgagaatgccgcatacctgaattgaacagggttggcgtagctggtgtatatcggaatgtcgaaagcaaattataaaaagtaatagcccaagaagtcttgtcttgctcattcaatgccaaccccatagcaacgcgcatccaaaaaatttggggagtttctaaacggcaaccttcgtggtgattaaaataacgatcatacagattttgaatacccatgtaagaaaactgtagatctcgagatagatccatagcatcggctaacgcatctaaatcaaaaagatgtttcagttcagcattcagacgataggtatccccttctgcgatgtagcgtttgaaatgatcgcgatgtgcttgttctaaatcctcagcatatttcgatttccctaacgcttccttatatacaacgtcaagtaagagctctgcagcaaccaaggcataatcaggctccttttcaatattggcacgagccgccataatacaggccagtactacttcagactctttgatgccggaatagaaatttgcgaaagccatatcggtaagcagcgccgcatctgtcgtttctggaaaacgactacaagcgcgcgctaaatgagccaacaactgcgaatgcgtcattgtataggtagaaccgtctttactgagcacctcaaaagcttcttctgctatagtcttttctgtactcccgtcctcttctctgttatcacgaacacgagcgcgagcttctcgataaagaatatagttctttgcaatagcataatgcccaacaaccattagttgctgttcaacaatatcttgaatcttctcgatatcaatgcgtctatcctgttgagaacaacattcttctatttccgcgacaatgttttgcgtcaaagcattgatttcctctcgcacagaacttggagtcatcccctcagtcttatcggtagctcggaaagctttttccaaagcggcggaaattttcataggattaaagtgtacaacagtcccacaacgacgaacaacggataggctttgccaagattttttccgatgcgctttacggtcatcgcgatagacaatataatcgcgagcaacatcttgcaaaccattcacatatagttggctttcaaccatatcttggatacgctctacagtaaccacttgtccatctgtaatcttttgcacaacttctttaactacctgatgcgttatcgagcgtatggaactttccagatcttcaggcaaaggcatatgatcatcaattctgcgagtgtctcgaaaagctgcttctaaagcctgaaaaatacggttccgatcgaaaggaacaaacattccattgcgcttaacaattgtgcattgcttttcttgtagatcgaccataactatccttgtaaacattgaatacgcattattctctattttgaagcaaagacgcctctagtccccctatccgtcaaaaaaacggtagagagagcccttatcttatacttaaaaatcagagtattatcctttgagtatgtgagcccctaaaaacccaagatattgtgaatgtctcggctcttgtataccatatatagaagctagcaacgtttcctgcaattgaaaaatagcataaactgcgatgaaaaatttcttttcgagagcaaacttttaagcatgatgtcctacataaaacatctagcttttttgtgctttttttcttgcaaaaagaagcagcttacctctctatcatttcacttgctcagggaaaacacgcaataaccataactatctgtgggttttctgtgtagtgccgaaaacatgttttgtgtaacatgaccttaggctttacaaagaaagatgtaaaaaatatgcgctgtttagtccttttggcactagaaagttccaagtcaaaggagatgtatatttgtttgcataaatgcaaattcacgccataaaaagaagcttctctacaaaaaaataaactaagccccactgatttctgtaataaatttccgcgattcctgaggaagatatgaatcgaattgaaatagaccttcgtggtaagcgccgagttgtgacccctaatgccattacagcttttggtctttgctgcggactctttattattttcaaaagcgtgttgaaaacttcctcttcactagagctcatgcaccgcttacaggggctctctctactccttattagcgctatgattgcagatttttcggatggagctgtcgcacgaattatgaaagcggaaagtgctttcggtgctcacttcgattctttgtctgacgctatcacttttggcatagcgcctcctttaattgcgattaaaagcttgaatggagaatacggcggaaccttttgttcctctttcctcctggtgacttgtatcatctactctctgtgtggagtacttcgcttagtacgctataatctctttgccgctacgggagaaaaagcaactacatttacaggacttcctattcctgccgctgcagcatgtgtagtctctttaggcgtgctactagcctctgataccttgaacagccttcctgaacgagctcgggttcttctcgtctctctcggcctattactcagtggctgtttaatgatttccacctggcgtttccctggattaaaacacttccattttcgcgtttcctcatcgcttttagttctgggaatcgggttagtggcttgtctcttcttctcgggactagtggaccatttcacacaagtatttttncttgtctcttggttatacgtgctagttgttgctcctgtttttccctttattaataaaagatcttcttcttagtatatgggtgtcttcgctatttctttgctgtcgcaaactgtgtgtctatactttacattcttttcattaggaatagcgctgggagtgctcttctcctttaaaattttcaccaaaaagctatcccgacaatacgaaatcattcgtgatctggagcatagcaaggctattctacaaatgtctttagatactcgccgaagtcaagaacaaattatggaggagttctctcataaactgacttcggtatcccaggcgtttgctagagacatgaagacagaatctcaagaattcttttctgagaaaactcaagccattacctctgttcttgctccggtgcataataccttatctgctttcaaacaaaacttagaaaattttgaaactaagcaagccgaagaccgcggagtctcaaagaacaactctctcaattactcactgcagaacagaagttagagcgagaaacacaggctcttaccaatattttgaaacatcctggatctcgtggaagatggggtgaaattcaactagagagaatccttgaaatttccggcatgttgaaatactgtgactacagcacgcaaacagtagactccagtgagtcttcttctcgagcagacattgtcattcgtttgccgcaaaatcgcagtctagttattgatgctaaaactccattttctgaagagtaccttacggataatcacgcggatcctactgatctagtaaaaaaaataaaagaccatattaaaactcttaaaaccaaaagctattgggataagttcgagcagtcccctgaatttgtcattctctttcttcctggagaaagtttatttaatgatgctattcgctgtgctcctgaactaatggactatgcaggacaatctaatgtgattctttccagccctgtgactttaatggctttattaaaaacggtcacacatgtttggaaacaagaaaatttacaaaatcagattcgagaaattggacaactaggaaaagacctctatcaaagaatgcataaactgtttgaccatttccataaggtaggcaaacacttagggcaagctgttcatagctataatgacatgtcttctagtctttctgctagagttctccctatcctcagaacttttgacaaactagagctctcttcttcccacaataaaatcgaagcactctctcaggtaagcaccctacctcattctccgaaggttccttgtcccgaaagcgatctggcagaatgcttatccccagaggcttcttatctgaagcctccttcctcaaaccaataacttttggttttatttaaaatgcagcctctatttggaatgcttcattaagctctttagcgcttttctgtagcatttcttctccagcaaaagaaacaaatgaggcttcggaaaggcatccttcaagacgattacgtacaacctcacaaatttgtgctttagttgtagataacacagcctgacggaaagcttgacgaacgaaaggcaccttaccgctccgcgaacgatagtaggatgcagatccacgacttcctggagaaatcggatcatctaaattctgaataacaccaagaattccttcatgcacatcctcttctgagaaatctcccgcagccatatcacgaattccttggagcaatacctgataggtagtagccacttccggatctcggtagctatagcaataaaaagcacctcgccctaggtttgcactagcgccagagccgtaagcgcctccttgctcacgaattttagcatgtaaaatgacattccccaaaacctctgctgcaacagaaagaactgcggcatctggatgatcataagcaagtgagcctagaggaaatgccaatacattgtaagctcctcgagcggggattacaatgcctcgagaatctttcacgacatcaagaacaggatttttccagagctctccaccctctaatctctcatctaataaaccaaaaaatcgctgatcatgtagaacttgataattagctttactactactgatgacaagctgccgtcttccaacaaaacacttcttataaagcgtttgcaaccgatctataatttcctgtgcttgagagtcaaaattactgagcagctctcggatatacttgacataaggaagtcctgccatctgatatgctaagcctcccgcaatagatttattgcagcaggccaaactaaccgcatatcccattgggctatttctcacgctatttgttagagactctgcatgctgcattaaaagctctttgagtctcgcaatatccgagaaatctactgttgttaaagtttctcttatgacttggaacagatactctgctttggagatcaaagccttaccacggatactgatcgagggtgagagtcgatcagtatctgtagcttgagaagagaactcataaaggacatccactccaccagtatgctctaaaagaaattccaagtgctctttgtaagagcgattcccacttcccaactgtaacagaacaaaaacgagaaggcgtaaccatggcaattcttccgccgaaagagctggaagatcaaaaacgagttccacaaaaataatatcattagtgaaacagtcatgatgaagaacttcaccttctgcaaatacttctttctctaacacaaactctttccctaaggaaggaactttgtccaaagcaaatagaggtaacactttattcaatcttcttcttgcgactgatatgcttctaaacgcttagaaactgcctctactctctctaattcttcctcactcatttgcatttgaattgtgtgtagaacattacgttcttctttattctcttgggcaatcaactgagaatctgggagaaagatgacgcgagcataatgcgggttatctaagaaatacttccgcaccaatcgtggtagataatctggcttttggatattctctcgcaagttagcaaacaaagtatggattcttaacccatcctccgctttccctccatgctgtcttagtagacctgctcggaaaaacaatgataatccataaggaatagaataccctgcgatctccttccttgctaattctagctgatgcacagctccttcaactaaatgcatcggaattccctcttgaaggatctcctctaaactagctaaaattagactttccagtttctgacttcctgaatgagaacatcccttacaaacaatatatacagggatctcatgaagttcgctgtcaatactcatatcaacttgcttacataatccagatttcagcaatcgagatttcaaaggagctgcatccgttcccattaaaactagatccagaacatgtaaagcaagaagatcttgctgatcaaaaattgaacaagtaagccaagctaatccaaaaagcaccttatcttcatctgccccatcggaagggtatctttcaatcacacgtacaggttctttgaaacgtttctgcagaggaagagttacactttgcttctctaccttccctacacgtctcagcaatttctcctctaagaaatctaaatgacggcctaggtttaatattcccataaaaataaaaaagacaacgactgagcgtatactgactttcataaaaagcgcggaccgtttctaaattcagcgaaacaattgctttaggatctcctcccgaatttacaccgtaagtgaccgaagggaacaatgcggcattctaacttcgctgagccgagattctcccgacatcaaagcccctttcatttcattgaagacgatcccagtgtaagagagatttccttcctctgtccgttcatatctccaagcttcttgcaaaaagctgttctctgttaacaacggatggaaaacggcatcaatatacacactgagtagattataaaaatcttctggtatctgagaagccgcaggataacaagtgaaatcagcccctgtgaacgcattcatgaaggtatttaaactacgtcttgtcattgagaaaaaaggatcccgaattgggtaactctcagaccnncacataaggccatatgctcgagtacgtgagccactccactagaatcttgcgggcaagtccgaaaagaaatattgaacacattttcatcatcatcattcacgatcatcatgatcgttgccccggtcggagtatgttccacttcaattagcttgctctcgatctcgggaagatcctgactcaacttgactacaaaatttctataggtatccccagttttcatatcccactcaatcttctataatagagaagttgtttgctctcccctatttcgtttctacctaacaataagaaagacagcctacatggttagagctcttatatccacacaaatattctttctgaaggcttctcttattaaaaaaaaaagggactcgattgagtccccatactagactagcttcctaaaatataaggccaggactactcgtctgatttcaagacgatgaatcgcaccacatctccttgagaaaccataaggagaacattctctcctttcgagtttttcaaaacctgatttaactcttcaacggaagcgactcgctgcctattcaccgctaagataagctgtccaggagcgacgcctgcagaagctgcaggcgagcctgcctccacagcaactaccagaatccctcgggtatctgctgccaatccgagtttcttacaaatttctggagtaatgttctgaacacggactcccatcttctgcaacgctgaaacgccatcctctgttgggatctgtgtaaccgtcacaggtatctcgattgttttcccttcacgaacgatttttaaaataacacgagtccctggcatcattagggaaatggcattacgcaacgcactcaaagactctacttcttttccattgtaagccacaatgacatcttcttgncgcagccccgctttttctgctggagaacctttaacaacatccgtcaccaaagctccgtacactttttccaatttgtaacaagtagccaattcagaatctatcggttgcaaggtaactcccaaaaagcctcttgttacctgcccatcactaatcaattgatcaatgactcgtttagccatcaagctaggaatagcaaaccctattccaatatatcccccgctaccactgacaatggcagtattaaccccgataacttgaccattgatgtttaacaatggaccgcctgaattcccaggattaatggcagcatctgtttgaataaagtcttcgaaatctacaatatgtagctgatttcttcctttagcactaacgaccccgacagtgaccgttgcttgcaatccaaaaggatttccaatagcaatagcccagtcacctatctgcagctgatcagaattcccaaaagtcaaaaatggtaatttctctgcttgaattttgatcacagcaagatctgtttttggatctaaccccacgatcttagctgtgtatttttgtccatcgtggagagtaacatgaatttttcctgcatcctcgactacatgatggttagtaacaacataaccatcttcagaaacaatgaacccagttcctcttacagcatcacgctgctgcggacgctgctgctctctatacgaaggcaacccaaaaaatcgattaaaaaattcgtcattaaaataatcaaaagggttctcttgaaagcctcttttgtttcctggagaagcaatagcctggttccctgttttaggaaaattttctatatatacaactccaggcgttgccttagcagcgacccgagaaaatcctcgggatacttctttgagcagatcttcttgtgaaacctcttgatctcctgaggatactgcaagacaaatatcagccttagaatctttctttgacgcactatagcctagcattggcgaagagaaaactgatgtccgatagcaacacacataataatcttttcatcatcttttccttgataagcgatctgggcgtctaggcccctttttttttcattttatgcaccataacaagcaaatatgcagcatacaaaatctaatgatgcaaatcaaggaaactactctgatgattctccaatctaaaaaactaacgtggttttagaacggatgcaaccgcctctccaatcagtgcaggaaattctacaacggtaacccctgcctgtctcaaagcttcttgtttgctaaaagcatccccacttttccctgaaataatagctcctgcatgtcccatacgtttccctttgggagccgtagctcctgcaataaatgcaatcacaggcttactactatgttgacgtatccaatctgcagcttcctcttcagcgcttccaccaatctctccaatcataagaacagcttctgtttggctatccttttcaaactcttggagagcatcgataaaagatgtgccatttaaaggatcccctccgataccgatacacacactctgtccgatctttctttgcgtaagttgccaaacagcctcatacgtaagtgtacctgatntagaaaccactcctaccttcccaggaaggtggatatacccaggcatgatgccaattttacaaactccaggcttgatcactccaggacagtttggcccaattaaagagcttgcgctcttttccataagagaagctacttcaagcatatccttgattggaattccttctgtgatacagactatcagctcaattccancatcttcagcttcgaaaatggcttctgcagcaaacggtggcggcacaaaaatcatcgaagcacgacaacctgttgctcgcttagcctccaaaacagaatcaaaaatgggtaagtctaaaaattggctcccaccctttcctggagtaactcctccaacaaaagttagatccgtaaagcgacacattgtgtagtgtgaaaagaccctgctttccctgtaataccctgtgtaataatcggtaaatccttgcttaataattctaacacagtttctctcccagctaacgacttaattgcacagcgagttcagccccctcgctcatggatgtaacgaactcacaaggaattcctgcgttaataatcatgccctttcctttatctacattcgtcccttctaaccgaattacagtagggatcgtttctttctgtccttgcatagcagaaacaagtccagaagcgacgactgcacaatccataatccccccaaaaatatggataaagagcacgcgcacacttttatcagataagactaaagagatagcttcttgaatttgcttttcagaagcacttcctcctacatctaagaaattggcagcagaaccgccatataacttcagaatatctaaggtgctcatcgctaatcctgcaccattgactaaacatccgattgttccatctagagcaatgtatgaaaggcctaactgcttaggctagtacgtcacgaatattttcctgagaaggatcatagcagtctgctagctcaggatgtcgataaagagcattgtcatcaatcgtcattttggcatccagaatgacaagagacccgtctttagtaagtaccaatggattaatctctaataaagaagcatccttttcataaaaacattgtaataactggcgaatgatacgattcccttgatcggcaataggttgatcccactccatgaacttagcaatacggcgtaactgatacccataaatttttccagaagaaggtagtgtcattttaagcagctgatccggctgcttttctgcgacttcctcgatatccacacctcctgctttagatagcataatgacaggacaacgatgttttctatcgatgacgatcgcaagataatactccgaagcaatctctactaaaggggaaatcaatactttattaacaggaagagacaaccctgctgtctgattactagaaaattgcatatgcagtagcttatcagctgctgctaataagtcttccggagagtgcgcaataaccacccctccattttttcctcttcctccagcatgaacctgtgctttcacaacaccagctttccattgttcngcttgaatcgctgcttctacttcaggtacggaggtcgctacgtgataggggggaataggaagttgataagcagttaaaaggtccttagcttgatactcatgaagatgcataaataaccctttaatttttcctccttatcttttattattctttttacttcaatcaactttgattactcagtgttcaagtttttcggaaacaaactccgctctctttttaaaagaacgctttcttctgacttattagaatatgctgaagttctcttgtatgagggagattttggccctaagctgacagaagctttttgcgaagaattacgccgatgtaaaaatcctgatgaacgggcagtgaaagagcttattcgctctttcttatcaaagattatttctaagctcccccaacgagagcctctttctgttcgtcctttttctactcttgtcctaggaacgaatggctcggggaaaacaaccacagttgcgaaactggctcactattatctttctcaaaaccaaaaggttttaattgtagctactgatactttccgttccgcaggaatggaccagatgcgttgttgggcagaaaccttaaactgtgggtttatctcagggaaacctggaggagatgctgctgcgatagcttttgatgggatttctgcagcagtcgctagggactatgatcatgtgatcatagatacttcgggaaggttacacacacacacgaatcttcttaaagaacttcagaaaatcgctaccgtttgcaacaaagcttttcctggagctccgcatgagacactgatgacgatcgatgctactctgggaagcaacacaattgagtcagggtgcaactattccatgaagccgtacctatccaaatggacttattttcacaaaagtggaaggttctgccaaaggaggctctctcttccgtatcgcagatgaactcaaaatccctactcggttcgtaggctatggagaaacaattcatgatttcgaaccttttgccatagaccgttttctagataaattactggatgtttgaaactgaaaatcccctccttcttcacccataaaaaagaggtatttaggaactctaaatacctcttttttttcctagaaaatctattttcgatcgacctttaccgtctcttgtcagaagaggcaaaaatctgcaacaaataccaaaatatcataattacattgcagtacatctgtagagccatgatcaaagaaagcttataactaagatctccatgatcccctacgctacgagcaacacgacgaatagactgcgcatccactactgtcagacctacaaagataatcaaacctaagtagcaaattaacagatataacaacggcataggcgtgaagagagacactattaaaaaggctagagatatcactaccagccccacaagtgccaacatcaaaattctatgaatttgtgttaaatcattcttagtgaatgctccatacgctgctgacaatccgaagattataccagcagacccaaatgcggcccacactaccccgcctccaaattgagcggcgtatacgggtaccaatgttccaaagaacatcccttctagaatagagtaggccaaaaacaatcccattacagcagggacagaaagtttttgaatctgggcttggatatagaaggacactcccagcgttgcaaaacaccaaatccaccacatagggaaaagcgctctgtacgctcctgttgcgtataaccctagagatgttagagcagtcacagctagccctgccgtcatccacccatatactctggaagagaaggtccctggcaagcgggaatcctgcgcataatcgcgatcatacaatcccatggagatctcctaatttaaaatagtttttacataacttctttctaaaacgcataatacagggttgcnagatttaacacagtatatcctgttagaattaatagaacggtctttcctcctggcaatatccttttaccaaagcaacgccgtttcccatagcgtccattccataacatggctactgggaataacacgacaatgcaagctccccctattcccccagcatagcgtaaacaagacaaaacaatctcgggataaaaaatagcccacactaaaggaaatacctgaactaaaaagaacaaagatacccgtttcttacgagcatcccatttaaaaatatctatataaaagtcctttaatgctaacgcagtccctataaaagaagtaaccaaagcaaaaaatccaaataattccccggcaatataaaaagcagaattctttaaagatccttgaagagctcctgcagcagtccaccctaaatccttagcttttagcaagtcgactaagggaaccgtccctaaaaccaaagcttcccaagcaatatagagaattaaaggaatcaaactccctattagaatagcacgtttaacctcacgaatattcccatccaagtagtgatacaaagagggcaccacattctgaaatccaaatgctaagaagaaaataggcaagctattaagagaggaaaaccaggaagctcgcaatagcagttctccctgtatacgcggcacacccaatacgcagaaaagcccaaaaacaaagataaggccaaaaacaaacccccgattgcaataatcaataacagaagtgtttgccatcagcaaaggtgcaaaaagggagaaaaataaaaggggcatgacatgtcgcatccaaggataggagaaaaagctctctccgatcactcgagaaagaatatttcctccatcacaaaaataagctacaagtaaagagtaaaatagaaacaggtagactaaacataacactatacgtcctactctccctagagtttcttcagccatagagcataagttagcctgtctatttcccttacaccaggttaacacctccagatagccataacctgaggctaacgaaaccaaccaagcgagcacatatagcaccacggcagggaaaaacccttctacagctgtcaaaataggaacggctaacacaccagcacctattacagtccccgcaacaattaaaattcctcctacacacttattccgcatacacatcctcctccccctattttttcatgtcgataggggaatctttctcattacgcaatacgatccaatctatactatatggagaaaaacaactagcaaacagtcgcgctttcatcatttcgatctgtttacagaaagctcgcataaaggaaatcctgaatgcgagcttgagacttgaagtgaaggaattaatagcctagaaacttctgggcaatcaacaccaggttaagaagcactagccctgacataaccaagagagtccctttcccgccaggaagaatgcgtttaccgtaataacgtttctttccgtagcgccctttccataccatcaatacggggcaaactcctaaaactatcgtctcacctaaagcgccggtgcactccaaacatttcaaaacaatgcctggatagaaaacagcccacaccaaagggaaaacaaaaactaagaaaaagatttccactttacgctttttctcatcccattgaaaagcatctataaaaaagtcttttaaacccaaagagacgccaataaatgaggaaattaaagcaaaaaatccaaaaaactcccctgcaacataaaaagccgcgcatttcaaagctgtttgtaatgctccaatagcagtccatccctctactttcgcttgttctaagaaagaaataggaacggctcctaacacaatggcttcccaaatgatgtacagaaccaaaggaatcgaacttccaataacaatggccttcttcacatcttttacgttcttatccatgtagtgatacaacgtaggaacaacgttttgaaatccaaatgccaaaaataaaatgggaaatccttttaaagtagctccccaagcagatcttactaacaaatccgttttcataagagggaaaccgaaatagcaaaacatagcgaatgcgattcctaagccaaaaacgaaaaccctgttacattgatcgataatggatgttttcgccattaataatggggaaaacaaagcaaaaaatactacaggcatagcatgtcgaatccaaggagtatcccaactgcgacatcccatgactcgcatgagaatattcccaccatcacaaaaataagccaccaagagggaataaaagagcagtaggtatatcaaccacataatgatcttgcttttatggcctaaagtatactctgccagagagaccatatttacattctttcttgaatgtgtccaggtcaatacttccaaaaagcaatacccggaagccacagcaatgaaccaagaaacaatatagagtaacgtcgtaggcaggaatcccccttctgaggtagaaacggggacggctaatactccggcgccaatggttgttcctgcgacaagcaaggctccgcccaacattttgtttatcatgagaataccttttttagagagtcgcatggatttgcgacttctcgattccatctaagatacagacgcttatgctattcatcaagagagaaaaaactgtagattttactctacagtaacagatttagccaagttccgaggtctatctacttcggttcctctctgtaaagccatggtgtaagccatgatctggcctgctatcgtgaataagataggagcagcaaggtcgtggctatcggggatatagatctgctcgtcggagacagcagcgatatcccgattggattccggagcaagagcgatcacataggcctttctagccttcacctccatgatcgctcctatagttttagtgtatacagagcggtctccacaatacacaatcacgggagtcccctctctaataagagcaataggcccatgcttcatttctcctgcagggtaagcatttgcttctacgtaagcaatttcttttaattttaaagctgcttccatgcaaattggatacataaaacgtcgccctaggaaaataaaactcgtctcctcaatttgtcggcaacgccagtcatgaatagaactatctaagaaaagtcttgtcaaatttggcaaatctttcagaccttgtattgcttgcgctaagtcttcctgagcaatgacttggcgatggtttgctagccttaaacccaaaagaatcaacagcaacagctgagctgtgaatgcctttgtagaagcgactcccacttccaatcccgcctcaataaacagacaatggtcgactcgagaagcaagagcggactctcgtacattacaaatcccgagaacacgtgctttgctcaacttgcggaactcattaagagcggctaacgtatctgccgtttctcctgactgactgatgagaatagctagcgaatgctctgctatatatggctgacgataacgaaactctgaagcaatttctacatacaccggaatggaagcgatagattcaatcacatatttggctaaatagccggcatgataagaagagccgcaagctacaatatgcaagctctgaatctcgtccaaagagaacccttttaaaaaagattctgtaaaactgttctcttcacacgtgagatgtaagatacgctcaaagacttcaggttgctcatagatctctttgagcatgtaataatcaaacccttttttatccaaagaatcttctgtatggtctatgcaacgcacttccttttggatacgcgctaactcaaaattgtacgtctcgatagacttccctatacgtaaaacaactagttctcctgaagccaaggtttgtgtacagccagaatattttaaaaaagcatggatatcagaagaaataaaaacctcgtcttctcctaatcctaggatgagaggactttcatgagcagcacataataaaacttcaggatgatcttggtgcatgagagcacaagcaaaactcccctgtaagcgtttgagagtccacgaaaaactttgaattaaatctcttgtctctttgtaacgccttgcaaaaagttgtacgataacctctgtatcggtatctgatgaaaatactacgccctgctcttccagttcttctttgagtttttggaaattctcaataattccattatgcaccaaagcacaactcgcatccatatctatatgaggatgtgcattaaagcgggaaggttctccgtgtgtagcccatcgcgtatgacctatagctgcctgagaatggatatcagaagaaacagcagaacataactggcttacaggccctacagccttctctacaaacaagcggccttcaataagagttgctatccctgcagagtcataaccacgatactcgagttcagacaacccttccaaaactaaaggtacagcgttcttttctcctaaatatccaaatatcccacacatatcgatccttttattcggaaatcccggctccaatttcggcttctacaacatcaacaattgtcttagcaagggagtccacttgatgctttttagtcccctcgaccataactctgcaaatattttctgtaccagaatatcttaacaaaatacgtccagaatcccccaagacctcttttacttctttgagcaccccttgtacattagctaaggactctagaggcacctttttcgtcacagggacattgattagcgcttgaggactctttacgatacatgctgtaagatcggataatgtcgattcactttcgatcataatacgcaacacttgaagagcagatacgatcccatcccctgttgtattgtaatcgagaaaaatcatatgcccgctttgttctcctccaagcacagcttgattttccaacatatgctgcaatacatgtcgatctcctacaggagaaattgtaacttgtatccccagactttctaaataacgcaatacaccaaaattggtcatcactgttgccactacacgattatcaggtagagcctgtcgtcgttttaaatcacttgcacagatgcttaacagcatatctccatctacaatatgccccttctcatcaaccatgatcagacgatccccgtctccatctaatgcaattcctacatctgctttgtgttcaataactgctttctgaatggtagaaggccataaagctccgcaccctgcattgatattacatcccgaaggttcacacccataacagatcacttctgcgtctaattcttcaaatacggaaggagctactcgataagtggctccatgagcacaatctaaaacaatacgcaaaccttttaacgttctccctttcgggaaggtagccttcgcatactcaatatatcttcctgttgcatctttgactcgtttatttttaccaacagcatgatcatcaggaagtttcccaaaatctttcgaagcaaccatggcttcgatacgctcttccactgcctggccaattttgaatccatccgaagagaaaatcttaattccattatctcgataaggattgtgcgatgctgaaatcataatcccagcatctgcacgataagctcgagtaataaatgccactcctggggtagggataggtcccaacatcagggtttctatccccatagaagtaagacctgctatcagagcattttcaaacatatatccagagagtcgggtatctttaccaacaactacgcgatgcttaccggcatgtttctctaataacacccctgcaatggccttaccaaggagaacagaagtttccaccgtcataggctcaaagtttgcccgtcctcgcactccgtcagttccaaatagctggctcacatcacgtgtcattgctctatccctaagaatatcctttggctcaaaactaactgatccttgattttcagagataaatattccctatttttatcaaaatctttgcaattcgccttcttaagacatttcctcaaacatcaatctgggtatcaatagcttactatttataaccaaacaaaaattcaaacggccattcactttttaaataagaagtaagaaaataattatcgaaaactaaatgatttatttttttgtttttatgaccccctatttgatagaagctttagttgcctgttgcattctgctttctttagggatggtcttgatttttgcctttaccatctgcctactgctcaagctccataagattatgaaacttgtcagtcgaatttcttctctattcaacttcgaagctcgatggcttgcacctctattgattggcaaaaaatttattctaaattggttacgcaagaagtatgccgaccggaaaatgtctcagctagcagacgaacttgaggataatgaagactctgaaaatagttgcagcagccgcctactttgtggagccaaacttgccgctatagccctatgcgcatggctcttgataagaaaaaaagattaaccttgtttgtggagaaaaggatgttcagaagccaaaaacctaaaaaaaataaatgttgcttatggttgcgaggcgtcctattcggagggttcctagctacactacttactagtcttttcctccctaaaagtgggatgcaaatcagaaaaaagcttctccgcgtcaagacatccggcacgaagaaaggccgagccctactcaaaaactctaagcaccacacacgagaatttgcagaacagaccaaactgctggctaaaaatatttccaaagagattcaagactttactcagtccattattgatgaaagtcgtcgagattaacgaatccaaaaaaaatagcctggtcttattactacaggccaggcttctattaaaaaaacaacgaattagacattcgtcttcttctatatcgaaccacgtcttcctggtttgataccatgtttttctttttcgaattccatcgcttcatgagccatctcatcaagattctctgtagctttgtctaattcttcacgcaactcttgtttctctgactctagatctgtcactttctcttctaattgttgttttgctgcctccagatccgtaacggttgttaatttttgctccatttcagctttctcttccagccaagtttttttctctttctgaagattgactttttctatggtaagaacacctgtttgcttatatagcttcataattttctcaccatatttttcaacaacttgctcatacttcgtcacatcttccttgtgcactgcggcagcatcgctccaaccttttgaaaggaattccacttctgattgcaatttctgatttgcttcgagcatgtcagccattacaattctaaactgggatttttgctctatccaagacttaaactctttctgccaccattgagatttctcaactngcaagcataaagctgataccaagcagcataaaccgacggctacgacgacagcagcaattatagcaccgattaatcctaatccggaagccatagaacatcctcctattcctatagcaagaagtcccaataccccagcaacaacacagatcaatcctgcgatccatgaggttttagcaagaggatccttccgagagccttggatctgctttgccatttcgatatctntcgtgaaagtatttatagaattggagtttgaagtacaagtattgggaagagtagtcatcgaatctcctttaaatgatcgtcatgcagatggaccaaaaaaacagcctcagacctatttctgcacaaatttttgtttcctagcgaaaaaaaaagaaagattctatcttctcctcaacttattgactagctaataaaaaaaatccctaatctctgatgggagattagggatagaatggttgctgttagctcttccaatccattaaaagatcaatcgcaatccagcattcgcctcatatcctagtttactatctgtagaagtaaatcctccacaaaaagctgttaatcctaagactgtgctgaagtaagaactccattccgtattattttccagagcgacacgcagctcctgtctaggaagatccattggagctccctcccaatcaaacccagcttctaaaagctgcaccgcgcctccttctacttttcgataagcttcccatgcataacttattcccaaagagttcacctctgaaaactgtccttttatgaacgccaattcaaacttcatccctaaaggaatggtgatattggtaagggaagcgtcttcaaaagaacgcgcttctcttccttgttctgtaaagccagggaatttcatagaagcataagatacttcgacataaggattgaaatgcaaagcataaaaagtaggtctcacaggaccaactaaacttcggtattcaactaaagcatctgccagtactcctcgagatgtccaagaagcactcgactctcctagtactccataacgcgttttcatatcgttctgtgtttctccaaggctatattgtcctttgaagaaccaggatccagctaaaaatcctgtatatacagaaccaacaactcccttccgagaaacctccgcatcaaacttctgactatccattttacctaggaaagcagctccactaactcctagaacaaaatcttccatcaattgaatatcgactccagcagaagcaccaccataagctcctttgtatccatcaatagcaaccagattctctgcagatagagttcggaaaccaccaaaggcgaatccccacacatttgtagaataatcgaattccatacgctgagcagtgagattaatcagcaaagcgtgcatttttcagagcagacaagacagccccttcttcccataatgcattaaatactaaagcccctgctttttgaggatctaatcgatatccagtaggattccaattaatgacaagagttccatcttgaattttagcctcagaccaatctcccatatggccgtatgtgtcttcttcaatctctggagttgctacatgaatctgtaaatcagaaaccgacaagttactgatttcggctgaagcttcatcactagaagcaacgaaagacatcaatggaactttagcctcattcttcaacaaagcatgattttcataaccagtacctgttgtgttaactaactccaaattaagctctccagatcgaacataacttcctccaggaacaataacctgaggagcttctactgtcccctcctgttgactagaagagaaggaggctaaatctacagaaatagtatggatatcaaccataggaactgttgtttgagcattcttcgcaatccaaagagaatgtgcaccctctggttcagaagatgactcgatttctgcttcaggtttactgatagcatgcccttgtacaggagttcctgaatctaaaatcttcagtttagatccagcagccaataccaacttagctccagcatcttgtttaaaaccataactacataatgtagctccatttagcaactcaaggcttccttgttgtacatgaatacattgaggaactttactttctgcttctaaaaatcgaatagatccagtgtaacctggattttctcgactattgattaacaatacttcagcagatttcctttcttttagattttcaaaaactaatgcgtcgtggaaaacaatagcatgtccttccgtagcattcagggctgtaatatgcgattctttacctgcaaaatagatagcatcggatccttgtgctctgaaagaagaatttcctttaaaaacaatatctcctccaaaagcttctaaaagaacattaccatgatcctctatacgaacagctcctcccgaacaggccacgttgttataaaacagaacattccctgtattctgagaaatcgtcaaattttgagtacaaatggctcccccacctgtatgaggaagatgctcatcacgcttcgaggaatttccggaaaaaacaacatcccctgcattgcctgagatcaagacttcagggatttgcccatctaacttatcctcttctcgaagagaacctgtaaaaatggcgccgccataaatatcagagaagttattcgagaatacaacggcctcttggttatctacaatacgaacccgttttgcaaaaatagctcctccagcacactctcttcttttcgcaagttcttcagaagaaatggatgactcaggtgataaatccccatcttcagatgcgaaaagagcttgattagctgcagtaataaaactctgttctacactccctaagaaagaaagctcattattgtctttttgctcaggagctggctctacctcttcaaccttttctacagtttcttccacataaagacgtgttgctatgttgtctttaaattcaactctacccttgtttccagaaatgactacatctccacgtaagcaagaaatagcacccccataaaccctccctcgattatctctgaatagcacatagccgttatcaactagctcacaatttccttcagaagcttgaagagctcctcctcccaaactagcaatatttcgagaaaaatcgacgcttccatttccagctaactgcactgttttagataaaagagctcctcctgagactccttgtcccattgcgtaattattaccaaatcttactgaagagttgccaacaatcgaagtgctatccatcccatgaacagcgcctcctccacaacaacctaataatgtcgcttcttcttcgctgcactgcaaacgattttgctcaaatactactgcagcgttgtggagaatagctacttctcttcctaaaatcgctcctcccccagaatatcctgaagagagtggtcgcccttcttttttgctgaataaaggaaactcctcttgagttggaagagcttgtggantctcgcatttcctgtaaaagaaattcgacggaattattggtaatttccaccttaccagtagctaaaatcgctcctcctcccagaattttcccattcgaagcaaaagtcttcacaatgttgtctttaaaggtgagcacaccagcattctcagaaagagaaatattttcaccaaatagagctcctcctccctggtactccatttgtcctaaatctgaggtcgtacataaagtacgagagaacgaaatcgcgcctaaattcttcgaaatatcaatagtccctaaaacagaagcaccgcctgcggaagaaaaagatccacacgcaatacctcctccgaaactagccttacctccctcgaaggaaatcccagcctgattgttctgaatagaaacaatttcttgagctgcaatagcgcctcctcctaagcaagctgtactatctctgaaaaccactggcccctcgttgtcagaaatctgacaatttttgccaaaaatggcgcctccttgcgaagcagactcattcttatcacaagttatcccgtgattcccttgcaaaagaacggtgcctagagaagatatagcccctccacctaaagaacctttatcctctgttccaattgcacaattgcctttgaaaactagttctgcgcagttttgaaaggcaatatcagaagaggctgcaatcgctcctccagacaaagctcggttctctataaaagaagtctttttatcattagcgacaaaaagcactttcccagaggcagcaatcgctcctccattagcaaagttcgcgctgtttccttcaaaagatatagccccatcacaattcgcaactaccatatctcctgcaggcatatagagacttttctctccagaaagagaacccgtaacaaagaaagcgcctcctccaaatccaagatgatcattcgcactagacccctcagcattcacggctgtagtacagtgtttaacctgcaatccttgacaatcatgaatcaaaatactttgagctccacaagctcccccctgttctagagaagaacatgatgcaaattccaatccacccttaatcttttcaaagataagatcttctgtagaatataaagccgctccagacaaagaagctttcacgtcagttaatgtgattccagccttactactatccccaacaaaagcaatacctaaaaaagattctccgtcacggggagaatcaaggttgctgctcgtaaaactacaaattaacccttgggaagagacttgatcctgttggtccacaccttggaaaaccacgggattggttactgagaacaaagtactttgctctaccttcccgggaagagtatctgcatctttctcttggaaagaacttggatctcctacaattaacctatactgtccttcagcctgactatctttagacccaacgaatagatctcgaatttggtctaacaataaaaccgcttgagggcctacatataccagctcatttacagactgtcctccagcatgaagatctacgcaactagctaacccgctaacagaggcaaggatagctgctactacagacaaagaaaacttagaacaggtgctttttatatctttctcggaactcatttcaaacctgcgaaatagcacttttttgacaaactagcgtaccgaaacaatcggtccaacaacgcgttctgcctgtgatttcacaaagacaaaacgacccatagacaagctccagagacgacattagagcttagaccgtggaatgtacaatgctgactgctttttgagaaagattttttataaagaacagacccttaggccactgaaaaggtgatcaagctaaactacgttatcaccaaacctgtctgcaatacgactacaaacattagctcgtgctaaatcaatcgccccggaaattcctccgaacaaagctgttccatgagatttaccatggcatttaatcactagtctagataagccactgataatagaaccaggatagattgtgtaatcaaactgcatcttaatcgatttttccaaacgatccccgagaatatgtcgtagaaaatcgaataacccttccgccgttttcaaaaagacattcccagtgaacccatctgtaaccacaatgtctactttgccgctaaagacatcgccactttctatgtttcctaaaaaagcgctaccaaagatgttccgaagcatacgaaaggtctgtttatgagaatccgttcccttgcgttcttctgaaccaatgttcagtaacccaagagtaaacggctggttactgttagaggacaacgattgccgataagccaaacccatacgagcaaaacctaccatctcgtcaggattcacggacactgtggctccgacatctaaaataaccgcaaatccagaaagagtcggaacagaaaccaacaatgcgggtctaggaacagccggaatcataggtattttggaacgagcaagcgtcactaaagctgctgtatttcctgaagaaacaaaaccgtcaagatccccttgctgcaatgcatccaatcctagagccatcgaggaccgctttttacgaacagcagctaataaggaatcttccatagagacaaaatcctctgcggtcacgatccgaacggaacgagacagcggagaattcattaattggtggtgaacatccgacgtagcgaaaacagtgaactctactggctgttcacctgttgacgaaagaagaacttctcccagtgcttcccaaacaacgagaggatcatgatctcctcccatcatatctacgcctagacgcactttcatgaatttcttttacgtgctggattacttctcaaccgtaataacagctttgcctttgtaaaaaccacaagaagcacaaactgtatgaggaataaaagcttgcttgcaattactgcacaccgcagcggaacatgctttctttgcatggtgacttctgcggatgttctttctagcattgctatgacgattacgtggtactgccattcctaacttctcctatagactgcagatagctaccctccccaataaggaagtctggggatccccaggattcaaaaagcgatgcattttgtggaacgactccccaaaatataccgcgacagacaagggacaccccctctcttcgcagtgaaaacgataccaggaagactcgctctctattcttctcccggcgaacacgaaagtatattagagaaaaaggtttttgggaagtcgaaggttttttttctctctctaaagagttacgtcccgcctttttttcaaaaagtttttgataaactctcttgcaggacatcctccttcctggcactcctgaaaacgatccccctctaacaataactcatcccgaatcaaatcacggcaatcaaacacccccgatctctcatctgaacaatgaattaattgttgaatcacgatgccctgtactggccattcaacaggagcatcacaaatcctacagcgaagagaaagtatcgtagaaatttctaaggacaaaaaccactgctctccacttaccatttctagactcccccgaatttccacaggggaacacataccctcttcttccgaatcgcaaaatacctgaggtgggatcgaagcatgaatatcttctctatcccctggaaattttaatcgatgaagataaaatttcacgttatcgtcttttctcaattagccttccgcggatttcaactttcattcttaaattataattcttccaaatatcttaccgcgaaactcttatcgatacaaaaggttttccccatacttcccctaacaaataggttgcttctagacaaaaataggggttatgaaaataagtttttaaaaaaagtgtttgcagcataaggaacagccttcttatcctgtcgctgagcaacgaaacacaaggaaagcggattgccaacaagaataagagttggcagttgtcactatagaaatcacaataaaagaaacaaatcagtttctaaattaaactattcaacaacaagcatttttgtagaattttttacctaatcgacttataatccgccttctgcttaataaattttaaaataactccccatcctcggaatcaggtgaggactcctgtagagcgcagagcatttaggaacgccatggaaaacgatatcttactaaatatagagtctaaagagattcgttacgcgcatttaaaaaatggccaattgtttgatttgatcattgaaagaaaaaaaattcgccagttaaaagggaacatatatagaggtcgcgtaactaacattttacgaaacattcaatccgctttcattaacatagatgagcgggagaatggctttattcatatctcggacgtattagagaattctaaaaaattcgaacagatgttcgatatagattctgatgcagatcacgcagaaccccggccagaagaaacctccgaagctcctatagaagagctactcaaacttgacagtcccgtacttgttcaggtagtgaaggaacctatagggacgaaaggagctcgactcacttctaatatttcaatccctggacgctacttagtccttctaccgaattcccctcaccgaggtgtttctcgtaagattgaagaccctctgatgcgagatcaactcaaacagttaattcgctcttttgaaatgccccaaaatatgggtcttatctgtcggactgcgagtatctccgcttcaacagagactctaattaacgaggctcaggatctcttgaatacttggcaaagtatcctagagaaattttattctccagatcatccttctcttctctacgaagagacagatattctgaaaaaagctgtgatgacttgtgtagataagagctacaagcgtttgttaatagacgattacgcgacctatcaaaaatgcaaacgcttattgggtaaatattctccagacacgacggtaaagattgagtattatcgcgattcggttccaatgttcgaacgctttaatattgagaaagaaatcgatcgcgctaccaagagaaaaatctggctgtctagcggaggatatctcttctttgacaaaacagaagctatgcacacgatcgatgtgaactctggacgtagcacacagctggaaaatggagtcgaagagactctagtgcaaattaacttagaagccgcagaagaaattgctagacaactgcgtctaagaaatattggcggacttgtgatcatagattttatcgatatgaaatcacgcaagaatcagcgtcgtgttttggaaagattaaaagagcacatgaaatatgatgctgcgcgctgtacaatcttgagcatgagtgaatttgggctagtagaaatgactcgccagagaaatcgtgagtcactaatgcagaccctatttaccacctgtccatattgtaatgggaacgcgatcatcaaaacctctgaaagtatcctcatagaaattgagcgtgacctgaagaaaattattaaacacaaagagcacacgaacttgtgtttggtcgttcatccggaaatcgcccactatatgaaacaagagcaggacgatgtcgaactcattcgcttggctaagcaattgaaagctaagctacaaatcaatacgtccgattctatccatcttaaccactaccaatttttctcattgattacaggagaaggaattgagttataaataggtgtgttgatgcatttttcaaactgtttatatcaggcttttgaagatcagcttttaccagagcctttgtaccaaaagtttcaaatttgctatcaaacctacatcgaggctgcatctaaaaaatctccgctgagaaagcggaagctctttgttctcaatggcttaaggtcattattgatgaccttaagaatcctattattttccctccctaccacaaaaaaattcgctcgccaattgatctttaccaatttggcatcgactttttttctgcgctgattgaccaccaaaaatcacaaattctacatcctgagcgattggatcagattcaagaatatatccaagctggacacaacgtggtgctgttagctaaccaccagacagaatcagacccccagctcatgtactgcttactcggagcctcccatccgcaactcatggaaagcatgatctttgttgcaggggatcggatcacttcagatcctctagcgcgaccttttagcatgggatgcgatcttctgtgtatttattcaaaaagacacatcaatcaccctccagaactgaaagaagaaaagctcatgcataaccaaaaaagcatgagaacattaaaaatgcttcttagcgaaggagggaaattcttttatgttgctccttccggaggaagagatcgtaaaaatcttcaaggagaattgtaccctgcagaatttcatcctgacagtgtagagatgttccgcctccttgccaaaagctccgggaaaacgactcatttcttccctttagcaatgaaaacctatgatattcttcctccgcctccgacaatagaggaagcgatcggagaacatcgcgtgatctcatttgcccccgttgcttttaactttggagacgaactgttgctcgatgagctttgttcttccgaagaagcggatatatatgataaacacgccctacgtgctttaagagcctctcgtgccttctctatcgtgaccgatctctacaaagaaattctaacttgacgaaccccctggccttttgataaaagcctcaacccggtggttgcgaaataaatggacaaccaccttcctgttatcaatgaccctaccaatgaccccaaaaatatgaagcgttccctatccctattacttctttgcattccttcttttctaactgcttgctcgaaatcctttcaaacgattcgagatgaaaaccctttgactattttgacccctgcattagcagatcaaaaaattgctaaaattctatgccctaacggactctctctcatgattgtatcctcccctcatgctgctgagtccggagccgctttagttgtcaaaacaggaaataatgcagatcctgtcgaattcccaggcttagcccattttacagaacactgtgtgttcctcgggaatgaaaaatatcccgagccctcaggatttcctgccttcctaagcacacatgggggtatctataacgcatttacttacccagataaaacctgcttcctattctccgtaaacaatgcagatttagataatgctctggatcagtttgtacatctctttatccaacctctcttccgccaagaagatttaaacaaagaagttcatgctgttgagcaagaatttgcgatgcatccaactaaagattctcgtcgtatgcatcgtattcaacaacttatagctcctaaaaatcacccattaaaacgctttggctgcggcaatctctctaccctcaactccgtcactactcaagatatgcaaacatggtttgccactcactactctccagaaaatatggcagcaattgtttacactacagctccgttggacaccgcagtgccgtatatcgcgtccctattctctgaaatccctatatctgcacagtacacaccacaaaaaccgtttccaaagacacaagatactactgctcttaataaactgttcatcaataaggctgtcgaaccttctccacaactagctatttactggcatttttatgatgctccacagtccttacaaggatgggctcagtcactgatttctattttatctagtgaaaaagaaaatagtcttgttgctttactcaaaaaagaacagctcattactgagatggaagcagaactttacagcacttctcataatacacaagattttgaaattctttataaactcaccaataagggggaacgcgaatatcaaagagttttgcagctaacttttgcttttcttgattatgttcgtcatgaacgacttcctgcctactccttgccagagatacagaaaatcaactctttagaatatacttacagcacgcaaaccgagttattctcgacactatcacgaatggtccccaattttacttctgaaccattagcaacatacccttatcgctctcttgtctatccagaatactcccaagaagatgaacaaacctttgctacatttttagcagaccctcaacaggcacgttatatcttatctgctaccctaccgagttcttgggagaatgcagatgaattctatgatcccatctttgacgacactttctatgaaaaacccttagatttcacacctatacaggactcctcctccttaggatttgcttttccaaatcccaataaatttattcctcaaacagtccaattattatctcaaaagaaacaacacgaagggtttgctttttctccgcagctgacctatgatcaaaatgcgatcactttatatacttgtgaagactctttctatacgattcctaaaatagctatggagttgcgcatccgttctcctcaaattcaacgaacagatgtgcgttctttagtattacgagacctatatagtctactagctaatgaaacattaataaaacgttatgacgatgctttaaaagctggaatgacttttgcagtatctcctggagcgacaggagttgatctttctcttttaggatatactgagacctctcctgttcttatcaatgctttactgtcttctttacgagatcttcctgtggaagaaagtctgtttctatattacaaagatcagctatcagaacaatatcagaagaatcttattgcctgccctataagagctggtctcaataaactatactctcagattcttgttgataccgtttccttagaagntaagctcaatactttaaacaccctctcctacgaagagtttgcgaacttcacgaataaactactccaagaactagctgtagaatctttagcactaggaacgctctcggctcaagatctctccaatttattatcgactctctctaactttgcagaagcttcgtctccttatgctgctcctagctatttatcctcaaagaaaacctctctcttctacaaagctttcgttccaatatcctctctctggaaattggtatgctgctgctcgaacaaaacgaagatccccatcaatataaggactctgtagctactagtatgttgttatcttggatccataacttgtacttctctgatttacgtacagagcaacaacttgggtatatggtaggttctaaatatctggaattcgcagaaactccttgtggacttttctatattcgatccaataactattctcctgaggagcttgtgcatagaacacaactctttatacaaaagattgctactgatccagaatctgcaggcttgtccgaagagatctttgaacagcttcgagaaacatatatccagtccatattgcttccaagttccacacctttagctatggcgaaaaaattattctctatagcttttgaaacgaaaaaacaggatttttctcgcccagaccaaaaaatagctgctgcccgttctatggattacagctatttcaaaaagtactgtgaagaatttttgagtcaaaagtttggcccagaaatccaactcctcgtctatggagccaactcgtcgcaggaaaaataacattcttgtacttacattttctcggatgaagaggttcttcatccgagaaaaacctcttgcttctttatgtgcatccgaaatagtgatagagagctaggagtgagctagctattaccctttaataacaagcctccctctagtgtgataaagacgatagccctctatcttgtgagtttctatgattttaccccattactcctcaggattacgcatcgggtcagcgattctatttttttctgcggtgatccatacctttcttacaccatggttaacacgattatacgaagagtctcagcataaaaagatgatttttccagaacgctggcgtcagtacctttggttaagtgagcttctgcgcatcgttagtcgcgttgaactggtcttcgttctttgggcgattccgctattctgtctatttttatatacagaagctatcgcataaccatggcctatttcgatagccgaaactatgtcttctccctttttattatcgctatgctgattctccttgaatcgcgacctatcgaatacttttctcagagagtctttgcaacgatcgcaaaaatagggaaacaatcccccatttgttggtggtggactattatgattgcagcaccgctatccgcttttttccttaaagaatccggagcgatgattattgcagctacactattgtctaaacagttttacaaattctctccttctcccaagttttgctatgcaactatgggattattattttccaatatttcgatcagcggtttaacttcttcattttcttcaagagctttactgactattcttccagaaattaaatggacaaacagcttcattatcagtcatttttgttggaaagtaattcttgctattctggtttctacaacaattttgttctgtttattccgaaaagaatttaaaaagttccctaaaaccatccccagtacaactatgatgaatgatcgccttccttcgtggattattttcattcatgttgttcttgttggttgtgtgattctcagccgcgcaatccccttatttttaggatttttatttattttctacttagggtttcagcgattcacgattttttaccaacatcctattcaaaacagcaaaagttctgtttcgtaggattgttctatgttggagtagtgatatttggagaacttcaggaatggtggatgcttgagctcatgcacggcatgtcagatttaggctatatgatgacctcatatatgttttcaatcttcttagacaatgctctggtgaatcatatcgttcacaatttacctatggcaaatgattgttatctttacctggttttggttggaagtatgtctgcaggagggctcactttagtgtctaatatgcccaatattgttggataccttattctgcgaccaactttcccgcactctgacatctctttaattaaattatttttatcagcattgttaccttctcttgtatctctgagtatattttggctctttagagctgttccaccgtttatgttttgcttgttccgctaacaaaaagaagtatttttgtccccctttaaaagggctctgtagggggcagagctgtttttttctatcgaaaaaaatcaagtatttttgtactagggatacaacagcgcaggatttataaggagctggaatatgcaacacacaattatgctgtctttagagaacgataatgataagcttgcttctatgatggatcgagttgttgctgcgtcatcaagcattctttctgcttccaaagattctgagtccaatagacagtttactatttctaaagctccggataaagaagctccttgcagagtatcttatgtagctgcaagtgcactttcagaatagatgctataccaagctgtaggatctcttcgtatcggagaagtcaataatcctccgcttaacgttactgctctttgtatctgagctgcataagaagggtcttcctctaagatttctgggtaacggacaaataaggttgcccctgatcccgttagccctatatgcacaggaagttccgcccacaggctttctagccaatgtttcttttctttcaaatctaagcgcaaccgaaaaacaggcttttctaagtcattttgcgtatactctaaattttttctggaggaacagtccgaaggttgtacgacggcaaaagcccgactagtgagaactccttcactagaaaaatacaaaacatatctatctgaaacactctcttctagagctattattttctccccacgggccactcctaaggctgctcctgtagaaaagaaaaaaggagtatccatgccaatctgttcggctaaggaacgcatttcctcatcagatagtcctgttttgaagatttggtttaaagcaaacaatgcagttgctgcattactactccctcctgcaagacctgctccaacagggatctgtttgactacacgccaactaacaggcgttgtaatgcctgtgtaccgacggaaaagcgccacacttttccatatagaattactaggcgtttcaagatgacaagcattaattacttggagagaatcgcgagagcttattgataaggagagttgatccccaaaggtatcgcttgatagcgtgtgactatttcatgaaaatcatcttcccgcctgccaagtatctgcaaaaagagattaagctttgctggagaaagaaagtgcataattaaaaaataaaaaaaagaggtggggaagaaaagaatctcttcccccaacaaacaaaaagtttaaccttcttgttcttctgcgctttggagttctttttgttcaatgatttcgtgatcagcacgaacttccaaatgaagatccgcagtcacgccttcttttaatttcagtccaactacgtgtcttccgagattcttaataccgctatgagagcgagggaaattcttacgtgtaagaacaacaccttgttgctcagcagcactaatcatatcattcacggttacggaaccgtacatattattctcagaatctacacgaacttggaaatccaaaacgatgcttctaagcatctctgccaaacgaagagactcttctttatcggccgcagcttgcagcaaacgctgctcttgcaactttgcttgcaaacggagagttccagcgctagaaaccactgccttccctttagggagcaggtagtttctaacgtatccgggcttagcgacaacaagatcgccggaacgccctaagccatcgacatcctctaataaaagtaattgtggtttcatccgttattcttcctttaagtttaatcttctcctacgaaaggcaaaagccctacatgtcgagctctcttaacagcttgagcaagcagcgcttggaagcgagaagaaacccctgtaatccttcttggaagaatctttcctctttccgtaataaacctttttagagtggtaacgtccttgtaatcgatggtcttccaacccgcggaaacaaaaggacatttcttagcgaaacgcttccttctgtgttcattatgaacaggtctattcatacgttctccttaactattattctggcaatgtagcgaattctaaaacttctttcacagcgcttgctttaagagtcatgaatcgaagaagatcttcgtttaaatgatactctctccacaattctgcgatagcttctggggctactgtgaaataaataaagtagtaatagccttctctagcaccacgaattgtgtaagctaactttttgcgcccctgatcatgaattttcagaacttcgccaccataattggtgatcccagaagtaactttttctaaagccttacgtctagcgtcttcacttaacgtcacgctaaaaacataggctccctcataaagttggcctgtttttttttgcattaaaaactcctaagcattgaccttgcttcttccaataactaagagatagctactctataagaagcgcttccatgttatcgaaactgattatttttcaggaactttttttcaaaaagtgaacagtaaatccccgtcagactaacaacctagccaaggaaggatttcttctatccctttttctaaaaagtcatttaatttttctttttcattcaaagaaaaactagataatacataatcagcaaccccttcagctccaggatacgaaggccttcctaccccaagacgtagttgccaataatgattggattgcagaatctgcgtggtattcttaattccattgtgcccaccagagccacaatcttgccgaaaacgcacaaaaccgaattcccgatgatgtcgtctgctacaacaagaatatcttccatggaaacatcgaaaaacttcttggcagctaagacagctttaccagtaagattgacataagtggtgggcttcataagaacaactgcctcgcttgaaatttctaccttcgcaaacgaagcataaagacgtggggcctcacgaaaagcccctaaaaaacgtgatgctagcgagtccaacaaaagaaaacctatgttatgccttgtccagacatactgtcgtccaggatttcctatgccaacaactagctttaccatgataatcttatcgtcgtgctaccgttacagcaacttctttaagagaagtgacaggtctaattccttcaggaatacaaatatccgatagttttagggtttgagaaagccctaaggactgaacatccaactccaaaaatggaacaatatcttttggcttacaaacaactcggatgcaacgaatcacttgtcttaaagatcctcctaattttaccccaacacaatctaccgtgttgatgcaacgaataggaacattcaaccgaacgtcgcgaccatccactaattcttcaaaatcgagatgaattacatcataagtcgttacatggtactgaatatctttgactaaagctttgatttctcgtccttcattaagaaagcgtgaacacagtagaagctaaaagccccgctttccaaagtagaaagaaacttactgaaaactcgcgcatctacaacgatattagctaagctttttcccccggaataaagaacagcaggaattccaccttgctgacgaattttcttaataacagacttcttatcagtctcacgactttgaactacgagttccataaaatgctattctccattaccttgagctaaaaggcctttgaatggccttaggggcttcttttccctcaaccggatgaacggtcctacgcgctataccagacggccttaaaatggcacatacgaagaaatcccctccaagcaagcgcctaccatggtacttgcagcctctgattattatcaagccttctgttcccttagatagccccaatcgaaaatctctcctattcaataagagattcgcattaaaccagacctaagggggaataaaagacaactctggggtggaaggattcgaacctccgatgcgcggtaccaaaaaccgctgccttaccgcttggccacaccccaatggaagagaccgagtgtacctcacaagacctttttatcggtagagaaatttctcaaaaatcaaagttttttacatttaaggggcatcttaccaccacaacaaccttctatgagcagaaactatccattaaataaaagtaattaaatataacaaaaacatcttgattatttttgttaaaagaaataattaacgagttttatttaattaacgaaacgaaaagcttgctaatgaaaattattcacacagctatcgaatttgctccggtaatcaaagccggaggcctgggagacgcgctatacggactagcaaaagctttagccgctaatcacacaacggaagtggtaatccctttataccctaaattatttactttgcccaaagaacaagatctttgctcgattcaaaaattatcttatttttttgctggagagcaagaagcaactgctttctcctacttttatgaaggaattaaagtaactctattcaaactcgacacacagccagagttattcgagaatgcggaaacaatctacacaagcgatgatgccttccgtttttgcgctttttctgctgctgcggcctcctacatccaaaaagaaggagccaatatcgttcatttacacgattggcatacaggattagttgctggactactcaaacaacagccctgctctcaattacaaaagattgttcttaccctacataattttggttatcgaggctatacaacacgagaaatattagaagcctcctctttgaatgaattttatatcagccagtaccaactatttcgcgatccacaaacttgtgtgttgctaaaaggagctttatactgttcagatttcgtgactacggtttctcctacatacgccaaagaaattcttgaagattattccgattacgaaattcacgatgccattactgctagacaacatcatctccgcgggattttgaatggaatcgacacgacaatttgggggcctgaaacggatcccaatttagcgaaaaactacactaaagagcttttcgagaccccttcaattttttttgaagctaaagccgagaataaaaaagccttgtacgaaagattaggcctctctttagaacactctccttgcgtgtgcattatttctagaattgctgagcagaaaggtcctcactttatgaaacaggccattctccatgcactagaaaacgcttacacgctcattattataggtacctgctacgggaatcaattgcatgaagaatttgcaaatcttcaagaatcattagcgaattcccctaatgtaaggattcttttgacttatagtgatgtgctggcacgacaaattttcgccgctgcagatatgatctgcattccttctatgtttgaaccatgtgggctcacacaaatgattggaatgcgttacgggactgtaccgttagtaagagctacaggaggactagcagatactgtagcaaatggaatcaatggattttccttctttaatccgcatgacttctatgaattccgaaacatgcttttggaagcagtgacaacctaccgtaccaaccatgacaagtggcaacatattgtacgtgcttgtctaaatttttcttcagacctagaaactgccgccaataaatatttagaaatttataaacaataaacttccctatgactcgccatccgggagtcatttttctgtaataagtgacttttattcacccaaatatactcaactccagagcaaatagaataaaaggctactaaagacactatcactgttgagaaaaactctaaatcgtctgtggagataatgccttttgcacaaaggaacatcgagaaaatgatgaaaaagaagctaatagcttgaagaatagcttttaacttcccactcatcctagcagctaatacttgtcccctactagcgcacagcgtacgcaaagtgctaataacggaatctcgagctaagaaaataaacacaagtatgagaggaagattcacggggggttgtgtgaacgtgaggtacagcgaaatacggtatacactatcagccatgggatctagaagttttcccagatctgttacctgggaaaactttctcgcaatatatccatctacagcatccgtgatttccgtaatgatcagcaaaaagaggagaacataaggcaggaatgcggcagacaacccgaaccaccgaccttttaagtaaagaatcataaaaatcggtgtgataaatagacgaaaaactgtcaggaagtttggtaagcttactctcatctgttccccaagaaatcttttttgaattcccaagtctagtgcttcacaccagatattttctttttgaaaaagtcagcaccacatgttatgatctatccggctcctcctctctgtaaaaacggcaaaaatccctctcgtgactgctcactttcttagttctctcattcttagcatttctagaatttatcgccagtctttcccatctatatttggaataaatacattctaaatcctttttcaaaaaacttagcactagttgctctctgattgcaatatcgatttctcttataaacagggcatttctcgccttgttcaattaatacagcttccactagtatgttcctctaggaatatcaaggatttcttaatccttgttctgcagagcccggctcctatttcaagccgtattccgtgtccgtaaggctcttctttttctcagatatctaggagtttttatgtcctcacaacctttaactcttcaagccatgatggcagctattctaaacttttggagcgaacaaggctgcatcattcatcaaggatatgatttagaagttggagccgggacatttaacccagcaacctttctgcaatctttaggccccgaaccttttagaacagcttatatcgaaccttctcggcgcccgcaagacggtcgttatggacaacaccctaatcgattacaaaagtaccaccagttacaggtgatcctcaaacctgtccctgaaaattttctttccctttacttagaatctctcaaagtcatcggattaaatttagtagatcatgacatccgtttcgttcacgatgactgggaaaatcctactattggagcttgggggctaggctgggaagtatggttaaatggtatggaaattacacaactgacctacttccaagctgtaggaagtaaacctttagatgcaattagcggcgaaattacttatggtgttgagcgaatcgctatgtatcttcagaaaaagaactccgtctacgatgtgatgtggaatggttctcttacttatggagacatcacacagtatgcagaacaggcctggagccaatacaattttgagactgccaacactaccatgtggttaaaacattttgatgacttctctgcagaagcgttggcaactctagaccaaggcctccctctcccagcatatgatttcgtcatcaaagcttcccatgcctttaatatgctagattcccgaggggtaatttctgtgacagaacgcacgcggtatattgccaagatacggcaactagcacgagctgctgcagataagtatgtggcatggcgggagtcattagggtttcctctccttaaaactcctccttccacaccaacagtaacaccaaagaaaatcccaacaatttgccagccagaagactttctgctcgaaattggaagcgaggagttgccagcgacctttgtccctactggaattcaacaactcgaatcgctcgcaaagaaactccttgccgaccatggcattgcttacaaacatctcgaagtattaggcactccacgacgattggcattgtgcatagaaggtcttagtcatgtaacgattcgtccggaatctgagaaaaaaggcccccctctttccttattatttatgacagatggctccgtgtctcctcaaggagaacaattcttcccctcacatggattatcgatctctcaccgaagtgctttggatcaaccttctgcgatttgtcgtgttcgttctatcaatggtaccgattacctatttcttgttattccagaagaacgcaaagaaactgcagctattcttgttaatgagctccctcaattgattcgatccatccgtttcccccaaaaaatgacctgggataatggtggcgtggaatatgctcgccctattcgctggttggttgcgctatatggggatcaaattctccctatatctttaggattcgtatcatcaggcaatacttcttggggacatcgtcagctggacaatcgtcaattgacgatcccatccagcaacatgtatgtcgatacgttgcgtagtgcttgtgttatcgtgtcacaaaaagaacgtcgggcaatcattaaacaagggctgcagaatttgacaggggatcaaatcgtggcgattgctcctgaacaccttgttgacgaaacagtcttccttacagagcatccgtttgttattagtgcgcaatttgacccagctttttgttctcttcctaaagaactactaatagctgaaatgattcagcatcaacggtacttcccaacacaaaatatgcaaggagaaatcaccaatcgattcttaatcgtgtgtgataattctcctacagacagtatcgttgagggcaatgaaaaagctttagctccacgacttacggatgggaatttcttattcaaacaagatttgcttacccctctttcctcattcgtagagaaacttaaatctgtcacctattttgaatccttaggtagtttagcggataaaacttctcgtttgaagttacacttagaagaggcttatgcactcctccccttatgcgctaaagaggatattgataccgctatacattactgcaaagcagatcttgtatcttcggttgtcaatgaattcccagaactacagggaattatgggaagatattacttacaaaatgcttctctatcccgagcagctgcattagctattggagaacatctgcaacacattactttaggttccaacatctccactacaggggctttattaagtattttagatagaatagataacctgctctcttgcttcattctagggcttctccccacctcctctcatgatccttatgccctacgacgccagtctttggaaatccttactcttctctacaccactcaaagctctgtagatatagaagatttatttgcacggcttattcgacacttcccgagctctattcctaatacagtatggtctccagaagaagtcttaagcaaactcaatacatttgtttggggacggttgagaacgatcttatcctcactaggatttgataaagagattatagcaacagtccttacagataactgccctaaaaatcctttaactatcattcaaagtgctcagtctatccaagaactgaagaatactcagatactgaaaaccattgctgcaacgcacaacaggctaaagaaaattcttgcctcactatccttctccgttacagagcagatgttttccttacaatctgccgaagatttgttattcaaacaggctctggatcgttttgtagaggaaactactgctttaccaataagctcgaaagactacttacatctattgaaagagttggcacaaagcaccgaactctttttagactctgtgcgtgtcgctagcgatgatgaaagcactcgaaaccaacgtattgctctgctgatagcagctcaaaagtgtttcggtttctatgcttgggatgttctgtaagaataacaagtttcttccagacaaaaagaaagccttctcttttcacaaagagaaggccttttttttataaaggtggacttaactactcaacaaattcaggatttattgacggcatctcggtaatatccatgatctctgcagaagaagccccaatagctaaggtaacaatcacaggctgtgatggaaatgtttgatctgagaaagcttctaagaacaacgctatctcgccaaccataggatctggaacccggaggaataatcagtggaactgcttccctcctagaaagaaccacaaaatcagcaaatgtggatagcaacgaactttccatagcatgggctgcataagcaagagtctcgaaggaatacccagaagtatctaacaatactactaaggtgagtttcccttcgtcccttgcgtgttctaaaccctctgcatagctgtaaaatacgcaggtgtccgctacctgactacagtcttcctctgcttcttgttgacactgcttatcctctgttgagaatgcctcagtcgcaggaagaactagtatcagtgagaataaagctaacaagaatctcatgagagaactcctcttctactnaaataagaattttgcgatcaaggctatcacaatgtaacaaaaatagctgcttaaattaaaaaaaccgggaagaaattcccagtctatagactcttgaaactcaactaaatattttcttgagaagcgagtaacccttctaattcctggctctgtaaattttgtagttcatttagaatataggcagagccgtaccccaccccagcacttttagcaacttcatgggcagaatctagtagggaagcaacagaggaaggacgtgcagcgcccactccagcagcttccgcagcaacaaaactcaatgtcttaggagatgaagcggtcaaagctgctccacaaaacaaggagaaagtaaatgctgttaataaaaagtgaagacttctcataaaacccaataaattgagaactaacgagctaatattctataacaaaagaaactaataagcaatattgttaaaacttgattaagttcttataattaagaaactaaagaaaccttaactctctctccggaaagacgaacatactcttgtaaagaatctaaacctttacccgtctgatgacatagcttacgctttctgtctcgccaatgtttgtccaataatttctgaatcgattgaacaacaatgtctctcataagttcggtattcatccgtctggcaacaagaagagtcattgcttcagtaccaacaactaaagacatcatctcgtccatagagggcagtgtttgccgatcattgtagtgattcatagccataacaaatatagctcgatattctgccacaatgaaactcttccggagaaagatactgctttaccgttgcggggacaaactcatcttcgggcttngcaaataacaaacaccgtatcacgtcagcttctaaaatcatcctcggagaaattttttttgaaatttttccttctgtagaagtttgctcagactctgaggaaggttcttttgcggagacctttttccctttgtcttcagcagcagacgtaatggaagaaagatagctcaaaacagcaggttctggaaccttgaccaaagaagccaactgcctcaagtactcatgaatggtaataggacttccccaacaacgcacctgttgaattacctcttcgattactcgagctttttctcttggagtaaactgttcataagaatgancttatgccaaactagaaaggaaagataatcctctcctctatcgagaagctctcgtaactcttcaggccctcgttgcattaaaaaagaatccggatcttgcccagaaggaagccgacagactatagcagtaatccctgcagcctgacaaagatccccaacacgtaacgatgctttttctccagcagcatccccatcaaataataaataagcttttgatactcctaatttaactaactcatgcacatgagtctctgtgaaagaagtcccttgagcagccaaagtacagttgaagccaaaatcaatcatttgcaaacaatctgcctgaccttcaactaaaatcactctccgctctttagcgatgcgcttacgagaaaattgtaacccgtataatacccgagattttttaaataaaatggtctccggggaattaatatattttccaccacgcccaccttctttgaacctccgagaagaaaatccaatggtatagcctaaagcatcttgaatcgggaacatgatgctcctgagcaaacaaaaaccagtctttagcgagatacccagcccactctagctgcttcacacaaatattgcgctcttccatcgcttgaataaataatctttgctcaggagcataaccaatctgaaaacgatctatcgtatcgggagaaaaccctcgcttatataaataggctaaagcctcttccccttccggcaaatgtaataaacagtattgaaaaaacctttcagcttctctgttaatacgccgaaaactatctttagaatcttgccctgaggtctctctagttctgacaacaagatcaacatgaaactttttcgctaagaaaagtaccgcttcagagaaagaatatccctgctgtttcataagaaaattaatggcatcgccatgctctccacatccataacaatggtagtggcctctagttgggtacacgataaatgacggtgttttctcatcatgaaaaggacagcaagccttgtaatctgcaccgctgcgctttaaatgtacgtattcccccaaaacgctaacaatatcaatactatgttttagagtctctaagctctcttctgtgtaatacatactagcctagctccaatcctcttgttgctcttctcttatgatccactattcgtgaatataagcatcgtacaatatttttttacacgcgatgcccgctcttcggcgataaaggatccgccatggtaacgcactataattttcttgggaatgtgtgcttctttctccctgatggattcctttttctcttaagaattttgcttcccaaagtcttgtattccccaaaaattcaacaccgttgtacactcgcgtttcgaaggttctctgatacataagagcctgttcccctactacgaataaaaaattttttcgatcacgcaatactagataaagctatgacacacaaactaaccccaatgatgcagcaatggcatcagtgcaaagagcaagctggtgattgtctattgttatttcgccttggagagttttatgaagcattttttgacgatgctttgatcctagctcaaaatctagatattactttaacacagagacagaatgtgccgatgagcggcatcccagcaacttgtctggatggatatgtggaccgtctagtaagccgcggttttaaggtagccattgctgagcaggccgataatactgaagggagcaaaggcctcgttcctcggacaatcaaccgattgataacccctggagcactcttatcctcttctttgctcccagaaaaagcaaataactatgtccttgcaatcaatcaagtagggtctctctatggtctctcctgtttagacttgtcgataggaactttccttgttgctgaatacgataataccaaggaccttattgaggcgatctgtcggctggctcctacagagttattgagccacgcaaaattttatcaaaaaaatgcagctgttattaaacaactccaacagcatttacgtatcacactatccgaatacgtttcttgggctttcgagtatcagtctgcaacaaagaaattatatacgtgttttcaagtttcctctttagatggttttggattgcaaggactagtccctgctattaatgcggccggagcattactgtcttatattcaggacaaacttcttcttcctatttcccatctctccattccaaaaatttatggacaacagaaacatttacttattgataaagcttcccaaacaaatctagaactactgtctcctattcatggtgagcatggaaaaggatctttgcttcaagttatggaacgaacctccaccccaatgggaggtcgtttattaagaaataccttaatcaatcctttctatgatttaaaagaaatcactcttagacaggacagtgtagaatttttcttacagcaagaagatcttcgaaaaatcttaaaacgtcagttgtcctgtgtacgagacttagaacgtctagctactaaaatctcaactagtctggctactccgaaagatattggaacgcttcgagactcgctgctctcttgtacacacattgcaaacaatttgcaaaactgtgctctacccgaatttttagagaataagtttttgattgctccccctctatgctctctcataaaaacgttatcgacagagcttatccaagaacttcctttaaaagtgtccgaaggaatattttcgcaaaccactatcatccagatcttctacgactaagaaacatcaaagaaaattctaaatcctggattcttgaataccaagaacgtattcgaaatgaaacaggcattaagaaactcaaagtctgttatgctcaggcattaggatattacattgaagtggctagcaatctagccccccaacttcccaaggaatttatccgtcggcaatcacggctacatgcagaacgattcactacgcaagaacttcaacaattccaggatgaagtatttagcgtggaagataagctacaaactttagaaaccaagctctttaaggagctttgtttctatatcgtagaacatcgagatctcattctcaaactttccactgcagttgcagacttagactatgtggtatctctggcagaactagctgcagaatatgattatcgccgccccctcgttgaccatagcgatgctttatccattaccaaaggaatgcatcccgtcgccctgaccctactagataaagggacttttattcctaatgacacagtgatgcacagtgcccaaacacgaatgatcctcctcacagggcctaatatggctgggaaatccacctatattcgccaaattgcactccttgtcattatggctcaaatgggatctttcataccggcacgttctgctcatattggtatagtagataaaatttttacacgtattggcgctggagataacctttctaaagggatgtctacctttatggtagagatggcagaaacggcaaatatcctgcacaatgcaacagatagatcattggttattcttgatgaaatcggtagagggacaagtacttatgatgggcttgctattgcccaagctgtagtagagttccttctgtttacagatgggaaaaaagcaaaaacactattcgctacccattataaagaacttaccgaattagaaatgcactgtcagcatgtagaaaattttcacgctatggttaaggaaaatagcggacaacctattttcatgtacgagatcgtaaaagggcactcgaaaaaaagttttggcattcatgtcgctaagcttgcaggttttcctctttccgttgtatcaagagcacagcagatcttgcatcaattcgaaggcccagatctacgcccagagcctgaaaaagctcaacaactggtcatgttttaattcttttgtttacgatttttctgcgtgcgcatagaggatttttctttaaaagacgtttcttcttctcctggggtctatctaatgaaagactcccaaggaacagttctttacgtaggtaaggcgaaaaatttacggaatcgactttcttcatatcttcaaaagaaaggcgattcccgtgaacgcatcccttttttaatgaaaaaaactacagatatagacacgattgttgtttcaaatgaaacagaggccattctcctagaaaacaacttaatcaaaaaatatcagcctcgctacaacgtccttctcaaagacgataaaacatttttctgcctatctgtatccctggaacatccttggcctagaattgaagctatacgaacacgggctctttccccaggtaaaaaaaaacagtggttattcgggccttatgtcagtgctgaagcctgctatgccctgctagaagtcattagcctctggttccctttgaggacatgctccgatcgagaattctcgactcgccaacgtccttgcgtcctctatgaaatgaaaagatgcttagctccttgtgtaggattatgttctcaaacggaataccaggaaactttggacaaagccattctgtttcttaaaggagatgtgcgttccacaatatctaacttagaaaaagcgattgaaaaagcctctcaagaacaaaagtttgaacatgccgcagctttgtatcgcactctcaccctgatccgtcaaactatggcaaaacagcatgttgagaaatttcaagcatatgatatcgatgtactaggcctttataggaaaggttctctcgctattgtctctgtactatccgtctattctgggaaactacttggcgctcgttattttatcttcccagaaaatgctcaggaagattctgccttatttccttctttcattttgcaatattatgcagaaaatcctcgtatccccaaggaaatatttgttcctgtatctttagacagtccagagctcccctatctactaaacactgctgaaccgccaaaaatccgctgcccgaaaacagaatacggaaaagagcttcttgctcttgctcataaaaatgctgctgaacaagcgaaacctttcaattctatcactcctccttatgaagagctgcaacatttctttaatttaagccagtatccatatcgcattgagtgctatgacaatgcacacttacaaggtgagcataatgtcggtgtgtgcattgttttcgaaaatgatctcttctctcccaaacaatatcgcaccttctctattacttctcatggcgatgacttggctgcttttgaagaggtcttaacacgacgtttccgatcccttactacagaactcccaaacttaatagtaatcgatggtggacgtaatcaatttaaacgagcgcaacgcattttagaggagctgaatttaacagggattaccgtagtaaccatcgccaaggaatctggcaatcacagcaaaagttgcgccaagaaaagctattttgtgaaactttcccccaaggaatccttcttcatcccacatccgcaattcttcagttctttcagctattacgagatgaagcccaccgtttcgcgattcaacactatcgtaaaaaacatgcaaaagcagtgctaactacaaaaaaaatccctggaatcggtgaagtgaaaacaaaacgtctacttcaaaagtttaaaagctggaaacgtgtgttcatcgcttcggaagaagagttaaaaaccgtacagggaatcacagcaaaagacattcaacggatccaggaagaaggcgccaaacccgaataacataccgaggatcctaaccaaaaaaaaggctctatacagagccttttattcttcagtttgaatcacagaaacttcttctaagtattcttctgccgaagaaaattcctctaaacaaggttcttcaataacttcaatagcaggaacttcttcatccttggcttttggatgcgttaatcctttgacgacaacatgaaccgcagcaacatgcaatcccgtatattcggagatttcggatacaatacagccttggatttcttctgttttttcagggatagaaactccgtagtccacattcacttcaactcgaacctttaccaaagaattcttgctatcctgctcaacatagatccctttnnnncntttcgatatcgcgtccaaaaagcgtgtcaatgagattctnctcctaataatgaaaccccatcgatttttgctaagcagtgaacaatgatcacttgaatcacacgggtctctatatcgcgactaaagatgtttctgggaattcaatctcttttacatctaattttaatctttgcttatccatactctcggctgcctcattctcgtgatcttgtctcttctattcagctctatttctatgccaaaaaatttttaacagcaacactttcaaaagcttttttttaccaagaaagttactggagacgagggtaaaagttactgcaatctaagtcaataacaagatcaaagctgctctctttctaaaaacgctccctaacttgtagacaggagcttttttagaaaagaaatcatctactcgttaatattgttttttcaaaaacgaaagcgaacccattattttttaatgaattcaaatatagaatataggcaatatcgtatagatatactgagctgttttatctgcttgctaatgatggtttggacactagtcagcatcaagctaggagattctctaggaggcatcattcctggatgcttaggatacttactggctaaaaggaagcatcgccgtcctgtccgctggttcttccttacttttttctttggcattgcctctggaatcttccttgttgttcttcatcctaagcaaaagtaattcctgattgtttttgtttctcgagaaaaaggtactatgatgatcttttttttagcgagaaaagctgctctaagaaataatgtgattatttacaacgaacttaaaattaggcagccctcccatgaactccggaatgttcccattcaccttttttttactgtacatctgtctgggaatgcttacggcgtacctagctaataaaaaaaatcgcaatctaataggctggtttttggcaggaatgttttttggtatttttgccattatcttcctattaattctccctcctcttccttcttctacacaagataatcgttccatggaccagcaagattccgaagaattccttttacagaatactttagaggactcagaaattatttccatcccagatacaatgaatcaaattgcgattgatacagaaaagtggttctacttaaataaagactgtactaatgtcggtcctatttccatcgtacagctgaccgcattcttaaaagaatgcaaacactctcctgaaaaggggatcgatccccaagaattatgggtatggaagaaaggaatgcctaactgggaaaaggtaaagaatataccggaactttcaggaacagtaaaagacgagtaaaaaaagcccctttcaaggggctcaacacaagtcctaccaacttgctttcacaacggcctgggatatctcccatagaagccatttgtctaaaacaaattcttgagatagcaaactttctaaggtatccacgaggacggcctgttaataggcatctatttatgtaaacgagaaggagaagtatctcttctcattttattgagagcttcccgagctctttctctttcttcctcgcaaacagataaactcttcgcaagttttcgaagctctgctctcttctgaaaattagcttctactaattttcgacgtttaacttctctagctactgctgacttcttcgccatgcgttctcacctaaatctatatattacttcttacgagcaggccctgcttgacgctgcttacggttgggatctttcttgttaataacataaagacgtcccttacgacgaacaagcttgtcaccttttgaggggtctgctttgatggatgaactaactctcataatatgccttacttgggctcttaaaaaagagactgattcttactacaccctcaccacataaaatacttagaaatgagagcccctagcaaaacagcctcctcctaccggacaagaagtacccttttgctataaaatccgcagcacaactaaaaaccgtaaaagttttcttacagtgatctctgctctctacgcattcctaaggcactagcccacgctccatacacagaattgcaaacaagagccttcccggataaaggaggattaacaactagaggaacaaaatttacccttttcctcactttttgacaataagagacttgctcagaattctatctactaatggaactactttctttactcaagaaatcataaaaattgttgccctgtattgatcttttaggtgagatcctttaaactcgtccctagtctctttggggcagagtccctaaagacttcaagagtattaggagagtattgtgaaacgcacctatcaacctagtaagagaaagcgtagaaattccgtaggattttagagctcgcatggcctacaaaaagcggaagaaatcttttgaatcgccgtcgccgtcatggtagacattccttaattgatctttaagatcttctattcgtgagtcggttaactttacctaagaatgctcgtttactgaaacgtaaacaatttgtttatgttcagaggaatggacgttgttgtcgtgccgatcaagtgactttacgggtcgttccctctcgtcattcgaacaccagtaaagtaggaattactgtgtcaaagaaatttggaaaagctcatcaacgcaatcgttttaagcggatcgtacgagaggcttttagacatgtacgcccaaatcttccgggttgtcaggtggttatttctccgagaggaaattcgcagccagattttttgaaactatcagaagaacttcttcagcgcatacctgaggctttgcccctcgcctcttcatccagatgctgaggtagaaatcctaaaaaaaaccattccacgctatagaggcatggaatggggaggaatactagatttgtgagttatatttaggattggtgttctatatgcactaacgaacgggaaatgctggattggatatcttgcggagccgattcaaaagctatctttgcgtgctctagcgcactattagggagcccagcatcgagataatattgagaaataatcatctcaagtctccactggttctctttatcctgttctccaaattgtgtaagatattctgctaaaggtgcgattacttcagcaacattcacgtgcgactgcccttgagaacgtttagctaactcttgaaattcaattaaagccactgtgaaatgcgtgactgctcattctcaggatctaattctagcaaccgattcttcacagcacgacactcctctgaatccattctacccgcttcaacgagctgccgaaacttctcggataggaaaaagctatcatcgcacaacaccccctgctcaagagctgttgccatgaaatcttttcgcgatagctcttcagcgagctgatagtattttcgtaacgctaccgaagatagtgtagggatgagtgggaaaacttgttctagttcctggtcattagcaatgactctgcacaagctctctcctagattcgatccattttcatttccaaaactttcgatcttatagatcgctcgttcttcgggggacaacaataccaaactagggaaggtattgacatacagtctattctttaaatcttcattttgctcgtttatgagaggatctcgcaactctgtatgacgagggaaatcgacaactacgcacacaaattggtcagcaacagctgagatgaaatccgacgagcttagcacttcatcacggattttcatacaactaccattccaatcagagccagagaaaaacaacaacatgggtaaatctttctctctactctcgtccctagcttcttgataatctacataccaagcaatctctctggaattagaaggagtagcgcatacctgagacgcacctagtccaaagaaaactagggcagccaaaagagttttctgcttgaaagagcaacttctagcaatccgtaaagaagacatgaattcctactccttacttgttcgttagaaataacgacaccatcgaaaacccagagaaaccctctcccaaagcagcttttcgaacacttttcgtgtatattcgttttttcattaaaagcaaacaaagattctctcttgaaaacgacatagctatgcttctgattttggaatattttctattcctttaacaaggaatgctgaatccccgctctgtggaaaattctatagactaaggagaaaaggttgcttatcatgaagggatggattcgctctaacagtacaaaaacaaggccttttcgtatgaatactgctatagatttatttctgtataacaccctatctagagagaaggaacgttttctccctgttaacgatcctgtcaagctctatacctgcggtcctacggtgtatgattacgcacacatagggaattttcgcacgtatatattcgaagatctactgaaaagagtcctgctctttttaggatactcggtttatcacgtgatgaatatcacagatgtcgatgacaagactttagctggagctcgtaaaaaaggttgttcccttgaaaagtattgccagccttatattcatgctttttttgcagatttagaaactctgcacatcttgaaagcggatgcttatccccatgccacccactacattcctcaaatgattgaagctattcagcaacttatcaatcaaggggttgcctacataggccaagaccaatctgtctatttttccatcagtcagttccctaactatggagctctatctcacttaaatttagaagagctcagaaatagcgcacgtatcgatgcagatgaatatgataaggataacttgtgtgactttgttttatggaaagcttatgatcctgatcgcgatggagaaattttttgggaaagtccttttgggaaaggacgcccgggatggcatttagaatgttccattatgtctatgtcccttcttgggcaatccctcgatattcatgctggaggagtagataatatcttccctcaccatgaaaatgagatcgcacaatccgaatccttaacacacaaaccctttgtgcgttattggctgcattctcatcacctcctcgttgataggaagaaaatgtctaaaagcttagggaactttttcactttacgagatttgctggaccaaggattttctggagaggaagtccgttatctcttgctgcaagggcactacagaacgcagttaaattttactcaagaaggattgcatgcttctcgccagtcacttaaacgcttaagagactttatttgtaggctggaagatccttcgtatcctgatgacatcatacaccctgaagtagctacagcctgtcaaagttttttagaaaccttcattacttctttgacgaatgacctgaatatctcctcttctttagccgctttatttgattttattcggaaaataaacagcagcattgaccaacatactggtatccagacagaaacagactcttccgtattttctaaacaagacgcgcaacatattctcgccttactaagaaagatagatcaagtgcttggagttttgcccttttcacaaccagatattccagaagaggtgttacttcttgtggagcaaagagaggctgctagaaaagtgaagaactggcaggaagcggatcgtctacgtgatgagatcttatcccgaggttttgccattgaagatggcaaaaccgggatgaaagtgaaaaaactttaatctttttttgcttctatacgccgcataacagggaaaaacaggacatcccgaatggatgcagcgtctgtcaacatcataaccaatcgatcgatacctattccaaatcctcctgcaggaggcattccttggcaaagagcttctagaaattcttcatctataggatggtattcgctgtcaggatttaaagcctttttacgcatttgctcttccaacaattttcgttgttgtaaaggatcattgagttccgaataagcattacacaactcttttcctaaacaaaaactctcaaatcgttctaccagagtttcatccccagaacgcaatgttttacaaagtggcgttgtttctaatggatgatctgtaatgtgatgcggagcgatgagcttatcacaaaccagctcatcaaatagcaaagcgatcagctctcctcgtgaggcatgaacatacgttttctctggagagatgtttgtgtttctaaaattttacgtaattcatgatctgcatgtaagtctacatcgacgccgcctctatcatggtaaactctggattatgcgttctatcgattccttcgttacggaaaactttgccgatttcataaactcgggacattcctccaacaaggagttttttcaaagcaatctctagagaaattcttaggaacatttctgcatgtagcccttgcagcgtggtaacaaaaggagttgcttctgctcctccgtagacggtttgcaagataggagtttccacctctaaaaagctctgctgatccatgtactcacgaatcaacttaagaatccggcttcttgttaagaaagtcttacgcacatcctctgaggaaatcagatctgcccaacgtttgcgatagcgaatttctttatctgctaatcctgcatgcttatcaggcaaagaaattaaggatttacataacaacgttaccgtttcaacgagaaccgttaattctcctgagtgagtaaagaaaagatacccttcgagacccaagatgtctcctagatcaagtttcttctcaataaatttaatcggagaaatcccagcatccgcggctaaccctgccactgcagaaaaatctcgattgaacatcacttgaatctttgcatcattatcgaggatctgcccaaaagcatttttccccatagaacggaaaagaacaagtcgtccggcaaaacgcaccttaggtgtctctttacgaaaaggcttcgctatctcctaattcgttatctacaaactgattacgaatttcctgtacttcaagacaatcagtgtattgataagggtaaggatttatgcccaaatctctgatttcctttagcttgcttgttctatacaaataatcttcgtgtngcaagtattcaacttctacagacatcaaccgtcctttggctcaaaaatagtagcaacatttttcttcttacgacaatcactaaagtcttaagcagactcatcatgctacatcaaacttgagaaattttgaagagagaggatatgcagcttgctttctccaaaatagaaagagaaaactggatcgttttctctttcttagaaatccgagaatgggaacacgtttttctcttattaaaaaagagaattacgcgcgtactcaggagatatgtaatgcttgctttaatctataaacatatgccccccgcctccaggctcaaatcccatttttgcgacttctntaccttcggaatcgaggaaaactagggtagggaatccgtctacagaatataaacttttcaaatgacgattctgctctttttgttctgcagtttgttctttgttgtgagggaaatctatctccaccatacacaaatattgtttatcaaactcggaaaatgcagctgtttgtaaaatctgatcctgcattctcatacaccaaatacaccaatcggatcctgtgaaaaatacggctacatgctttccttcctgttttgccttattcaaagcatcttgataagacatccagtgaattccggtctctgcaaccctattggatcttctgcgaacccgcagcacgacgttttgcagcaaaacaaggagctgtgaccgccatacatgcgatgagcaagctccctaataaccagtttctcataattttctctctttgtttaattgtaaggaattgctttatctagcctttaatatgataacaatgatgcgtggattgcaatgaattcgtctgggctgataaccttatccctccggaacaatgtctctctttacaacctgtgcacctgttgacacaccatgcattcacttaactgtttttcaagaaatttttaatcgctacacagaaaagccctaccccgccacgtctatactggtcccattatattttccagaagaacctcttaccttttccgaggacttatctccatccacggctcctattcttaatcccccaggcttagaaccgcaagctcttccggtagaaactcccaaagaccctgttacaacttctattcccccaccttcccatcctaaagaatccaaacactcctgggcctgtgttcctatttaccctggactctctcatgaagaactactgaaagaaaattatcctgctttaaaacgttatattcaacgacctgcaagggcctcatgtggcatttttgtccatgaatctcaggaacatgagattcttttctttaatcgcttagctaaaattctttcacagaaaatttttcctactcgcctcgttcttttttaccaaaaaactttgtctgattttagtcattcccctcatcctttttgtttagcgcccttaccaacaatcaggtataaaaattcgcaagtgaactatcacgatcctgttttgcacgataaagtaacctgcatacccatttattcctcttcccaatatgaaaaagattcagcattaaaaagagatttatggaccctactcaccagcctttccgcctctatgcagaagtcatagtcaatgcaaatatcaataaaatcctagactacggcattcctgctgaattggaaaacctagtaactgtaggatctgttgttaaggttcccctgcaaagaaaactgacaaatgacaaatataaaattgccattgtgctcaaaattaaaagttcttctgattttgttcatgtaatccagcctattttagatatcagttatgaaggcattacccttccccaagaccttatcgatttgattttttggatcagtcaatattacttttgtcctctgggaagcgccgtatccttattcctacccacggtatacgcgcaaacgcactcaactaagcatcagaacaatgtatttttagggcaaaatgcagagcgtacacaagaaatactcaaaacgcttgataacccacagcaaatcgctgttctgcgtaaactactcaaaacgacaaagcctctcactccccctgagctgatgagaaaaacagaggtatctgcaaaaactttggatgccttggtaaaacaaaaattcattcgcattgtcgactcagcagatctagaaatccaagacgaacaactccattatttcctcccagagacccccacactcaatcaagaacaactagatgcaatcaataccatctcgcaatcgctcgttgcggaacaatttcaaacctgtctgctattcggagtgacagggagcgggaaaactgaagtgtatctgcaagtcattcgcaaagctagagctttagggaagagcgtgattcttcttgtccctgaggtagctttaaccattcaaacgctttccttttttaaaatgcactttggttccgaagtgggcgttttacactacaagttaagtgacagtgaacgtacacagacctggcacaaggcgtctcgaggcctaattaacatcattataggccctcgatccgccattttctgtcctatacaaaacttaggactcattattgtggatgaagagcacgacagcgcctataaacaaagcgatttgcctcctttttatcaagctcgagatgtggctgtcatgcgagggaaaatgaccaatgctacagtcatcctaggtagcgccactccaagtttagaaagttacacaaatgccttatctaagaaatacacgctttccgttctctcaaaaagagcttctacgtctactcctactaaagtctttcttatcgacatgaacttggagatagaaaaaactcggaaaaagcctttcttctctcaaacggtcattcggagcatcgagcaacgtttggaagtaggagaacagaccattattttcttcaatcgtcgcggattccatactaatgtatcctgctcatcatgtaagtacaccttgaaatgtcctcattgtgacatgattctgacatttcacaaaactgagcggattctcttgtgtcacctttgcaacacccgcctctcaaagcccattacctcatgccctcaatgcctgggcactatgacacttcaataccgaggcactggaacagaaaaaattgagactcttctccgagaattcttcccaacagcccgcactatacggctagattctgacaccacacgattccgcggaagtcatgatgctttagttaaacaatttgctacagggaaagccgatattcttattggcacacaaatgattgcaaaaggtatgcactttcctgccgtgactctttctgtagttttaagcggagactctggtctatatatcccagattttcgagcagcagaacaagtctttcaactgattactcaagtcactggacgctcaggacgcagccaccttccaggagaagttcttatccaaacatttcttcctcaaaactcgactatatctcatgccttagcacaagatttcccagctttctacaaggaagagatcttagggagaaaagtatgtaactatcctccgttcacacgactaatccgctgtatttttcttggaaaatgctcggattatactttaaaggaaactcagcgtgtacacacactgattaaacaaaatttggattctcaagcctctcttatggaaatatctccttgtggacatttcaaagtaaaagacttatttcactatcaatttctaatcaaaactcgcaacatcctcgtggcgaataaacagattcaagaggcattagccgctgcaaaattgtcctctaaagtgcgttgcattgttgatgtagatcctgttacgacattcttctgatacgttacttgctccgtggcaagcaacgaaaccaaaatatctacttcttgttcggtattgaaagcatgtaaattggctcgcagtactttacctgtaggaggacaagcgactccaacacgaatgcctgtggcaactaatttttgatacaattcctgctcagagatcccagggagagagagcggttgcacaaatccagctgctgcccaagagattttttgagcaaaatagtcacgaatacgacgtaatcgtgttctcgcaagttctccttcttgtgagagaaattcgtatgcaacttgtatagatactaacaaatagggaggtattcctgtagaaagacttaccataggttctttgatcaaatcctgcttcctatcgcaagaagataaccaagctgcacccgcggatcccaaagctttactgaaggtaacgagtacagaataaaaattttcataccctaacgaggcacaaaatcccttcccagcgtctccaaataatcccacagcatgcgcttcatcaactatcaactgagcgtgatactgatgagacaatgccactatttgctccaaaggagcaaaagaccccttaaaagaatagacagaacagacgaggataaatactcgttgaaaaccacgttgctgacaagattctaataaagactctagatgatccagatcattatggcggaaactctgatgccaccccgacaaaaaaacagatagattgtaagaaacggagatatgcacctgctcgtcccatagcacataatccgctacggaagatagatgcgcacaaatcgcagtattcgcaacaaaaccacttggcaaaataagagcttctggagcgccatgaaagtgcgctatttgatgctctaccccatctaacagcgaggaagagcctaaaatagcgcgcgaacctccataacctaactgcgcatgaggcttgtctctacaataaagccgataacgagcctcaacagcatgaactaagctatctaaacgagagaatcccaggaaatcattagtgataaaatcaatagaaagagcttccttcaaaacccatttccctcatagctataatcattcaaagagcagtccttattcgctaaataatcgttttgccaaagcatttaaggaacagtaatcaggtttccccgtccccaacataggaatcgcttctacctgatggtgataagaaattttcaataagttactggttttggagttttttaggatatcatttacttccgaaacagaagttgggaatatcgtgaataggcaaagacgctctttttctcctgggaggccgcaaaccaccaaaggatgatcggcagcattttgcccacatccttccataataatactctccatggcctcaaggctaaccatttctgccccaatcttcacaaaacgactgagtcgtccttttaagaataactccccatggcgatctacataccccaagtcgccggtgacataccaagtctctccagctaactctatgaatccatgtccgaagtcttctcccaaatatcctttaaatagagaagttcctcgtgtcagaaccaatcctgttactccggttgatacagggactttagtttcttcagaaacaattaacacttccatacctctaacaggcatgcctacgcaagactcatgtttcggactattcacagtattaatagtgataaccggagagcattctgtagttccatatccttgacgcagttgaacatgtgggaaagttttcaaagcttcttgatataaagagtgtttgaaaacatctcctccaacaacaacgaaccgcaaggaaggaagcgtggtctcgcttttcttagcagcattaataatataactgaggaaaacaggcgtacttcctagcaaagtgacctttgcttcatcaatcatctcaactattttcttcgcatacaaaggattataggcaaaaacaacaggtatcccggatagcaaaggaaacagcgtacaagaattgaacccatacgcatgaaacgggggaaggaaggatatcattgcatcatcttctttcggagaaaagcaatcgaaacaggcccgttgattagcaagtagtgaggcattagtaagaggaaccccttttgggagtttctcggttcctgacgtgaacagaatgacagcaacatcctcagggtctttatcaaacactccgaaccagcgcatcatccattcaaaaggtatggacatgcaaatacccactcgacacttctctaggaaagataattccttacgaacctcatctagaaaaantagggaaaaaggatattctgcatcttctccatgcgtctgcgccaatttctgcataagaggctttgctgtaatcacatgagtcacaccaaccaggtttgcgcacgccgttacttctcgcaacccttgactccagttaatcatcactggaatcttccctgaaagaagcgttgcaaaataagcaatataggcgcctgctgatgcgggcatcataattccaatatgctgatcaggataatttgctaaacgtgtcgctaaagcacaaacagccttatacacttgattgtaggaaagctttccaagttgctcatcccaaaaaaccgtcgccgtagtcatctctgcgcaaagcttcaaaaaactgcgtaaaacggttttttctgatcgtaattttccgcgtttacttctagctgtattcctattatctcgcatctcttacctatgcgtaggggacctctaaaggagtctcccccccctcttgattaaaccaatccgagaggaaagtattgaattcttgttttgtcgggaactgcttcaataccgagtaatctgcagggcaaaccgaaacccgtacctcgcgtttgggcatgaagaaaattccgcaccgcaacaaggctttcaccgcctctttaaacactttacctaattttggtgtgcttcctgttctatagcgtgaaaaagaacttccccaaatcctgtgtcttaactaagaatacatcacattccttcgcccggtgcaaaatagtgtaggctgcctgctgattaacgatctcttctttcccatttctagacaatcgtcctgatggataaagaagcaagctttccttacgatctagcgcttgggtcacgcatacataaaagcgctctatcctttcaagcaaacgcttatcatcccttccagggacgacggaaggcacagggatggctcttacagaatcaagaaaccattttaccactggattattgaataaataatctaccgctataggtcgcacgtgaaactttaaccaaaacacgtgctctaaaatgacagggtctatctctgctacatgattagaaagaaataaagctcccttctgggaattctggttaatagactctatcccttcgactaatacacgatagcgaagtttcaaagcgcaccctataagagaagtataacacacctcatacagtctacgccaaaaccctatcttcatacttcctcttggtttattaaaattattcttgcaccaaagagtgcaatatttccatatccaaattaacaggtttgcattctgaaaagaactattcttttcatttattatcaaaaagatatcgtggcttcatatttttcgttaataatctttacagaaatccaagttatttgcgcaactctacaatagctctgctcttgctaagaaactatctctctggttaggatgtcctctcactacagcaacattcgctccctatagtgagtgattgtaacctctttgcaaccagcggaaaagcttatgttctccctcctcaatgactgccaaaaagctgcggaaacagttgtcatgcaggctatgctgtcactgatgcgctatcgaaaagctcataaatttattcccttttggaaaaagcctgaccagacatacgttactcccgctgattacgctatccaatattatttttaccaaaaactgacatctttatttccgcatatcccgctggtcggagaagaaactctcaatcctgccacggatcaccctaggatccctcaaatcctacaatttgcgcagcagctcgatcccaaagtctcctgtcaagatttgtatcaggccctctctccggaaagctcccactcttcactattttggttaacggaccctatcgacggtacttcgggattcatcaaacaacgttgtttcgccatcgctctttctctattttacgaacatacccctgttctctccgttatcgcttgcccttcttctaaaaataactctttcaaaatctattcggcagccaaagggaaaggacttacgatttgtaatcctacccattccttccccttctccctgcacgaagatttccagcctacctgtaaattctgtgaagcctccttatcagctagaaaccatcaacatttagctacacatattctcagtaaacacctcccttggaatcctcagcctatccgagcagatagtcaatgcaaatacgcttgggttgcagataatacggtagacttcttcattcgcatcccgtattcccctccacgagcccactacagagaccatgctcccggtgtgtttcttatagaagaagctggaggcctcgttacagatatatcggggaatcctctccctttttctaatccaaatttatatctagatagacatcctttgattcttgcttctgctaacgagcaaatgcatagcacgattttagagactctatacaaactacgtcaccaagctactcaaaacatgctcccccttgccactcatgtctctgctactaagcataaacagctaagcgctcttcaactatagcatcagccaacgtccctgtgtctcggttttctttagccccttgttcgtataatttacgaagtattttcggcaggccttccaccttgcttaacacttctttaggcgaataagctcgccctacggaaccagcgacattcaataagcctcctgcgttagcaagatagtctggagcataaagaatccctctagcaaccaattctctgcctatagcaggattttctaattgattgttggttgctccaacaatagcgcgacatcgcagctgatcgatactcatcgaattaataattccacctaaggcacatgggcatagaatatcgcaatccgaagagatgatattttcatccacttgggcgccatataaagtcactacttcatcgagaagatctttccttgtgtcgtaaacgattaactctgcaccggcaaagaacagttcatgcaccaacttacgtccgactgctcctaacccttgtacagcgacacgttttcctcgtatatccgttttccaaaggtaatctgcagtttcttgaatacataaaaacacgccgtgagctgtgtaaatagaagggtctccactgactgttacaagaccacaaacatacggtgtctcttcacgaataatcatgacatcctgaacagagacccccacatcttcggctgcaatgtacttcccttgtaaagagtttacagcttgcccaaaagctcgcagcattccttctgtaggactagtcatcccttttggcaagaaaatgacactcttcccgcctccggtttctgtactgctgagaagagctttgtatgtcattgcttttgacaaacgtagagcatcttgtaaaccatcctcaaattgaagataagggaaggcacgaatgcctcctaaagctgggcccacttttgtctgatgaatagcaattacagcaactaactgtacagactcgcaagtaactttcaaaacctgttcatatccttcaatatgtaggtcttctatttgcaaagagtatttcatatcctacgtccggctcatattattttgcagtacaatcactctcgtctttcgtacaaaaaacctgtctgaaaggattgccacgagtaacttttcaacatttttcacaatgacaagaataaaagcaaaaagaaaggctgccgataaaataaaagttttactgcgagaacagaagactaaaactatctggacgaataagccggatgcgcaggataattgcgcataaaacactttaatagagagtgatcttatgtctaaaacaccattatccatagctcatccttggcatgggccagtattaacacgcgatgattatgaatctctttgttgctatatagaaatcactccagccgactccgttaaattcgaactggataaagaaactggtatcctaaaagtggatcggccacaaaagttttctaacttttgtccttgcttatacgggctgttacctaagacttattgtggagatctttctggagaatacagtggtcaacaaagtaacagagagaatatcaaaggcgatggcgatcctcttgatatctgtgtgttaacggaaaaaaatattacacaagggaacatcctcttgcaagcgcgtcctatcggagggattcgtattttagactcggaagaagccgatgataaaatcatcgctgttctagaagatgatttagtctatggcaatatagaagatatttctgaatgcccaggcacagttttggacatgatccaacactatttcttaacctataaagctactccagaaagcttaattcaagcaaaaccagctaaaattgaaattgtaggtttatacggcaaaaaagaagctcaaaaagtcattcgtcttgctcacgaagactattgcaatctttttatgtaaatcgacagaaaaagaaaaggctgttgtgggagattccacaacggcccttcctaaccaagtttttttcatcctaggggactttatgaagcaaatagataactttgaacaaatttatctgcttccgtaacaatattacgaatttctgggaaatttaaaaaggcgtaaaccttcttgaaagcttagccactgcacatcacagatctcatcaggatcagcatgtacttcgcctttaacctctgcaagaaaataagttacctctttacgcacaaagatttcttctttgtcattaaaggaataaattttccacaaatatttttgggaaaaaattaacaatccccaaaccagtttcttctacaagttctctctcagcagcttcctgagggccttctttttcctcagcatgccccttagggaaaccccaatgtttcccatctgtatggcagataaaacaagcctttaaggtacttctatccggagtaccaaaaaatctgataggaataacgccaaaagaatattcgtgcttagttttcatcataatgaaggttcatacctcgaaaataatatcgttgaattgtgtccgccaaaaccaaaagaatttgacatagctacatcgacatcccaatcttgagctttgttcgcaaccacatcgaattcttctatttctgctatcggattttctacattgattgttgggtgcaacttcccagtctggatggcttgaatggttgcaacagcttctactcctcctgcagctcccaagcagtgccctatcaacgacttcgttgaattcagacgcaagtttttgacgtggcttccaaaagctttcttcaaagccaatacctctgatagatcccctagaggcgtcgacgttccgtgtgcattaatataattcacccgttctttaggaatcccagccttattcaaggctcccaatatacaggcagtgattccttcgccatcatctctaggagcagtaatatgaaaagcatcgcacgttttatatgtgccaagtacctccgcaaaaatcggagcccctcttttcaaagcattatcaagggtttccaaaacaagaattcctgcgccctcccccaaaacaaaaccgtctcgatccctatcccaagggcgcgaagcttgttctggagcatcatttctttctgacaatgcgcgattcgcaataaatccagctaaaccaacacggttaatagccgcttcagttcctccacaaacgataacatctgctcgaccctcaatgaggtgttgataagcggcatcaatacagtagttggctgttgcacaggctgttgaaatagaataattaggtcccattaacccataatccattgcgattaaagccggagccatattcgtaatgatgtaaggaataaagaatggagataattttctatttccagccgatagtttttcaatcccctcatccagggttcgtaatcctcccattccagaaccaataatcaccccacaacgatgagaatctgcgggaagagtatcttgatcccaacggacatagctattgccttctttgcggctacaactgcataagtaataaaaggatcaactcgtctaacttgttttttatctaagtaaggctctgagttaaattcttctatccagccagcaaaacgcgtagataatcatcgcagggaaaagacgtgattgttcgcactccactaattcccgccaacaggctatcatagaaagattctacttcattcccaaggcaggagacgatccccattcctgtaacgactacacgttttttgttcatactttctcctttaagaagctagacaatcagacgtaatgattgctccgtccttccacaattcttctaaacaatactgctctcgtanngaagaaacaaataagtggataacaataaatccgtaatcaataacaacccaatcactatgactaagtccttccacattcaatggatagacttttagtttttttaactcctctataattgtgtcagctatagctttaatgtgaaccccaacgttcccttcaacaaaaacaaaataatctgttaattgggaaatgttttgaacgtctaaaacaacagggttacggccttttttgttatcaatagctttaacaattaccttcaataaatttaaacaaaacgaatccataaaactggcctgagaataaccgattatctaagataaggtcgagctttttttctagagagaaaaatccctttgagccctagctctcgtggatattctttaccaaaaatagcctctttcctctagcgagatcccctactctttgaagagctttctcaaaaacctagtcaccgtactcaagctaacttccatgccagagcaagattaggacttctctgctatccttatggacatatttttatttcaaagagctaaggcttttttcgcaacattttgcgatcgttctcatcatgaacataaaaacctgtagtgagaacaaacctaaccatctaggatacgctgtatacatagatgttttccagtcctaagttgccactctttaaaacaatttaaaaaaaatagccaaaaggctcttcaccttttgactacttgtttttactcctccattatcagcttttaaacaaactgctgtatttgtcttttcaactcgataatggctgcatcaagctcttcaagggcctttctatcctcttccaccatagcactatactgcaaagcacggtcaaaatcgaggccggatccccctaataatttcttatcacactcaaatttagctttgagctctttacgccgcagcattctttgttccagaacctgccgcatatttaatactttttcatctggacaagctagcatttgttcttctagccgtgcaagaacgcttctctgcgcagcgttgatttgattatccaaagctactttcttcgcataaggcagataagccatcttcttcacagcttctttcagctcctgacaacgctctttagccccttcaggaagatctccttcattacattgatcacagaaactttgcacttcgttttccagtgcttgaattgcttctgccctagcctgctctgctttagcttgcaactccttcatttctttctcaatgacagcttctctctctcggacctctcctaacaaagtctgaatacggcccttcaatagaacaacatcatcatgaaccagagagattcctcgaatatgtttagaaattgcctctatctccttacggatcttatggacctcttcgttctcctgtaaaaggacttctacctgatctaaacgcccttgaacttccttcatattctcagcggaagtagcagccaaacggctttgttcctggcggatttctttttctaagcctttaagctgatcccaacactgactcagtcccaaacgtgtcgaagaaaaaactccagaagaaatagatagatacttagcagcctgctgcaatctcttaatttcttttcttaagaaaaagacggacttcttaagagactctctagaggctcttgaaaaatatctttctacaaaagcttccacatcttgagcaaatagttcgctcaccttctcggttaattcttttctacgaggaaataccttattccctaaaacggataacttctgaaaaaactggcttttcagccgcatacgcatgctaatattcataagctcttttctcaaattgataatttgagaagagaaacttcctaaccagcgcagatctgcatgcgtagacaaatagaaatctttatgtgcagacaaactaggaatttctaacgcagctcgatcctcctcagagatctcttctttctctgtttttgagaaaaatccctgaacaccagattccaaacaagaaatagccagctcaatctgtcctactaggaaagcgccttcttcatcttgcaaagtcttgatataacgcccttcccttgttaattcagtgtaacgcccccaaagattggctcgctgaacaggatcctccaactgctggaataaaggtagacaaaactttctcacattccagaacagcttcaaatcgctgttctgatccgcaccttttagcaaagctcccatctgctctaatgcaaataaaatcttttcttcaattgagctgcgttctgcaaccacttgctcaaaagcttccattgactcgcaactctggacagcttctgctgagatctctgaagaagagagcttatctttagcacgatcattttctgccgcttcttgattgcagcaagctgcttgctctacttctggtgtatttgagccctgttctggaatatccatatgataactattggttagtgtgagtcttgacaaaaaaaacaattggtagtcaaagtttgctctggcaatgcattatcgtcaacggttttatgggatctccagcaagaacttcgttccaggaaggactccgcctttttctttattcccccttggaagagcttcgaatccatgcagattcattacgcaaacaacgctaccctcaaaatactattacctatgtccttgatgctaatcctaactacacgaacatttgtaaaatagattgtgcattttgcgcattttacagaaaaccgcgttcttccgatgcctatctactctcctttgatgaattccgacaattaatgcagcgctatgttcaagctggcatcaaaaccgttttgctacaaggaggagttcatccacaaattggcattgactacttagaaactctagtttccatcacaaaaaaggaatttccttctttacacccgcactttttttctgcagtagaaatcgcacatgctgctcaaatatcggggatctctaccgaacaagctttggaacgtctctgggaagctggtcaacgcactattcctggaggaggagccgaaatcttatctgaaagaattcggaaacaaatatctcctaaaaaaatggggccggatggctggatacaattccacaaactcgctcatcgcttaggattccgttcaacagcaaccatgatgtttggccatgtagaaagcccagaagatattctgctacatctacaaactcttcgtgatgcgcaagatgagaatcctggattttttagcttcatcccttggagttataaacctaataatacagcactagggagacgcgtccctcaccaagcgtctcccgaactctattaccgcattcttgcggtggcaagaatttttttagataattttgaccacatcgcagcatcatggtttggggaagggaaggaagagggtgttaagggactcttttatggagccgacgacttcggtggcacaatacttgatgaaagtgtccacaaatgcacaggctgggatctgcaaagctctgagaaggagatctgcgcaatgctacttcaagcaggatttactcctgtagaacgagataccttttaccgcccgctctctttagctagatgaggatttacccacaaagaaaatagtcttgcgctatcttctttgccatatcatccagagtcatccccatgggcctaagttctctaaacaaagaatacctcttaaaccaggtacgctgtttcttagtataacgccacgtattggtaataaatttttgcttcgtgatctcaaataagtctggtgggcttcctaaatccaagaactctatccattctctgtatccaattgctcgtgatgcggaagaattccctttgatcccagcagctaaaagagcctgcacctcgtctaaaagcccttcttctaacatctgatcacatcgttctaaaatattatggcgcaataactctggatctggagataaaagccacccccgacaatgatactcttttgattcatttacggtagattgccaggcataactagataccttactccctgtttttcgaataatttctaaagcacgaataattttattcttatcatgcttggtaatagtggctgcataaacaggatccaaaagctctaattcttgatatagagcgcttattcctcgttcctgcgcttctaatgtaagctntcccgcaatacaaaatctggagaaggcccagatggcggacctgatagaaaagtatggaaataaaaacctgtccctcctacgagaatggggactttattacgcgacaagatatcttgacatgcctgcactgcatgataatagaaatcaacagcattaaaagactcttggacatgacacacatctatcaagtgatgcggaacctcttacggtctgctagggaaacttttgctgttccaatatccattccctgatacacctgcatagaatctacggagataatctctccgtccacaagaggcgccaatttaagagaaaccgctgttttaccagatcctgttggcccagccaacagaatcactgtccgcttaaacatttttgaaaaagatttttgcggatccgaacatacagcgaatccagttgcagctcccgaagaggatgatgaggacatagtttaaaaatcgctaaaagattcttgttctgctttacggatggtgattactttatccaatcctgcgatacgaataatatcagcaacttcatctctaagacaacagatacaaagcttcccattatgattttgtgttaattttgctaatgagagcagtgtgcgtaaacctgcactactcatataaaaactttctccatatttaacaaaacattaacacgtccttttgcaatggattttgttagaaactcttctaaagcaggaaccgtcacagcatccatatccccttttaaagaaacgataaaaatatttttgtactctcttgctatccattccataatctcgccttctaattcagcttgtaatctaatgatgaaattcttgacggaagaagtctctaccttttatcttccaataagggtttctcactttttttctatttaaaaaagcaattctttttagattcttctagatgcacgttagaggttattttgcccccccgctccccctcttttttagtacatatatggcgtcttttttttgctaaagggccgaattattctcttccctacgctttcctgtgtatcttcgttagcgttctcgtctttttacccatcggcttatggctgactctgcctagttttttaaatttcaagcactccctaacgcctattaagacattgtttcttacctgtacggagcctccttgccttcctgagccttttttctcggatatcttgcatctttctgctgattcccctccagctttacagacattttccacgaagtctgccgagcactttttaaatgaattaggagttttttcttttatttctattgagaaggttcctgatcataaaggcttagatatttcctatgctttgcatactccattagcttttttaggaaatcaaactcatacattcataggttatgaaggacaaaccttcccagctttgcccttttttcaatccttagaactacctacagtcttcttttcgcaacaagctctttcccaaacacgcattccacatcaaacactgtctattgtcacgagcctaatagatcaactacagatggatcctcctagcatcattgacttatctcaaatcgatcattatccgggagaatttgtggtatccttatcttctggaacactcttacgttttcgtaaagactctttccttcctggaatccaacactatcaacaagcactctctctaggagccttctctcctcaacaagctgtcatttgcgaccttcgttgcgaagactatcttttacttaaacgtaaatgaagaggtttctatctctagaatttttcaccataaattagcccatagtggcctataagcgaaaatattgacgcttttttagaatttcatatattcttcccacaatcttgggcaagagactcttatcaaggtttttatttctcattttacattggattttatggaagattttgcagcgtacatcgttaaaaatttagttaccgatcccaacgccgttgagattcggtcatccgaggacaaagccagcgcaacccttaagctggagatccatgccgcttctgaagatattggaaagatcatcgggagaaaaggacaaaccatacaagcgctaagaaccattctaaaacgtgtaggcgctagattgcagaaaaaaatccttgttgagcttgctcaacctgaaaacggctctctcacagatgaagaagttttgtctttagattagatctctgcagcttctgccgaagatttcgaagaagattcttcttttgctgaaaatagcatcgaagaagaaccttcggtcattgtacgatctcttgcaggtgtatgcccaggttgtagctgctctcatcatcatgattagcttgattgcccaacaaagagtctctcttgttggagcttactgaatagcgaacgcttgatctacaaaagacgttgatatcaagcgttggcgttggttaaatcgttgcagcccatcaataacaagttgatggactatctgttcataactccaccctttacgaatgaaagatgtaagaaatgggctcgtttctgtcattccaggaatggggttcatctcagataaccagaaatttccttcttcatctacaaaaaagtcaatacgacacgaccctttccctagcaataaacggtaaattttatccgcagcttctagtatttgttcctgtatttctttagagagatctgtatcaaatacgatctgcgcactagacttgccacttaacccatacttctcttgatagtctataaaacctccactcccacgacgctcatgcagaccagcaatgacaaacgcaccagatccatctcctaagacagaaacttctatttctttgcaacctaagcgattttcttctacaaacacgtcgttatctcgcataaaagcttcattaatggcatctcgtaattctataacattatgaacttcgaagacgccgatactagatcctaaatgcgaagatttcacaaacataggaaatgaaaaagcctctacaatatgtgctaaccacttatnttgttcttgattccatcctgctaatgttaaagggagataaggaacgacaggaatccctaaatcactcataaagcgcttagtaaacactttattcattgctatcgcagaaaaagcgatagcaggacctgtataaggcttaccaatagtctctagaaatccttgcatagctccatcttcaccatagggaccatgtagtatcggcaacactacgtctactttttctagtctctgagctatttctggatcaaaaacggatttccctgagtcttcagcagtctctaatgaagagacgctctcccataatccttctcgagtaattaaaaaataactcacatcataaaaggattttgaaagatgtttagctatattttttgcagatagaacggaaatctcgtgttcgcatgatttccctccacaaataattcctaagtgcagtttttgaggctcaaaatctcttaacttttctcccaaattcacaatattaccagcacctaaagatacacacacatcgtgtacacggatggactgctctaaatgtctctgcaactcatgaaacggaatatgcgtacactttactatcgactcttgactaatagcttcagcaagctcttggtacgagatatcttccgcctcctctcccgcactgtacacttctgttaacaagacttcatcagcatctttaaatgctgacgggaagctgtctatacactctcttaatcgagaaaaacgatgaggctggcaaatagctaaaatacgtctctgtccaacagcagtacgaacagcacgtaatgtacaagaaatctctgaaggatggtgtgcataatcttctaaaaagagaaaggtctcagaagaattctttctttgtaatcgtctttgaactcctgaaaaccctctgaaagcatttcttatagcaccttcatctatacccaatgacagagctattcccatagctgctgcagcattcaaaacgttatgcatgccgaccaattgcacttctatatctgcatacactacatcttgatactttgctgtaaagtacagtctccatccttcttgataataagatagaatatgtagatcacaagaagagtccaatccaaaagtatgcccttgcaagcatgaacgcaagcgaggacaatatccattataccaacagatctgctgagtcttgagtgcaaatctttcaaagaagccagaagaagctctcgatctccttcaaaattagacagatgctcatcatctatattcgtaataacagaaaactctggagtataacaccgaatagacccatcgctttcatctgcttcagcaacaaaatattcagatcccgaaccaccattgatgccttcttgattcaaacctcctataacaaaggacggatttttctttgcttcctgcaaaatggctgtgatcaaagaagagactgttgtcttcccatgacttcctgtaacaaaaatagaaatctgatcttgagcaagctcggctaataattcggctcgatgaactacacggttccctctacttttagctgataaaaattcaggattttctttagaaatacttgaactgtatacaactacagcgccttcagggatatgttcttcttgattccctaaaaagaattccgctcctttattcttcagcttctctaccactttcccctcggaaagatcacttcccgatacgctatatcctcgatcgagcagaacatgtgctaaagcactcattccaatcccaccaataccaataaagtggtaaaacaagcttttcatcatgagcctatagagattcacaaataaactgatacagtgatttgaaagacttcttctgttgtgcggaaagcatagccttgcgcctattttcactggttgcaggatctaaagcaaagtaaaacctgcttactcaaactttcttctgttaaatacttctgcaaaatcatagtccctccacctacagtatgcgtgaagaattttgcattcacttcttgatgtccataagcacctggataaggaataagaatggcaggcacctgaacccaaagcaactcattaagcatcgttgctccagatctactaatcactaaatcgcttgcctgtagtacgccgagcatattgtgatcaaatgcggtaactgtatgattgataccagcatcttgataaacttgagaaaccgcttgaaggtctcctttaggccctacaatatgatgaacatataaattcgaataactttctcgaatacgagccaaggcttttggaacaacatcatttaaaatttttgctccttgggatcctcctaccacacaaatgacaggagaagctccagggaaaacgatctgctcagacagtttcctgatagggagaaagacttcttcagctcggcaatggaaatgttcccctgctgctgcaaaagacatccctacacctttagcaaaacgtgaaaataacttattcactttcccaggaacaatattctgttcatgcagaaaaagaggaatcctacttcttatagaagcaagcatagcaggtaaggaatggtaactcccaaatcctattgctaaatcaggagtaaaatctctgatcttttgtagagctgcgacataacctttatataactgcttagccccagagaacatccgattgacacgcaaagaaaaaggcgatcctgaagggatatcacaataggcaatctctgaatcatcccctaaaaaatgagctaatcctttccctaaaagtaagacttctatgtcttcatgaataaaagtctctcttgctgctagagcagggataatgtgccctcctgttccccccactgccaatacgattttgttgattttcttcatcacatatccttaatagcaatcccatgccacacatattagcaattagagaagagcctccctgactaaaaaatggaaggttcactcccttgctaggtaataacccagaaacaacacccaagttaataaaagcttgcatcccaataatcacagtgattgaaatagcaagagccgctccagataaaagcgaggctcgcattgcaatgacatacccgctataaataaatcccatatagagaagaatcaataggagcatcccaataaatccaaactcttctgcgtaaatagcagcaatgtaatcattctgagcttctggaagataagttaatttttgtaatccttttcctggacctttaccaaacactcctccagatcctgctgcaattttagcttggtaaggttgatgacctcttcctttaatatctaattcaggatgtaggtaaacttgcaaacgattccgaacataagggagacgataggcaaatgtgcctccaatacacagaacacatagcaaaggaaccagccaataacgtaatcgtactgcagttacgataaaaactggaattaaggaaaatgagatcacagccgcagatccattgtccggttcaatcgctatcaacataatggggataaacaacagagcaacgaaagctacgaatcgtttaaaactactacgaatagaaggtttcgttgttaaacattcgatagcaacacatggaactaaatatttaacaaattcagaaggctgtaaagttaactgccccactcccagccaacgcttagctccatttctacaaacaccaatacctggaataagaactaaaacaagagtaatccctacgaaaatcagcaacatagggctcattttcaagaaatccttccatcctaagatgtacacaaatgaagcgataccaagtcccaatccaagataagtaatctgccggatcagagctttgtgtgtactacacgacaaagctcgatccaaaacctctgctgatgaggtatcaaacaccatgatcagtccgagagaaaaaattcctaataaacaggaaatcaggaaccatttcataataattccagagatttatcgaattcgtaatctatcccctggacgtaatctacgagctttttgctcatctaatccatttaacttcaacaactcatccaaacgaataccattactcaatgcaatggcccaaggactatctccttccttgactacatagtaatcttccggatttggagtcttcacttgaagatccttctctgtcttattcgttttaggaactcgtaacacttgtcctatctgtaactgtgtcgaagataagtcattcaactgcatcaatgcagaaactgtagtgtgattggatctagctatacgttctaaaaagtctcctttcttaacaataacagtagagaattcctctttttcaggagttttctctactaccttagcgttcacaacagaaatttctggagcgacaggagtcgtcgattctacaggggtagatgaaatctttttagagcccccgctagattccttctctgtcttaggatttttgtccgcaaattgcgcagcaagttcagctttagaaacgacaggatttctaacgacctgagaaggcttcgcaatcacctcaggctttttctctaacttctctggagccttatcaacaaccggaacgggctctaagattttaataggagctattttctgaggatactctatttcttgctctgaatggcgcgcggtcataaacagcactgccaatagcactgcattcacagtagttgctacaatcatcgtgtttctacgattcataaaagaacctcttccatcccaaccaaatgcttaaacattgcccctcgctcttcatagctacggaattgatcaaagctagcacaagccggagacaatacaatcacatctccaggcactgcttgctcttcagcacatagtaaagcctcagataaatttttcactacggttacagggaactcttctagatctcgagcgatctcctgagcgcactctcccatagcgactacactcttcgcagcttttcgcaaagcgggaagaagcgaagagaacgtgcatcccttatttcttcctccgagaatcacaattgcctgattcccaacccctaaaagagctgtttctgtagcactcaccgtggttgccttactatcattgatataatgtatgccttgcttttgccccaaatattccatcctgtgaggaggcttgttaaaagtagccacagcctctataaagctagtttcggatattgggaattctattttagcaagcagataggcacaacagtagttgtacttatcatgcaagtaccaatggttttaatgcactttctttatctaataaacgcatatacttctgtacttcttctaaatacaagtggccgtaaaaacgctcatctcctacccaaaggtcatcgggattacgcatacataaagcaagattttgcttggcttgaaaatactcagagaaattcccatgataatctaaatggttatctgagatatttagaatcattcctccagataagacaggataggatttttcttgatcagcgagctggaaagagctgatttcaacaatccgcactccaggattctgcataccatctaaaataggaattcctacattccccatagcgaaagcaggaatcccagaccgtttgaataagtattctaaaaataatattgtggttgtcttacctgtagtccctgtgattgctaacgactctctttctgtaaatttttctgtttgaaaagctaactgaatatctgtcatgacaggaatgtgcgaggctatcgcagcctgtacccaaggatgctccttggatactcctggagacgacaacataatccacctgtgaagggaactcttcgttctccaaatatttttnctaatatacgggcaattctgaagtgcatgaagcgacttgtctacacccaatacacatacacctttttgagctagaaaacnnacaatagacctcccagagacacctaggccgataacgacaacacgctccaatcccatctaactctcctctaatccacaaatactgcaatgatcccaactactacacaaataagctcgacaattaagaaattcctcactacagccttttctgataaccccttatactcataatgatggtgtaaaggggcacaaagaaagactcgtttctttcttaatttataacttccgacttgtacaatcacagatagtgattccagaacaaaaatccctcccataaacaagagaagaaactctgctcgtaataatacagcacacataccgagcatggctcctaaaaacaaagatcctgtatctcccataaagacacgggcaggagacttgttgtaacgtaaaaatccaagacaacttccagctaaggtagctagaagaacacaacaaatgaaggcccaaggagctccattagtacaagcaacgacaagcatccctaagcaggctatcaccatagctcctgccgcaagtccatccaatccatcagtgagattgactgaattgctcgttccaacaatagccaatgttgcaatagcaaaactgagtagatagctccaccaatgatgtggcaaagaaacgattcctagaaaaggaagatgaaaactaagaaaactttctttatatgcgaacataataggaagaaccacccccgccgccaaacaattctgtataagaaacttatgtttagcagacaacccatgccctactctacgccgatttttaatctgatcatcgcaccatcctaatgctccccataatagaatagttccaatacaaaaccatgtagaccaaagctgtatggggaacaataaaagaaccgccaacacagatgcaaaaacaaaaactatccctccagctgtagggatatatgctttgtctttatgtaactcttctaatttttcgcagtgatctttgtgaatatgatcttgaaaaccttgtttttttaaccaagaaatcaaaggtttcatcaaaaaaaggctaaaaaacaagccaatagaaaaggctttcacaacatacgttagaggcagcatctgttttctcgttttattatgggaagctcttataagaaattctctatcttaaacttaagctttcaaaaggcaagttaaaaagagcatcttacagcgacttgaaagttaactatttctattctaaaaagaaattctgatcttttacctatgaaatcgaaaagcatggtaataaagtctctagttctaaactacgagacccttttaacaacacaacatctccctgttgaacgagagctttcacggtatccataatctcgctcactgcgctataaaacccaatctggcaatccgcatcacgaactatatccctaacagggaaccatttctctccaacaaaaaagatgatgtgagcttttgtcacagctttcctagctacagcaatatggcattcatcggaatatcgtcctaactccgccatatgcccaaggataaaaatgatcttacctccctctggaggaacaggaacagcatctaaagcagctagcattgcatcaggactagcattatatgcatcattaatcactcggataccattgtgctcttgctgttcgaaacgcatggcaggcaaaaacagagactgactcacctgctctaaacgatccatgggaacattcgtaatccaagccaaagctactgcaataataaaattcatatacgctggagaatacggaaatacggcaggcaactcaatgtccccatcaggagcactaataaggactcttcggaatgaatcgctcgataataaaaatctgccgtttcattgctcatagaaaaagaaaatcgctctgctgcagaattcttttttgcaaaaaactgaaaccaagaagagtctttaggaatgagctgcaacccacatctttccaacagcaagcttttttcctcgacgataccttgagcccctttatccagaaaatgcatagcatgctgcacgtcgatatgtgtgatcacaccgattgtaggctcaatgatctccaaaagattcttcatgttattaggttcagaaactcccatctctagaagtaaaaaatcctcatccccatcggccattaaaacgcttaaaggcagcgtcaactgcgaattgtagcttttgggactcataaagactttatagacagaagaaagcaactgatttgcaaaatttttagtagttgtcttccctacagatccagtgattcctataacttctccatggaaaagagctccttgggtacgccccgctgcccgtaaagcttctcgaggatccgccacacgcaataactgcagaccgtaacttggaccatgataatcgcttgcgactacagcagcaactgctccagattgtgctgcttgttttaaaaataggtggccactcgttcgattcccaggaagagcaaaaaacacgtccccaggcaatacgagtcgactgtcaatagcaactcctgtcactttcttccccgagcgagggatttccatacctaataacaaagaagaccattcttccaacaaaatagggcgcataacagatcccttggcttcgtgccgaataccaacaactaaaaaatctcaaagaaatagattttagaagacgcactcccccgccatctcctaaaaagattctcttttctttcctctactagcagtcttaaaaattattctatatccattatcaattcaacctctaaagaaacgcttttcactcacataaaaaagcttcaggaaaaattttttcttcatcctgcttacaaaaaaaagatcccagaaaatgcacactgttattgacttttcctcataacatcgcgtacactcggatatctcccggtggcatcgcnagcggtaaggccgaggcctgcaaagcctctatccccggttcgattccgggtgccaccttcttaaatctcgttgtgatctaactggcgagttggtagtgttctaggtatgaaagaaaccgttacaggaataccccgctatgcctcacgacaacaatgagatgcatcgcaatactattcatcaactgtttacaggccttgataaggcgtatcaaatagtaaaggggttttatggccccgcgtactcctcttcttcgaaagattttttcaaagggagaggctatcatattctttcgcgtatagaactttctgatcctttcgaacgtattggagtctattttgctcgatctctagcaaaacggatccataaacgtcatgctgatggagtgatctcttctgttattcttttacgagcctttttaaaggcatcgattccttttatcgatcaaggactttctcctcgacttttagcttctgccctcgcctctcaaaaagaggcggtgtgcgcctatctgcattcgcactcttttctcttaaaagatgcttcaaaagtgctcgggctcattcgttcccatcttcctgatcctcttattggagaggcttttgctgaagccgttgcctatacaggacatgaaggagctgttgctttatctcaaagaagcggctctacgctacacctggtgaaaggaatacaaacgcaaaagggctatcgaatgccgtcatttttccctcatgactcttttcatgaaaatcctattgtagctcctaaaatttttgtcacagatcagaaaatccattgtctttttccttttctgcccttactcaaaaaattctccgaagaacaaactcctctgatcattttttgtaaggagatagctcccgacccactagctacctgcattgcaaaccgtatagcgggactgttggatgttctagtagtgacaatccccgataccactctgttagaagacatcgctttgcttacagggacaacggtcttttcctcgccgcctttctctaataagcctcctatagaactgcctctactaggatcctgtacctgggcagaactatctcgcgatcataccttacttgtctgtgagaatctggttcctgaagtagtgaaactaaaagttcgacaactcgatcacgctatacacaactcagaagacgaaacatcccgaaaactccttaaaaaaagaaaacatcgcttagaaaacagtatcgcaatcattccggtgaagcaggacacagctcccctacatgaattagctctcaaaacgctaaactcaacacaagaatctggtttcgtcttgggaggcggagggctcttctttacgctactcagagcctctcttcctcttcagagcattctcaagaagaacaagctgctgttcagattttacagacccgtgccgcactctcttggaacaactggttaactctgtgtatatggatggaaaacttgttgctgataaactctgctctctagggactccaagtctcggcttcaatgttgtatctcaacaaatagaagacatgatctctgcaggaatcattgcacctttgaatgctgtgctagatattttttcttgttccctgcataccgctgtagatcttctcttagcttctttcactaccccaccgactcctgcagcaaaagagaaaaaaacttaatttttactaactatccgcctatcataccgagggtatgctcttgttaataaatcgggttctctattaaccatcgcttctctatgccaaacaagccttcacacgcctttagactgatccattgctccgacattcacttctgtgtactccctaaaaatccttttcaatgcttcaataaacgctttaagggacttctaagacaacttataggaggcgtttcctttcaagcttttgcaatctctcagagattccctcaactcgttaagcagcttgaagcagatagtgtctgtgtgactggagatatgaccatcaccgctctcgatacagaattccgtttcgctaaagaatttctttctcgcgttgaatctgtagctcctgtgtatatagttccaggaaaccatgatgtatncacccatcgggctttgaaaaaacaaacgttttattcctattttcctaataaagaacttcaaactcaccgtatcgcctttaaaaaactcactcccacatggtggttagttcttctcgattgttcttgcttcaatggttggtatacagcgaatggagaagtgactgattctcaactccttgctttagaacaatttctttcttctcttcccgcttctgaacacgtgattgtggctaaccattatcctctatctcccacaacaagacccgctcatgatttactcaattatgcccctctaaaatccctactgatgaattctccttctgtacgcttgtatctacatggacatgatcattatgtagaactcgatcatctccctcctctggtagtgaatagcggctcactaacacttccctcaaatgcacgctttcatattatagacttacatccagaagggggatatcaaatcgcaacagcggcattaacaaaccttaaggaaacctctactccgttaaccatttctatcgaagaaaataccatctctttataaatcctctgcactcaacttgagaataacgaacctggaaggactcccgatgaaagaaaaaaaagtgttagaactatcgccagaagcgactcttttaaaaaaacttcgtgaccgagctatctcccagcaagaaacacaaaaaagaaaagcctgggtagagaaattggctgctatgccagaatcgactagagactacctagagcctcaagcgcatcttgaaccttcgcaattatttcggaaagtggcggaacgccttcttgaagaaggggcgtaatgccccttctaatttttattttgatacacgagactcataacttcctgttcgcgtatcgaccttcacaacttcaccttcttcaatgaaaatagggaccataatctttgccccggtattggttgttgcaggcttcaatactcgtcctgatgcagtatccccacggactccaggagctgtttctgcaatagtgagctccataaagatcggaggttcaacagaaatcacatccccgttgtacaaaaccaacgtatatattgtatcttctaataaccattgccgaacattttcgagtttgtcccaaaaaatgagttcttgttcgaaggtctcgtcatccataaacgtagccccttcctgatctgtgtacagaagacgcatctgctgctcccgtacatcggcagtttctatagattcccctgatttgaacgttttttctattacacgcccagttaaaaagtttttgactttgattctattaaaagcctgtcctttccctggcttaacaaaatcgttctgcaaaattacatagggttgtccatcgatctcaacgcgcaatcctacacgaaattcactagtgcttacacgaaccataacacgcttaacccgttatcttttctccatccatgttatcgttctcttctaagctttgtccagaagaatgtcgcgaaacaaacgctttccctctttcttgcaaaagaaaactatacttttaagtagcccaactattaccctcacgagaacaacttgttccatcttcatactatgtttttagaaaaaaagattctctaaccattataatatctgtgatttatgacccatcaacataaaaaaatcagcgaagaaacaatcgcctgtgacatgctagagcgctataccggctctaccattcaagagttccagccctatctccttcttactaattttgggtattacgtggatgttttcgctgaaatctatcaggtccctgtttctcgaggatccatgttttcggcagcgcatgcgcctcaaattcacacctcaatcatcgattttaaattaggctctccaggagcagctcttaccgtagatctgtgttctttccttcccaatgctacagcagcgatcatgttgggcatgtgcggaggcttaagatcccactaccaaataggagattattttgtccctgttgctagcatccgaaaagatggaacatcagatgcatacttccccccagaggtccctgcattagctaattttgtcgtacaaaaaatgatcaccaatattctcgaagccaaaaacctcccttaccatataggcatcacccacacgactaacattcggttttgggagtttaataaagagttccgtcgaaaactatatgaaaataaagctcaaactgtcgagatggagtgtgccaccttatttgctgcaggataccgaaggaatcttcctttaggagcacttttgctgatatcggatctacctttgcgaaaagatggaattaaaactaaggaaagcagttcggcagtcctaaactctcacaccaaagagcatatactaacaggcgttgaggtgtttgcctctctacaaaagaaatcaggcccaggaatcaagaaaacaaaaggcttgccgcacatggagtttgggcaagccgatgattctctttctgaacaaactggagtttctgacggggatttctaaacagaaaggattctctgcacaatattatccacagtgaaaccgcaagtctctgccacctcattgggagctccggacattccaaacccatccatggcaatggctaagccattgctaccgatgtatttgtaccaacccaaggcggtacctgcttctatagaaacacgcaaccctaaatctcctcctattacggattcgcgatactcaacgtcttgtctctcgaatagctcccaacaagggaatgaaatcactcgcacacgcttatctaaagccataagactttgtgcaacctctatagccaaatgcacctcggatccagaagcacacagcgtatagtctgggcgatctccttcctctttaaccagaatataagcaccctttcttactccttctctgaaagaacgtttcgtctctttaagagtaggtagattttgtcgagataaaattaaagctgttggaccagcgctttctaaagcagctaaccatgctcctttcacttcattcgcatccgcagacgaatcactcttagccctggaatagcccgcagcgacatgatttgctctataggctgatgtgtaggtccatcctctccaacaaaaatcgaatcatgagtgaactgataaattaccggcaatttagataatgctgctaatcgaatcgcggaacgcaaataatcggaaaagactaaaaaagttcccccaaaaggacggaatacttgactatacgctaatccgttcataatcgtgcccattccgaattcgcgcactccatagcgaatattccgcccaagaaaatcgctagcactaatagttccttctttagctatccaggtaccatctgaactagagagatccgccgatccccctacgagggatggaatatcctctgctaatacctgaatgactttattcgaagctgcacgcccggctatagactctggcatatcaataagattcaaaatttcttcgagttcttgaatcgagatctcttgaatcaatcgaagatattcttgatgttgctcgggagcttgtttagaccagactcggaagcgttcttgccattcttcctgtaatttcttaccttcctgttgttttgcagcaaagaacatcttcactgccgaagaacgaaaaacttttcttctgggagatgccagaaacttttagtttgagcaacaccatcctctcctaaaggagacccatgtgctttattggttccttctttaggggagccgtgtccaataatagtatgtgcaataatcaacgtaggtttgcattggcttttcttgatctgtgtgaaaacctgatgcaagctctcaaaatcatgtccgtcagtttcaaacacatcccagccatatgctaagaatctctgttttgtatcctcaatacttacatcgtgaagagtcccgtctaaaataatctcattataatcataaatcaaaacgagattatccaagcctaaagaacccgcgaaactacaagcttcatgactcacgccttccatgaagcacccatctcctgctaagcaatacacttttgcatcaaagatagaattcgcaggctgattaaatctggctcctaacatttttaatgaaagagccattccaacagcatttcctactccttgtcctagaggtcctgtagtggcttctacaccatcagtttctctaaattctggatgcccgggagttcgagattggagctgacgaaattgttgcagatcctctaggtttacatcgaatcctgctaaatgcaaacacgagtaaagaagagcagaaccatgtccagcagagagaacaaagcgatccctattcacccatcgagaatctttagaattatatcgcaatacgtaaccatataaataagcagcgagctctgcgcatcctaaaggcattcctggatgacctgaagatgctttctgaatactttctatgctcaactgtttaatagttcctgcaatcttttctaagatgtctatatctaaatcactattgccagccatgttttttcctttagcagaagttgatacctatacgaatgcttaacccaatatagaaccgaaaattcgataataaggagaataaaataaattaagtccctagagttcttaaactctatttcaggataaggaagaagatagtagagaattagagataatttgactaggattacagcaagaagaagagagaaggtattttagagaaaagaaaagggggtagctgcgttagcggctacccccttctcctttttagtctatgactaagatcttatataataaaatgcttggcgacgacctactctcccatactctcgtgtatagtaccatcagcgatcagaggcttaacttctgagttcggaatggtgtcaggtgtttccctctctctattatcaccaagctaatcctggtatcgtttctcacgtatactaatagacgcttaaaagcttgtcttctacgcacttgcactctctactctttttcttattgtctttgcctttcggctcttccaatcataaaaagaccaagtctttggacttattagtattggttagctgaacacattactgtgcttacacctccaacctatcaaccacgtagtctacatggagtctcattgggataccttatcttgagggaggcttggcatttagatgctttcaatgcttatcctttccgaacgtagctactcggctatgctcttggcaaaacaaccgatacaccattggttcgtccattccggtcctctcgtactaggaacagctcctctcaagtatcctgcgcccacgaaggatagagaccaaactgtctcacgacgttttgaacccagctcgcgtaccgctttaattggcgaacagccaaacccttgggaccttctccagccccaggatgcgatgagccgacatcgaggtgccaaaccgccacgtcgatatgaactcttggtggcgatcagcctgttatccccggagtaccttttatccgttaagcgacggcgattccactttccaccgccggatcactaagcccgactttcgtctctgctcgacttgttggtcttgcagtcaacctatcttatacctttacgctctactcgtgattgccaaccacgatgaaataagctttgggctcctccgttactttttaggaggataccgccccagtaaaactgcccgtctggcaatgtccatcttccagattcatggaataatgttagattcccagcttgttaagaccagtatttcaacgttgactcccactctcctgaagaagagtgttcttagtctcctggctatcctacacataacaaaccaaaaaccaataccaaagtacagtaaaggttcacggggtcttttcgtcctttcgcgggtaaacagcatcttcactgctactacaatttcaccgagtctttcgttgagacagtgcccagnatcgttacaccattcngtgcaggtcggaacttacccgnacaaggaatttcgctaccttagcaccgttatagttacggcggccattcaccagggcttaggttcaatgcttcgctttacagctgacatatccctttaaccttttggcattgggcaggcgtcacaccatatacttccccttagaggtttgcatagtgctgtgtttttgctaaacagtcgcctgggccatttctctgcggccccccggggctcctatcgttccatagtcaccctaaaaggctccccttattccgaagttacggggataatttgccgagttccttaacgaaagttatctcgcgcgccttagaatattcatctcgcccacctgtgtcggttttggtacggtcaccatcaacagctagaaattatttcttgaaagcctcgctccacaccatcggttcctccgaagattccccttgatcgcgacctgatcttnatgttagcggatttgcctactaaccgttctcatcgctctacggactcttccaatcgtccgcgtgcttaacttactccgtcattccttcgctatagttttaggtggtgcaggaatatttaacctgctgctccatcgtctacgcagttacgcctcaacttaggggccgactaacccagggaagacgagcttgaccctggaaaccttgggcttacggcgagggagattttcactccctttatcgttacttatgccatggatcttcactagtatccgctccagccctccttccggtacaccttctctgctgaatactacgctctcctaccgcgtgtcttatcgacacacccgcgatgtcggttttatgcttagtcccngtttattatcggcgcaatgattctcgattggtgagctgttacgcactctttaaatgattgctgcctctaagccaacattccaactgtcttcgaatcatcacttccttacccacttagcataaaattagggaccttaatcggcggtctgggctgttcccctctcgacaacgaagcttagcccccgctgtctatctcccggactcgcttctggtattcggagtttgatttccgttggtaagccggtaggcccccgctagaattcagtgctctacccccaaaagcttattatccgaggctaaccctaaagttatttcggagagaacaagatatctccaagtttgattggcctttcacccctattcacaactcatccaaacctttttcaacaggtactagttcggtcctccacatagttttacccatgcttcaacctggtcataaatagctcacttggtttcgtgtctaaaccaaacgactcttcgctcttttaaaactcgctttcgctccggctccggaatgtatatcccttaacctcgccgtttagcttaactccctggctcatcatgcaaaaggcacgccgtcaaccttgacccttacgggccattnggtctccgaccgcttgtaagctactggtttcaggttctatttcactcccttaacaagggttcttttcgcctttccttcacagtactggttcactatcggtcattgactagtatttagccttggagagtggtctccccagattcagactaggtttcacgtgtctagtcctactcaggtgttgaggtcggtctttctctcctttcgtctacgggactatcaccctgtatcatccatctttccagatgtgttcaactaggagtcctgatcctttatcctcaatcctacaaccccgagccttatcagctcggtttaggctattcccctttcgctcgccgctacacagggaatctcttcgatttcttttcctctgcttactaagatgtttcagttcggcaggtgtcgctttgcatacctatgtattcagcatgcaatggtagtctattactctaccgggtttccccattcggatacctccgggtctttgcttatcaccagctcgccggagcttttcgcaggtattcgcgtccttcttcgcctgtcaatgccaaggcatccaccaatagctcttattaacttggtctgtaatttctatagatccatgcaagcacttcacctaaaagacaaatactcttaaacgtctattattatgcgtgaaatatacttgttaccatgattatttctttacaataacatacttgatcacaaactatatgtctcgtcctcaccacgctactcttaacaacacaaatgaaatagaatgcttgctcttacatataaatgcttgcccaacctagtcagaaaccttctcaggcttcttccttatccttaaaaggaggtgatccagccccaccttccggtagggctaccttgttacgacttcatcctagntcatcagcctcaccttgggcgcctctctcccttgcgggttgagtcaacgnacttaaggtaaaaccaactcccatgatgtgacgggcggtgtgtacaaggcccgggaacgtattcacggcgttatggctgacacgccattactagcaattccgacttcatgtagtcgagttgcagactacaatccgaactggggccagctttgagngatttgctccatctcacgatcttgctaccttctgtactggccattgtagcacgtgtgtcgccctgggcataagggccatgctgacttgacgtcatcctcgccttcctcctggttaacccaggcagtctcgttagagttcccaccctaagtgctggcaactaacgataagggttgcgctcgttgcgggacttaacccaacacctcacggcacgagctgacgacagccatgcagcacctgtgtatatgtccttgcggaaaacgacatttctgccgcggtcatatacatgtcaaacccaggtaaggtccttcgcgttgcatcgaattaaaccacatgctccactgcttgtgcgggcccccgtcaattcttttgagtttcacccttgcgagtgtactcctcaggcggcatacttaacgcgttagctccgacacnggatggggttgagaccatccacatcaagtatgcatcgtttacggcaaggactaccagggtatctaatcctgtttgctccccttgctttcgcgccttagcgtcaggtataaattagaaaagcgccttcgccactggtgttcttccacatatctacgcatttcaccgctacacgtgaaattcccttttctccatctaccctctagaaaaatagtattagatgccgactcggggttgagccccgatctttgacaactaacttacctttccgcctacacgccctttacgcccaataaatccgattaacgctagcaccctccgtattaccgcagctgctggcacggagttagccggtgcttctttacctggtacgctcaaatccagcgggtattaaccgccttctcttattcccaagcgaaagtgctttacaaccctagagccttcatcacacacgcggcgtcgcttcgtcagacttccgtccattgcgaaagattctcganctgcagcctcccgtaggagtctgggcagtgtctcagtcccagtgttggcggccaatctctcaatccgcctagacgtcatagccttggtaggcctttaccccaccaactagctgatatcacatagactctcccttaaccgaaaggtcctaagatccccttctttaacgttactcggatgcccaaatatcgccacattcggtattagcggccgtttccaaccgttattcccaagttaaggacaaattatctatgcattactaacccttccgccactaaacaattgccgaaacaattgctccgttcgacttgcatgcctcatccacgccgccagcgttcaatctgaaccaagatcaaattctcagaaaaatatatactttgatttattaacgggttccttaatctcttaagaaatcctcacaaccatctatactggcctgcattctatctcatttgcattgttaagaaaagcttccagcctctcagccttccactctgtcgcgccctctcatccacgtaagaggccttccttcaaccttcgttcgaaagaaagctacatcttatgctaccccctattttttatgcacctattttttatcaactccccaaaaaaccctttttcttaacctctcaatttatcccctcacacactatcctcaaccctttttataaaacaaaattttcctctctttttttcttttttttgctcatcctacccttcctctcttcgatttttttgtcgaaattcttttttttagcgctccgaacaagcttacatcttggcttgttctaattatgagtgatccactagtatattccttcttgaagccgagggcctcttctcttcaaaaagtccctaccaaactttgttcccttaaactagtggactcggtctttggacaaatctttttgtattgttgtgagttaaaaaatggtctccccatgttgagtaacactcttcgatccaattttctaaaattctatgctaaccggaaccatacacctgtagcatcttctcctgttttcccgcataatgatccttccatactctttacgaatgcgggaatgaaccagttcaaaaatattttcctagggaaagagcagacgagttacacaagggcaacgacatctcaaaaatgcattcgtgccgggggaaaacataatgatttagaaaatgttggacacacctcccgacatcttaccttttttgaaatgttagggaatttttccttcggtgattacttcaaacaagacgctatttcctttgcttgggaagtctcgctttctgttttcaattttgatcctgattttatttatgccaccgtgcatgaaaaggatgatgaantttcgctctttgggaaaaatatcttccgacagacagaatttttcgtttaacagacaaagataatttctggagtatggcggataccggaccttgcggattctgttccgagcttttattcgatcgaggagaaaaatttgggaaagccgcttctcctcttgaagacgttgatggagaacgcttcttagagtattggaacctcgtattcatggagtttaatagaacttctgacgggactcttttagctttgcagaagaagtgtgttgatacaggtgccggcttagaacgtttagtttctctattagctgaaacaaaaaccgtattcgaagcagacgtcttaagacatctcatttccaaaatagaaaatttatccgggacaacatactctccaacagaagcaaaaggagccgccttccgagtgatcgcggaccatatccgttctctttctttcgcaatagctgatgggctgttaccagggaatactgaacgaggctatgttttaagaaaaattctccgccgagctgtcaattacggaaaacgcttaggattcaatcgcccttttctggccgatgtggttccttcactagtggatgtaatgggagaagcatatcctgaactctctgcatcagtcacacaaatccaagaagtcttgaccacagaagaagagcatttcttcaaaacgttgcagagaggtgggaatctactccaacaagtagtgaaatcttcagcttcttccgctaagatttctggagaagatgccttcaaactcaaagatacttacgggcttcctatcgatgaaattgccctactagcaaaggattataactacgcaatagatatggatacctttgagaagcttgaagtagaagctaaagaacgctctcgaaaaaacacgaaaaaaactaagaatgacagtgattctgtgttccaagatttagatccaactaacacttccgagtttatcggatacgatactctttcctgcgacacctttattgaaggaattattaagtacaacgaaattgcttcatcactggaagaaggagatgaaggagcaattattttacgaaccaccccgttttacgcggaaaaaggtggccaaataggagactctggagaaattttctgtgaatcaggaactttcctggtatctcatactattgcccctaaagcaggactcatcgttcatctagggaaactttctcaaggaagtttgacaacgacaatggctgtcaccgcacaggtaaaccaaaaccttcggaaaaaaaccgctaataatcacacaggatgccatcttctacacaaagctcttgaaatgactcttggagaacatatccgtcagccaggttcttatgtcgactctcaaaaaattcgtttagactttactcataacaaagcgctatcaccagaggatcttctagcaatagaaactctcgtgaatgagaaaattagagaaaatgatccggtaacgattcgagaagttttgtattctgacgtaatgagctcttcagaaatcaaacagttttgcggggataaatacggagatattgttcgtgttgttttggcaggattttcccacgaactatgtggaggaacgcatgctcaggcaactggagatattggctatttcagaattaccaaagaacatgctgttgcaacaggaatccgtcgtatagaagcaacaacaggagaagacgccgagaatattgctcgtggacaagatgtggatttaaatgagatagctaccgttatccaatctcctaaagatcaaatccttgtcaaaatccgcagtgtaatggaagaaaaaaaggatttagccaaacaagttgctgatttggaaaatcagcttgttcagcaacaagtaaaaaccctgttaacttcctgtgagaaaatctgtgatacttcgtacttagtttactatttaactgaggaagaaggacaaagaattcaacactacgcaaatgctatacataaggaaatccctaccaatttcatttctttatggatcacagaaaagaatggtcgctacattgtcttgtctagagtctccgatgatttaacaaaacgaggcgttcaggcacacaccttacttgcagagcttcttgctccatatggtgggcgttgtggcgggaaagcgatttcggcacaaggtagttccgcggagtacctcaaatagagtttcttaacaaaactttaagacaatggatttcgacccaactagcatagatttttctagttttcctttattaaaagacacgaagctcccgtccttagtggaaaatctccactcgggagcaaggtcttttgtcatagcaaaactattcaaagaacttaaacgctctatcgtcgttattacgacaccggcaaaacttgatgatttattcgaagatttgaccactctattggcagaatcgcctcttgagttccctgcttcagaaatagatttatcccccaagctggtgaatgttgatgcggtgggaaaaagagaccatattctgtattctctgcaaaaacagagtgctccagttatctgtgtcacaacactgaaggctttattagaaagaactccttctccagaatctatgatccgagatcatctcgaacttcgagtaggagaagaactggatcccgataccctactcgatctttgtaaaagtttaggttatcgacatgaagctctagctagggaaaaaggagactttgcattccgaggagggattgttgatattttccccctatcttctccagaaccttttcgcattgaattctggggggatcgcgtttcctctattcgctcttacaacccttcggatcaactctctacaggaaagctgtctcaaattaccatttctcctgcgacggcaatcattcctacagacaaattatcttattcacttttggattattttaaagcgttcccgctttgtatctttgatgggctctcgtctcttgaagataatttttcggatattgcaggcatcttagcatctcttccgaaacgttttatgcccattcaggatctatgtcagcggattctcaaagaatttactcctctattttttgaagaaaaaacgttccccaatctcatttcgcataaggatacaggattttctatagaggcttttcataagaagatctctgtacaaagagtttctttaccttttatctatcctccggcactaatagaaactagtggcgagcaaaaccctttacttgcatttttaaagaccttccaggatttttgtgctgggcgtacgctctctttagctttgtattgttccaatacaaaatccttaaaagaagctcatgatctcgcagcagcctgtatcccaaacactcaaatttacgaccatcctacaactctctcctccagttttgcgttagtagaagctggatttgctgcagtttccctttcggaatttgcagcgagcaaagtcctccgtagacaaaaacaacggaactatttttctactacaacggaagaagtgtatattccagtcccaggagagactgtagtccatttacacaatggaattggaaaattcattggtatagagaaaaagcctaatcatctcaatattgaaacagattatctagttttagagtatgcagacaaagctcgcctctatgtcccttcagaccaagcttatctaatctcacgctatgttggtgcttcagaaaaagctcctgatttgcatcacttgaatggagcaaagtggcgacgatctcgggagctctcagaaaattctgtgattttgtatgcagaaaagctgattcaaatggaagctcagcgttctacagcgaattcttttatctatcccccgcacggagaagaggtaatcaaatttgccgaaagtttcccgtatgaagaaacgccagatcagcttaaagctatcgatcagatttatgcagatatgatgtctgataaattaatggatcggctgatttgtggagatgcagggttcgggaaaacagaaatcattatgcgggcagccgtaaaagctgtgtgtgatgggcacaagcaagtaatcgttatggtccctactacgatcttagcgaaccagcattttgaaactttttcccaacggatggctgggctgcccatcacaattggactattgtcccgcttttctcaagggaaaacgatgaaaaaaacattagaggatatagcccaaggacgtattgacattctcattggcactcataaagtcattaacaaagccatagaatttcataatccaggcctacttattattgatgaagaacaacgctttggagtgaaggccaaagattctctaaaagaacgcttccccacaatcgattgtcttactgtttctgcaactccaattccaagaactctgtatctctctttatctggagctcgagacctttctctcattacaatgcctcctttagatcgacttcccgtcagtacatttgtcatggagcattctgaagaaaccctatctgcagcaatacgccatgagcttttacgtggagggcaggtttacgttattcacaatcgcatcgaaagtattttccgtttaggagaaaccattcgaacattgattccggaagcgcgtattggcgtagctcatggacagatgcatgccgatgaactagcaagtatattttataaatttaaaactcaacaaaccaatgtgcttgtcgcaacggctttaattgaaaatggtatcgacattcctaatgcaaatacgatcttgatagaccacgcagataaattcggtatggctgatttgtatcaaatgaaaggccgtgttggacgatggaataagaaagcttattgttattntcttgtccctcatttagatcgcttatccggacctacttctaaacgcctagaagcattgaataaacaggagtacggtggcgggatgaaaatagctcttcatgatttggaaatccgcggagctggaaatattttaggtaccgaccaatccgggcatattagtgctgttgggtttaacctatattgcaaattactgaaaaaagctgtggctgccctgaagcataaacaaaaacccatgctcttccacgatgatataaaaattgagtttccttatcatgcgcgcatccctgaagactatatagatcttgcttctatgcgcatcgagttctatcaaaaaattggaaacgccgaatctgaagaggagctagaggctatagaagaagagctgcgggataggtttggaccttctccagaagctatttcctggttatttgctctagcacggattcggttaatcgcgcaggaatatcacctttccagtatcaaaggaacagggaatgcattatatatccagcagtatcatgataaagacaaacaaattcaaaaaacgttaccgtattctttatcaccgacaccggaacttttagtaaaagaagtccaagagtctgtagaaaaggctttccccaaataatagaggtagaggatgcctatgaccgggttttatgaaaccatctcccctcgagatcaacaacgtccgccaatatggttcctccgccaagtggggcgatatatacctcaatatcaagagctgaaaagaaaccgttctttgaaagatttttttttggatactgagtctattgtagaagcgacgctattagggccttctttattaggagtagatgccgctattgtctttgctgatattctctctattctagaagggttttctgtcgattatcgatttgctcctgggccagaggttagctattcccctcatgaacctcttattttcacaaaagatcctcaagaaacattctcatttctactggaagctatccagcaactaacgaaacgtctcacggtccctttgattgcctttgccgcttctccttttactctcgccagttatctaatagaggggggagcatctagagactaccctaaaacaattgcattcctctatcaatatcccgacagatttaaagctttattggatgaaatcactctagggaccgctacttatctccagatgcaggtgcaagctggagctgcagcgattcaattgtttgaatcttcgagtttacgactgcctcctcacctctttgcaaaatacgtagttgctcccaataccaagctaatccgtcaaatcaagcagacagggaatcctcctattagtctgttctgccgatgcttttaccaagaatttttgtctctatatgcgattggagcagataccttacatcccgattatcacgtagagctcccagaggtttaccgtcagatacatagtcccggatctatccaaggaaatttcgatcctgctcttttactacttccccaagacgcactgattgctcaccttgaagcttatcttgctcccttaaaacagcaatcgcattatattttcaatttagggcatggtatcttacctcaaacgccaatagaaaatgtacaggctgttgtatcatgtttaacatcaatttcaacttcctaaaagggctgcatcaaccagctcctcgctatacgagctaccccaccatcgtcgactgggaatcctcctcagattatggctatacggccttggagaggcttgctcaggagcaagatcctctttctttatacttccacatcccattctgccaatctatgtgtctatattgcggatgtactgttgttttaaatagaaaagcagaaatcgtagatcactacatagagacgttaatccaagaaatgcgcctagctttctcgttattaggagggaagaaaccagtctctagaattcactttggtggcgggactcctagtcgtttatcgcgtgctcaatttgaacgtttgttcactcatatccatcgtttttttgatttatccaatatcgaagaacttgccatagagttcgatcctcgaagtctcagagaggatgccgataaacctctattccttcataacctaggttttaatcgtgtgagtctgggtattcaggatacccaatgggaagttcaagaagctgttcgtagacgccaatcttacgaagaatcgctcttagcttatcaactattccgagacttaaaattcacaggtattaatattgacctcatttatggtctccctaaacaaacacagtctagttttaaacaaaccattgaacatatcttagatatgcggccagaccgcctagcccttttctccttcgctcatgtaccttgggctaagccgcatcaaaaggctttgcgcactaaagatctcccttccatggaagagaaattcgcgatttattcccaatctcggcataccctgatccaggaaggctaccaggctattggtctagatcatttttctcttccggatgatcctctaactatcgcccttaagaacaaaacgttgattcgtaatttccaaggtactctcttcctcctgaagaagatcttctaggttttggtatatcggcaaccagtttcattcgggggatctatttacaaaatgttaaggatcttcgtgaatattctgagactattcaggctagcaaactagcaactgtgaaaggcaagattctttctcaggatgataaaatccgcaaatgggtgattcataccctaatgtgttctttttcattgtctaaactggagttcgaacaacggtttcatgaacgctttgatcgatactttgcagatagctatgatcggctgtgcgggatggagagtgcaggattaattcggcaagactcctcttctttacaagtaactcctcttggagagctttttgtacgggtcattgccacagcctttgaccattattttttgaagaacatcgtagaaaaacctcttttttcgaagtctatatgaaacatgctctcattgttggctcaggtattgccggcctttctgccgcgtggtggctacacaaacgattccctcatgtgcagttgtctattctagaaaaagagtctcgatctggagggctaattgtcacagagaaacaacaagggttttccctcaatatgggccctaaaggttttgttttagctcatgatgggcaacacacccttcacctcattcagtctttaggcctagcagacgagctattatatagctctccagaggctaaaaaccgctttatccactataataataaaacccgaaaagtctcgccttggactattttcaaacaaaatctccctctctcttttgctaaggatttctttgcgcgtccttacaaacaagacagctccgtggaagccttctttaaaagacacagttcttccaagcttagaagaaatcttttaaatcccattagcattgctattcgtgcaggacatagtcatatattgtctgcacagatggcttacccagaattaacgcgaagagaagctcaaacaggatcgttgttacgtagttatctcaaagattttcctaaagagaaacgcacaggcccttatttagctaccttgcggtctgggatgggaatgctaacccaggctttgcatgataaattgcctgctacctggtatttttctgcacccgtcagcaaaatccgtcagttggcgaacgggaaaatttctctttcatctcctcaaggagaaataacgggagatatgctcatttatgctgggtccgtgcacgatctcccttcctgtctagaagagatccctgaaaccaagcttatcaagcaaacgacttcatcttgggatctctcttgtgtatctttaggatggcatgcatccctccctatccctcatggatatggcatgcttttcgctgatacgcctcccttattagggatcgtgtttaatacggaagtgttccctcaacccgagcggcctaatacaatagtctctcttcttttagaaggtcgatggcaccaagaagaagcgtatgctttctcactagcagctatttctgagtacctgcaaatttacactcctccccaagctttctcactattctctcctcgagagggacttccccaacaccatgttggatttatccaatcccgccaacgccttctatctaaacttcctcacaatataaaaattgtagggcagaattttgcaggtccaggtctcaaccgcgctacagcgtctgcttataaagctatagcttctttactaccatgaggcatctgctaatagttctctgcatagagaactcgtgaatgttaacatcttcccaatatattcctgtcttggtcgcgtttgaaagaaacgtttttcaatgtggctgattaataacgcatttctttgttcagttgcttgtatagcttcatacacatgagcaagccccgaaacccaacgcatctccaaagacacacggatgtgcggcggatctatcaactttacataaggatggtgcggagcatcccactcttcttggatcgcttcgaaaagagtatctgatttagacacattccctaaatataggtaggtttctgctaaatccattcgcattaaataatacaaaggagcccaagctttcatctcctttgctaacaaagaattttccgtaaaagtctctaaagcttttgttaaccaagcgatctttcgaattggatctccctcacctcttgcctgcaaataataaaccaaaggcaacaaaggcgagttcgggaataattctgggaattgtgttaaatactctaataattctgtatctccagaaagatattgctctaatgaatactgtaaaagatacagtcgatctccccaaggccgatcagatatgcctaacgaatatgccttcgatataggattttcactagtatgactaactgcccacaccatcctcaaagaggattgccataaagaggctcctgaagaaaaagcttctgctatttgctgtattgcgctagggtcctgctgcgacagagcagaaaaacactgcaaaatacttttctcaaataaagtctgattctgatgagcagacccccaagatacaaacgatccttcatatagagctctccataaagagagcttgcgtctcaccagaagatcttctgtttgaattaatgtttctgtcaaccgaagttgtatctctcgatccaactggtcgtacactagccgttgtataggagagcaagagagcttctctctatgntgacgactaatcatctcctttagcagtantccataaaactcttcttcagataaagnacgcgagcttcccaataccttaaaaaaagaagaaccttctttccctggctcaggtaagaaatttctatccatccattttaaaaattcctgatgtgaaaaggataaagacacctgttctctgacctgctgacataaaataggatctttttctaagactgccaatagatacaatcctataccggcatcctctctcccccaccccttgtaagctttaagaaagaattctttagcggaagcatagtgccctttgtaacaagctaaacaccctaaatactcataagtttccgctaaagacactcccagtcgatctgcataccgaattacagaagaaaaagcctcttctgcacgagagaaatcccgcaagtaaaaccagtacttgcctagaaagaagaggtattctggatatttcttatgggtctcaacaaagacggttttcccaaaatctaataagcgagatatttcttgtatttgagattttttaaaatattgttcgagaagcgaaaagtaagcatgttgagaataaatcgatgtgagatagtgtcctcctgatatgagaacctccagttcgtgttctccaagagtctcttcccatggaagtttacttaacgcatgtgcaaataaaattgcgtcgacttcttgtgatcggtctaagcttcctaattctatttttttgattaactgctccacagcctctgcgtaactctcttccgcactacaataggccaatagcaactctatagaggggctcccttgcagctccttctcttgttcccaccgtatggctaaggagattcgctttaagaaggcttgctccacctcatataccgttgaaagaggtgaacaaagccctgaagtcagattttcttgcaactcctcgcataaacgtaaagcgtcctgataatttttttgttctcttgcaaaaaggatctctgctttcttgttctcataactgctatgcagtgtcatattatataaagaaagtaggagatgatcttgcggtgaagaggagcatccgctactttccagtaaacggactaagtcctttaaagaagctccttgaggattgagtacctgccacacttgcttaatacgagcttttgactgcggaggcattacagctaaagaaaacagaggttttacaagctccgagcataactcttgttctccccgctttaaactccctcgtatatattcacaaattaaccatgttgctgtttcccaatctttctcagataaagatgagctgtcattcacgatacgacgaataaacgcatcaaaaataggcaaaagcggcttgccctcttgcatcgccttgcgaacgtctgcgcattggtgcccaaaagaaagtggcacgtcagctccgaagcatatcccccaacctatcagaaaccatgaacagcttccagagatgaatctataaatattcatatgaaaaaacacttgtttattcctcttcaaagaagactgcaaagacttctcatcatgagggcatcttaataatccattctgaaaagatctatgaagaatcttctaacaagagaacaagctcctttctttcttttctaaacaaggttcagcgctttctattaaaagaaaccctattcagaccctatgcagcacatagttttataaaaaatttttctattaacagaggaaaaataacctattgataaacagagcggtacaaggagatgtcaaataaagctgctttaggatccttacctagattctagaaaatggttgcatgaatttgaacaaacaaactaattaaaaattaaaactgaaaaaaatagtttaaaacaacaactagaggatattttttcatggcgctaaaagatacggcaaaaaaaatgactgacttgttggaaagtatccaacaaaatttgcttaaagcagaaaaaggaaataaagccgcagcacaaagagttcgtacagaatctatcaaattagaaaagaccgcgaaggtatatcgtaaagagtccattaaagcagaaaaaatgggcttaatgaaaaaaagcaaagccgctgctaaaaaagctaaagctgctgctaagaagcctgttcgcgctacaaaaacagtagctaaaaaagcttgtacaaaaagaacttgtgctactaaagcaaaggtcaaaccaacaaaaaaagccgcccctaaaacaaaagttaaaacagcgaaaaaaactcgctcaacaaaaaaataatattttagcgctttctcttttttatagagggcacttttatcaacagggccctctttccccttctcattgatcccttctcttttttttgttatcctttccgttctcgcaaaggcaagtccttgcaaataaaagtacaacctcacacctcctttggaggaaaaacctttcactttctttaggattcaagttgctctcctgttatcgtaactgtaaacattttggcgtctgtggaggctgttcatctcctcaaatggaatatgcatcctctttaaaaacaaaagagcttgcgctccataatttatttgcacctcttatcccatcccaaaatattctccctgtaattccttgttctcctcttcttcgcggaagaaataaaatggaattttctttttaccaaacggttgatggagaaaaaactttaggttttatttctccatcaaaacctaaaaaaggaatcccaattaccgaatgtttaatgattgatgagcgtgccatggatatccttaatatcactcgctcgtggtggactgcccatcctgacctgtctgcgtactatccaccattaaataaaggctccttgtgcactattacagtccgggtaggcaatatctctaatgattttatgattattctgactacatcaggaagagaagaattcgctgtacctctgaatataatccaagaatggcaacaatctttattagattctggactaccgattacttcgattttctgggaagaaaaactctccgcacggaactctcccacaacctttcggacaactcatctatacggagctcctttcctcaaacaacaattatcgatagatggccgttctagtctcttccatatccgtccaagaagctttttccagccacaaagcctccaagcagaaaaaatcattcaaactatcaaagaattcattgatccttgcggagaagagactctcttagatctgtattgcggagctgggactatcggcattttactggctccttacgtaaaaaaaattattggagtcgaactagtcccggatgctgttgcttcagcacaagaaaatattcagcttaattccgtggatatggaagtgtttttggaagatgcaaaacaattttgcaaacggaatgaaaaccttccttccccagatattgtagtcatcgatcctcctcgttgcggcatgcaaaataaagccttaaaataccttttacgcatggctcctaaaaaaattgtgtatgtctcctgcaatcctcttacacaaatccaagaatgctctgttcttgtagagcaaggatatcagctacggcacatgcagcctattgatcagtttccgcatactaatcatttggaaaatattgtgctcttagaaaggctttcttaaaacaagaaagccttattcctaatgctgttccttctggaaaaggattgatccccctatcttcctgtgttaacctatcctttttaaccctaataaaaggcacctcgatgtactcgcgtctgttttttagtatcctgntctttttaggatgttgcccagctctatttgctgatacggattctcctcaacgcgcaacgtttggacaacctgcagtcatgttaggaattgctatcgtctttttctattttatcttgtggcgtccagaacaaaancgtcgtcaagctatggaaaaaagaaaaagcgagttagctgttggagataaagtaactgctatgggaatcgttggcaccattgcggaaatccgagaacanacagtcattctcaacattgcctcggggaaaattgaaattcttaaaactgctatttcagaaattcttaaagctgagaaataaaaacgagctcctttcagcaaagcccaggtccttgggctttgcttccttgtaataaaactttaaaaaactccgttgattttttatagagtaacctataacttgacgctacagtctcgttgaaattccagggatttttataattatgacttggctttcaggcctgtactctatctttgtcgcttctgcagcattttgttctttagaccttattcttgtcgccgttatcctgctttccaggaaattccttattaaagtgcatccttgtaagctaaaaatcaataatgatgattccctcactaagactgtagacagcgggaaaacattgctatcttccttattagatttcaggaatcgctatcccttctccttgtggagggaaagctgcttgtaagcaatgcaaagtccgcattacaaagaatgctgatgaaccattagaaacagatcgttctaccttttctaagcagcaattagaacaaggatggagactttcctgccaaacgaaagtacaacacgatctctgcttagaagtagaagaccgttatttcaatgcttcttcttgggagggtactgttgtatcaaacgagaatgttgctacctttatcaaagaacttgttctttctgtagatccttcgcgccctattccttttaaacctggaggctatctacaaattaccgttcctccttataaaaccaatactttcggactggaagcagactatggatccccaatactatagtgattgggagactttccatctattcgaccaagttattgataatctatctttagataccgactctgcgaataaagcgtattccctagcttcttatccagcagaacttcctttgatcaaattcaatgtccggatcgcgaccccttcttttgtggatcaagctcccgacccgaccatcccttggggagtctgctcttcgtatatattctctctgaaacccggtgataaggtaatggtatccgggccttatggggagtctttcatgaaagagaacaaccgtcctgttatcttcctaataggaggtgctggatcttcttttggaagaagccatattcttgatttactgttgaataaacattctgacagagaactgactttgtggtatggagcacgttctcttaaagaaaatatctaccaagaagagtatgagaagttagagaaagaattccccaacttccactatcacttggttctctctcagcctttacaggaagatttagaccaaggatgggataagaatgatcctataaaaaccaatttcttgtttaaagctttcgaacttggacaactgagtcatctccccaatccagaagattatctatattacgtttgcggtcctgctctgcataatagtagcatcttaaccgtgttagataattatggtgtgagcgctcttctattgttttagatgatttcggaagttaacctgctacaagggtgctaactttcttccatcactccaagaagagcctctaacaacagttcttcatagcttctaatttctttctcatgcgttaattaataagcccttgctatcagcatacagactgtggcaaggctttcaaaaagagctaaacttcttgttaatgacaaactttctcgattctcttgcatgtatagtcatctgcagcctacatacatgcttttgatctttccagcaggcctctgttttgaaattccgttatgatcccaggatccctctgtccattctaaggagcatggtattctaaagtcttaaaagggtagaaaaagagaaatatttgataaactgaaaatgctctaaaggataaggaagaagatagtagagaattagagataatttgactaggattacagcaagaagaagagagaaggtattttagagaaaagaaaagggggtagctgcgttagggctacccccttctcctttttagtctatgactaagatcttatataataaaatgcttggcgacgacctactctcccatactctcgtgtatagtaccatcagcgatcagaggcttaacttctgagttcggaatggtgtcaggtgtttccctctctctattatcaccaagctaatcctggtatcgtttctcacgtatactaatagacgcttaaaagcttgtcttctacgcacttgcactctctactctttttcttattgtctttgcctttcggctcttccaatcataaaaagaccaagtctttggacttattagtattggttagctgaacacattactgtgcttacacctccaacctatcaaccacgtagtctacatggagtctcattgggataccttatcttgagggaggcttggcatttagatgctttcaatgcttatcctttccgaacgtagctactcggctatgctcttggcaaaacaaccgatacaccattggttcgtccattccggtcctctcgtactaggaacagctcctctcaagtatcctgcgcccacgaaggatagagaccaaacttctcacgacgttttgaacccagctcgcgtacgctttaattggcgaacagccaaacccttgggaccttctccagccccaggatgcgatgagccgacatcgaggtgccaaaccgccacgtcgatatgaactcttggtggcgatcagcctgttatccccggagtaccttttatccgttaagcgacggcgattccactttccaccgccggatcactaagcccgactttcgtctctgctcgacttgttggtcttgcagtcaacctatcttatacctttacgctctactcgtgattgccaaccacgatgaaataagctttgggctcctccgttactttttaggaggataccgccccagtaaaactgcccgtctggcaatgtccatcttccagattcatggaataatgttagattcccagcttgttaagaccagtatttcaacgttgactcccactctcctgaagaagagtgttcttagtctcctggctatcctacacataacaaaccaaaaaccaataccaaagtacagtaaaggttcacggggtcttttcgtcctttcgcgggtaaacagcatcttcactgctactacaatttcaccgagtctttcgttgagacagtgcccaggatcgttacaccattcgtgcaggtcggaacttacccgacaaggaatttcgctaccttagcaccgttatagttacggcggccattcaccagggcttaggttcaatgcttcgctttacagctgacatatccctttaaccttttggcattgggcaggcgtcacaccatatacttccccttagaggtttgcatagtgctgtgtttttgctaaacagtcgcctgggccatttctctgcggccccccggggctcctatcgttccatagtcaccctaaaaggctccccttattccgaagttacggggataatttgccgagttccttaacgaaagttatctcgcgcgccttagaatattcatctcgcccacctgtgtcggttttggtacggtcaccatcaacagctagaaattatttcttgaaagcctcgctccacaccatcggttcctccgaagattccccttgatcgcgacctgatcttatgttagcggatttgcctactaaccgttctcatcgctctacggactcttccaatcgtccgcgtgcttaacttactccgtcattccttcgctatagttttaggtggtgcaggaatatttaacctgctgctccatcgtctacgcagttacgcctcaacttaggggccgactaacccagggaagacgagcttgaccctggaaaccttgggcttacggcgagggagattttcactccctttatcgttacttatgccatggatcttcactagtatccgctccagccctccttccggtacaccttctctgctgaatactacgctctcctaccgcgtgtcttatcgacacacccgcgatgtcggttttatgcttagtcccgtttattatcggcgcaatgattctcgattggtgagctgttacgcactctttaaatgattgctgcctctaagccaacattccaactgtcttcgaatcatcacttccttacccacttagcataaaattagggaccttaatcggcggtctgggctgttcccctctcgacaacgaagcttagcccccgctgtctatctcccggactcgcttctggtattcggagtttgatttccgttggtaagccggtaggcccccgctagaattcagtgctctacccccaaaagcttattatccgaggctaaccctaaagttatttcggagagaacaagatatctccaagtttgattggcctttcacccctattcacaactcatccaaacctttttcaacaggtactagttcggtcctccacatagttttacccatgcttcaacctggtcataaatagctcacttggtttcgtgtctaaaccaaacgactcttcgctcttttaaaactcgctttcgctccggctccggaatgtatatcccttaacctcgccgtttagcttaactccctggctcatcatgcaaaaggcacgccgtcaaccttgacccttacgggccattggtctccgaccgcttgtaagctactggtttcaggttctatttcactcccttaacaagggttcttttcgcctttccttcacagtactggttcactatcggtcattgactagtatttagccttggagagtggtctccccagattcagactaggtttcacgtgtctagtcctactcaggtgttgaggtcggtctttctctcctttcgtctacgggactatcaccctgtatcatccatctttccagatgtgttcaactaggagtcctgatcctttatcctcaatcctacaaccccgagccttatcagctcggtttaggctattcccctttcgctcgccgctacacagggaatctcttcgatttcttttcctctgcttactaagatgtttcagttcggcaggtgtcgctttgcatacctatgtattcagcatgcaatggtagtctattactctaccgggtttccccattcggatacctccgggtctttgcttatcaccagctcgccggagcttttcgcaggtattcgcgtccttcttcgcctgtcaatgccaaggcatccaccaatagctcttattaacttggtctgtaatttctatagatccatgcaagcacttcacctaaaagacaaatactcttaaacgtctattattatgcgtgaaatatacttgttaccatgattatttctttacaataacatacttgatcacaaactatatgtctcgtcctcaccacgctactcttaacaacacaaatgaaatagaatgcttgctcttacatataaatgcttgcccaacctagtcagaaaccttctcaggcttcttccttatccttaaaaggaggtgatccagccccaccttccggtagggctaccttgttacgacttcatcctgantcatcagcctcaccttgggcgcctctctcccttgcgggttgagtcaacggacttaaggtaaaaccaactcccatgatgtgacgggcggtgtgtacaaggcccgggaacgtattcacggcgttatggctgacacgccattactagcaattccgacttcatgtagtcgagttgcagactacaatccgaactggggccagctttgaggatttgctccatctcacgatcttgctaccttctgtactggccattgtagcacgtgtgtcgccctgggcataagggccatgctgacttgacgtcatcctcgccttcctcctggttaacccaggcagtctcgttagagttcccaccctaagtgctggcaactaacgataagggttgcgctcgttgcgggacttaacccaacacctcacggcacgagctgacgacagccatgcagcacctgtgtatatgtccttgcggaaaacgacatttctgccgcggtcatatacatgtcaaacccaggtaaggtccttcgcgttgcatcgaattaaaccacatgctccactgcttgtgcgggcccccgtcaattcttttgagtttcacccttgcgagtgtactcctcaggcggcatacttaacgcgttagctccgacacggatggggttgagaccatccacatcaagtatgcatcgtttacggcaaggactaccagggtatctaatcctgtttgctccccttgctttcgcgccttagcgtcaggtataaattagaaaagcgccttcgccactggtgttcttccacatatctacgcatttcaccgctacacgtgaaattcccttttctccatctaccctctagaaaaatagtattagatgccgactcggggttgagccccgatctttgacaactaacttacctttccgcctacacgccctttacgcccaataaatccgattaacgctagcaccctccgtattaccgcagctgctggcacggagttagccggtgcttctttacctggtacgctcaaatccagcgggtattaaccgccttctcttattcccaagcgaaagtgctttacaaccctagagccttcatcacacacgcggcgtcgcttcgtcagacttccgtccattgcgaaagattctccgactgcagcctcccgtaggagtctgggcagtgtctcagtcccagtgttggcggccaatctctcaatccgcctagacgtcatagccttggtaggcctttaccccaccaactagctgatatcacatagactctcccttaaccgaaaggtcctaagatccccttctttaacgttactcggatgcccaaatatcgccacattcggtattagcggccgtttccaaccgttattcccaagttaaggacaaattatctatgcattactaacccttccgccactaaacaattgccgaaacaattgctccgttcgacttgcatgcctcatccacgccgccagcgtcaaatcgaaacaaaaacaaaattctaaaaaaaaaaaaaacttgaattaataaacgggttcctaaacccctaaaaaaaccccaaaaacaatcaaaacggcccgcaatccaatccaattggaatggtaaaaaaaagctccaaccctccaagcctccaacccggtcgccccctccaaccaacgaaaaagccctccctcaaaccttcgttcaaaaaaaagcaaaacctaaggcaacccccaatttttaagcaaccaatttttaacaaatccccaaaaaaacctttttcttaacctctcaatttatcccctcacacaatatcctcaaccctttttataaaacaaaattttcctctctttttttcttttttttgctcatcctacccttcctctcttcgatttttttgtcgaaattctttttttttgcatcttcgcttcctttttcaaaaacaccgctttagattttattcaccttgatcttccataaaaacaatctcttcattatacttctctttccccaacgtagagcgcctgcacgctctgctagttggggagtttcaccatggcgaacgtagctcagttggttagagcgtcggattgtggttccgaagtcgcgggttcgaaccccgtcgttcgcccttctttatagtttcctaaaaagactacttcgattcttttatttttcctgttataacaagctacacatgtgcgttggagtgctaggatcgttgagagcttccgcaatgataggctaacacctccatataagcgctatttctgttaagagtccttatcagttagataagagagaggaactatgggaaaagaacggaagaaagcaagcgtttctcttttctccacaaaacagtctttgctgttaaaacatgcgtgttatctagccctagcctgtttctctggattaagtctatggagtttccaacataatcaaccttacacacaaaactggataggtttactcggctggtctctcagctccttcttgctatataactttggtgtcgctgcctttttaatccccctaaattttggatggctttcttttctaaatatgaagagaaccccagctcctttagcttttagaaaagcagcagcttttggcgcaattccggtttgttgcgcagtattattgtctatgatttctccagctcaaaaccttccacagtttttagctacaagagtgcccatggttgtcatggatcttcaacctcctaaagcgtacctagggggcattccgttttacttactgtacgatggaaattctttttctttaaaactgttaattggtgcagtgggaacaggattaatctttctggccatattgctatgcgcgatcttttatcttatccctaaatcttttgtgttaaaaaaaaaagctctcctagacgatctcctaaaatttctcaaaaacaaattttacgcatgttggaacgcctgcaaaaagcttttaaaaaatcttgttaacaataagtcttatgtccccgaaccctctcttcgcgttccatcttcgccttctgttgctaaaaaggaaatgctcaaacttccaaccccggtgatttcgcttcctctggaaaataaagatctacacgatgactcctctgtgaaccgcaccatttttctcaccccaccgcatccgacaaaaagaacattatcgcctcaaaaaagaactgatcttcctaatcttttgccgaaagactcggcttcagctcctgcacaaacatcttacaagcctttacctaccccatccccatttgtactagcaggagacgccccggacttaccacaataccatctcttgagtaagcggaatgtgcgccgcccagaatctctcttggaagaattaaaaaagaaagctgctattttacagcaaacattggctagctttggaatagaagctgctattgggaacatttgttcgggccccacccttgccgcctttgaagtcctccccaacactggagtcaaagtacaaaaaatcaaagctttagaaaatgatattgcattgaacttgcaagcttctagcatccgcatcatcgcccctatccctgggaaagctgcggtaggaattgaaatccccaatccagatcctcagcccgttaacttccgagatttattagaagattaccaaaaaggaacacaacgactccaagttcctcttcttctcgggagaaaagctaatggcgataacttttggacagatttggcaaccatgccccatttaattattgcaggaaccactggatctgggaaatctgtctgcattaacacgattgttatgtctcttattatgacttctccccctacagacataaaactcgtaatcgtggatcctaagaaagtagagttaacaggatactcgcaactccctcatatgctaactcctgttatcacagaatctaaagaagcccatagcgctttaatttggcttgttcgagaaatggaactacgttatgaaattcttcgatttttagggctacgaaacatccaatcctttaattctcgaactcgcaatgtggatatcgaagcttcgtacgataaagagatcccagaaaaaatgccgtttattgttggcatcattgacgagctttctgatttacttctttcttcctctcatgatatcgaaacgcctattgtacgcttagctcagatggctagagctgtaggaatccacctaatcttagcaacacaacgcccttctcgagatgtgatcacaggaataatcaaagcaaattcccttctcgaatcgcctttaaagttgccaacaaagtgaatagccaaattatcattgatgagcccggagccgaaaacttgatggggaatggggatatgctagtagtttctccaggatcttttgcgcctgttcgtgttcaaggcgcctatatttgcgatgacgacatcaacaaagtcattaaagatttatgttcaagattcccatgcaaatatgtgatcccttcttttaatacctatgacgatccaggttctatggatcctgaagatttagatccattatttaaccaagctaaaactcttgttttacagacaggaaatgcctcgacaactttcctccaaagaaaactcaaaattggttacgctagagcggctagcatcattgaccagttagaggaagctagaatcgtggggccctcagagggagctaaaccgcgtcaaatactagtccaattatcaaatcaggacgattaatccatggaaggtttttgccctatagcctctggttccaaagggaactgtgcttatttaggaacaaggtcatgtaaattactaatagatcttgggattagtaaacaagccgttaccgaggccttacattctatgggcattcaccctgaagatattcaagggatttttgttacccatgaacactcggatcacattgcagggcttcgtagttttattaaaacctatagaacccccattatatgtaacatagaaacagcgcgcagcttacggcaacttttagatctgtgtccgacatttaaaatctttacaactgggcatcgtttttctttagaagatctccgcgtgcaaacgtttaatgttccgcatgatgcagtggatcccgtagggtttatctttcaatattctggtatgaaactcggtttttgcacggatttaggatgggtcacctcttggattacacaccttctctgtgattgcgactacctactcatagaatccaaccatgatccggaaatggttctccgatcctcacgaccagagagctgcaaacaacgcattctcagcaagcaaggccatatctcgaatgcggagtgcggcgctctacttcaacgcgttctcactcctcgaatcaaaaagatttatcttgcacatctttctctcgaatgtaatacggcagagcaagctttgaatacagtgacgtctgccattcaagagatcacagatgttcatcccgtaattgctcaaagttctggcattacagatcctattttcttttctgctccgagccttgtatgaccactaactctactcaagacactttgtatctctcgttacacggagggattgactcagccattccctatcccgtacgaagggttgaacaacttttgcagttctcatttcttcctgaattacaattccaaaatgctgcggtcaaacaacgcattcaacgattatgttatcgagaagaaaaacgtttagccgtttcctctctagccaaatggctagggcagctccataagcaacatctccgcgctccaaaaaatcctccagtggccatctgttggattaattcctatgtaggatatggagtctttgctcgtgaatccatcccggcatggagctacatcggagaatatacagggattttgcgtcgaagacaggctctttggctagatgaaaacgattactgtttccgctacccggtcccccgctattcgttccgctatttcactattgatagcgggatgcaaggaaatgtgactcggtttattaatcacagtgacaaccctaatctagaagcgatcggggcctttgaaaacgggatattccatattatcattcgggcaatcaaagacattcttcctggggaagagctctgctatcactatggtccgttgtattggaagcaccgtaaaaagcgagaggaattcgttccccaagaagaataatctctgatttagtctttttcatatgtgcccatcagctctgccgtagctatgatatgtccgtccatagcttctaacagctgttctttggtcactccttcttcatcggaaagcacaacatcgagcgcataagcataaaagtaatagcgatgcttcgcatctggagggcaaggagggcagtatcctatttctccagcagtatttaacccttggacagcaaaaatttgtgctccttctgcaagattagagactacaggcgaaagattatacactatccagtgtatccacaacccatcctctcgaacactaggaggaacatctggatcttcaacaataagaacaagacttttagcctctctagggacatcagaaaaagacagcggtggggagatcccaacgccctgacacgaatactttttaggaatcggacggccgtaagaaaaagcttgtgaggtgagttgcataattgaggtctcctgtatttagggccatgctctgtaaagcgtggccctattcttgtactactgtcgtagtggatcagactgggcttgcgcttctttacggagaagggctacctcataccgagtggcaattacttctctgaacaaggcgatcaaactgatggaattaaaaataaccatcccgcaaaaacctagatcggatagcgcccagataaactgcattcctaagacaccacccatggggattatcgcgatataaatagccttcaacaataggttagcgcgcttccctgggatcatatattctaaacttttttctgcgcaagcaaaccatgacagagctgtagtatacccaaacaagatcatggatataagaacaacacttccgcccaacatgcctaacgaagatttgaaagcattcataaccatcaaaacccctaactctccagaatcataggctcctgtcacaagaagcaccatcatcgtaatagagcatacgaccgcaacgataacgggaggtaagagagtgactaatccgtctgtcacaggattcgtgcttttagaattagattgcagaatagaaaccattccgcttccaccgtctgtagccataatagcacgatttaatcctgtagagattacctgtcctaatgtatagcccccaaccccggctatcccagccttgacacctaaagcagaagagaaaacgagctgcaaagcaggaagaattttatcacaatgcatagccaaaactataacggagaaaaggaaatagaatcctgctacgaaaggaatcgctttagcagagaagcggagaactcgagtatttccgccagctaaaatagggtaaacagagagcgcgagcagtatccctactgcgatcttcgctgagaccccatcagcacaaagagagataatgctgttaacctgaactaaactccctgcagaaaatgctgtgatcaagctagcgacacanaaggcaacagccangaatcggctgcccattttatatcctaggcaagctatcggtcctccgatatactcctgggattccttttggaactggcggtacttacatccaaggaaagcgcctgcatactggactattgcagcaaaaagagtgacgatccatatccaaagtaatgccccagggcctccactagcgacagcaatcgccatccctgcaatattccctgtaccaaagttccctgctaacatacctgctacagcttcatagcgcgagaccccctctccttctgcaccagcttgttcctgttgattattcagcatcaagcgaaagctcattcctaaagaagtaaactgtagccctcgtaatttccaagttagtatccctcccaaacaaagaatcaaagggaatacacaaaaagaagttaaaaagtgattgatttgctttaaaaactgtaacattgtcctactactcttatgctttcacccgcttcggaggcaaataagcggaaaatacaaaagccccctttctcctatccgggggaagggggcctttagaatggcctttatatagcagggttctgaatcacgacatcgatcagctcagcccacctttccccatcaacaattgaggtaacggtccccgagtctaatcctaaggtcgacgcgaacgcggcaaacgtctgcaacgctgaaagccctaaagatgctgcttgagaaaaaactttgcttaattctgtgataaagatattccagacccaatcccgtccttgcatctttttcattccagcaattaaagcaggatcttctgcaagagcttgtaacaaatgcaagaggatggatctctctaatacgcgataatgcgcctttaatttccccctgagccatagccaaagcaatagaagacttatcagcagcagcagacactacgaaagaaaggtcttttctttcggaatctgtcattggatctgcgtaagacttaaagttcggcaacacaggctctgtcttctctttaggtttcttgcgcgagaaaaattttctcaagtaacaagaagatttctttttacagccggcatccggcttctcgcgaagtataacagattcttcttttatctcggctgtattttttgcaagagtcgatccataagagttggcgcaacagctgctcaatccggagagcccggagagcaacaagagagctccaaagctatacttatagataaactttttcataaacctgccaaaattaaaaataaatttgtagtattatagcacaaatcttattaactaaatagtttataaaggcgcttcaacatcccaatcaaattaaaatcttaacaatccctctctatcctctctgggtaggaatgaaaagatctttgcaagaaccttgcccctaacaaaaaatcatgttagcatgaagccggtagaatctctcggggaatccagagaactacagggtgtttgcttcttgaatacactctatgcaacgccctttttataggcttgccaccggctattgatatcaaccacacaactccccgttaagctctttacaagttacccctctaatccgtattaagaaggggatgaagcccgggagtagcagaggatcatatgttaataaactttacctttcgcaactgtcttttgttccttgtcacactgtctagtgtccctgttttctcagcacctcaacctcgcggaacgttcctagctcgaccacaaaaattggatcagaagtttggattgaacaaaaagtccgccaatatccagagcttttatggttagtagagccgtcctctacgggagcctctttaaaatctccttcaggagccatcttttctccaacattattccaaaaaaaggtccctgctttcgatatcgcagtgcgcagtttgattcacttacatttattaatccagggttcccgccaagcctatgctcaactgatccaactacagaccagcgaatcccctctaacatttaagcaattccttgcattgcataagcaattaactctatttttaaattcccctaaggaattttatgactctgttaaagtgttagagacagctatcgtcttacgtcacttaggctgttcaactaaggctgttgctgcgtttaaaccttatttctcagaaatgcaaagagagactttttacactaaggctctgcatgtactacacaccttcccagagctaagcccatcatttgctcgcctctctccggagcagaaaactctcttcttctccttgagaaaattggcgaattacgatgagttactctcgctgacgaacaccccaagttttcagcttctgtctgctgggcgctcgcaacgagctcttttagctctggacttgtacctctatgctttggattcctgtggagaacaggggatgtcctctcaattccacacaaacttcgcacctctacagtccatgttgcaacaatacgctactgtagaagaggccttttctcgttattttacttaccgagctaatcgattaggatttgatggctcttctcgatccgagatggctttagtaagaatggccaccttgatgaacttgtctccttccgaagctgcgattttaaccacaagcttcaaaacccttcctacagaagaagcggatactttggtcaatagtttctataccaataagggcgattcgttggctctttctctgcgagggttgcctacacttgtatccgaactgacgcgaactgcccgtggcaataccaatgcagaagctcgatctcagcaaatttatgcaactaccctatcgctagtagcaaagagtctgaaagcgcataaagaaatgctaaacaagcaaattctttctaaggaaattgttttagatttctcagaaactgcagcttcttgccaaggattggatatcttttccgagaatgtcgctgttcaaattcacttaaatggaaccgttagtatccatttataatcaaaaaaaacgcctgatttgatcaggcgttcttctttttctacaccgttttattccttccctatcagagagaataatgatgccatttctaaagctgttttcatgcctgaagcgcctaaattgggccctttgatacccgcgcgctcccaagccgcttccatattaggagcagtaatcacggaaaatgtaataggaagacagaagtctaaggataggcgactaacacctgcagccacactatctgctatatgttcataatgcgatgtctcgccctgaatcaacactccgcaagcaactacagcatgaaactgtcctgaggtggaaagtaatttcttaatcgcacaaggaatctatcacgccccagggactcggacaattgttaaagaagaaggatctcctccgaaatcgaaaaaagtttcttgcgccccagcaacaagcctatcagcgataggagaattgaaacatgacccaacaatagctacacgcacatccttagcgacaggacatcctttcaacggtttcatactcctcctccacatcatccagaacgggcagatctaaccaatgccccatgcgttccttttttgttcgcaaatacccctcattttcggtagaaatactgacgggcaaaataattcggtcaagaacgtgtattcctaaccgctgtaactcaaaaaattttcttggattatgggtgatcagtctcacgcttgtcaactgaaggtctttaagaacctgagcagccatgccatattcacgagcatctatagggaaccctaattgaagattcgcatcaacagtatcataacctaaatcttgaagcgcatatgcgcggatcttatgtccaaaaccgataccgcgcccctcttggcctcgaagatacacaataactcccagcccctcttctgctatgtaccgcatcgccatatctagctgtgctccacaatcacaacgacaagaccccagaatatccccagtcagacattccgaatgcacacgcactggaacagcttcttgttcatggatatctcctttaactaatgcaaaatgctgggtcccatcgatgattgactcataaacatagattgaaaaatctccgtatttcgtaggtaatcgcgccgatgagattttagtaacgagggaatcataggtatatcgataagtaatcaaatcatctacagtaataacagttaaatcatgttgctcagcaaaagcgagtacctgctgctgtcgcatcatagagtggtctggattgactaactcagcaaaaataccacacggctgcatacctgcaagccgcatgagatccatagcagcttcggtgtgcccaggacgttgaactacaccgccaggttgactgatcaaagggaaaacatgccctggtcgaacaaaggactcgctgtcgctgccggatcagctaacaattgcacagttctggtgcgatcactcgcagacacacctgtagtcactcctgaagaagcatctacggaaacggtaaaagcggttttaaacgcacattggttgtcttgaaccatggctggcaagtccaaagattttgcctgctctcgagagagcgaggcacagacaatacctgtcgtgtgggataaaagaaaactcattttctctgtagagactttttctccggcaaggattaagtctccttcgttttctcgagatgctgcatcaataactatgacaaatttcccttcagcgacatcttttatcgcttgctgtaccgacgctatcccagcttcatatgtaaacattctcaatctaccccgtttttgaggaaaacttagccagtgggaaacgttctttgtctataatcccctcgctgtggcagagtataacacaaacctctactttctgcgaccctaacccttcttatctacactctcttgctccaaacattcaaaacatgtctttacagaatccctaactaaagaagtttctgtaatccttacatgttctgctgtaaccagacttagctgaagatctcgcaacataggttgcccttgatcacccaaaaacttcggcccccaataaatgacccctgcattgacgagcttctgttgccagaaagcggagtgtagctgcgcgccaccctcaacaagcacctgtaaacaccctctctctgccagatagcgcaaaagccctttgagatcgacctgatgagaagaagattcccatacttctactcctaaatctttcaatttttgaatatattctttagggcactgttgagtcgtagcaaatagcgtactccctgagctgagatcgaataccctagattctaatgggactgttccgcgactatctaccactactcttaatggctgtctttcatataaatccccatgagggaaccgtgccgacaaacgcggattatctaaacaaacggtacgagccccaacaattatagcctgagactctgcacgaagtttccctacatccgcccgagctaattctcctgaaatccattgcgatgatcctcctcgatctgcggtctgaccatctagcgaagctgctgttttcatcactacccatggcaatccccgctctcgttgatacagataaggttgcaaagaagttttggcctcctgactccctaccccaacataaacgggaatccctgctgcttgcaaacgggtacgccttttttacaaacacgcggatccggatctagtaagccaacataaactgcagcaaccttacttttaattaaaagatccacgcaaggtggcgtcctaccgaaatgacaacatggttctagggtgacatacacctcagctccttctaaagaacatttttgatcttgaactgcgcacacctctgcatgaggagaaccgattccttgatgccaaccttcacctatcacacaaccattctttacaatcacacatcccacccaaggattgggtggagcaaaaatccttcccttttctcctaaggcaacggctttgcgcataaaaaacagttgttgctcagacaaaacttccatatactcaacctgaaaaatcagatagcgaaagagatgcaaggatgttggatatacgattaatacgcaaggaaccaaaagagtgcgaaagccgtcttcaaaaaaaagatnccngntatttctttagaacgcctcctagacttggataaaactgtgcgtcagttaaaggcggattcagaagctctgcttgcaaagcgtaaggtattatctggtcagattcataaagctaaagttgctaacgaaaatgctgacgccttgattcaagaagtgaatactattgcagatcaactcgttgcatttgaaacaactttgcaagaacaggaagcacttctagaagatctcatggcgagactgcctaattatccagatgaagatgttccagtttctcctgataaaacaggaaaccaaatgattaaaagccacggtgaggtacctacttttcctttccctcccaaacaccatatgcaacttaatgaagcgttgcaaattttagactttaaactccctgccaaaactacagggtctggctggccggcttattgtaatgaaggagttcttctagaatgggctctgcttacttatcttctgaataaacagcaagcacatggctttcaattgtggctccctcccttacttgttaaacgagatattctcttcggttcaggacaaattcctaagttcgatggacagtattaccgtgttgaggatggagatcggtctcttttccttatcccgacagcagaagtcgtcctcaatggattccattctcaagaaattctaaatgagcaagatctccctctctgttatgctgcatttactccctgcttccgcagagaggctggcgctggaggagctcacgaacgaggacttgtgcgagtccatcagttccacaaagtagaaatgtttgctttcactactccggaacaagaagaagttgtctatcaaaaaatgcttcatgttgtggaagaaattctgtctgaactgcaactcccctatcagctttccttactttccacaggagacatgtcattcactgctaagaaaacgatcgatgcagaagtgtggctcccaggacaaaaagcgttctatgaagtctcctctatttctaaatgcggagattttcaagctcgacgatccgaaacacgctatcgagatgctcaaggtaaattgcacttcgttaacactctaaacggctctggattggcaacgccaagattgttggtcgctattttagaaaattatcagcaagcggatggctctgtcgtcattccttctgttcttcgcccctatatgaataaccaagagattctcctacccaaaacggtaagataaccttatagtgagatagaaagctagaggagcggcacgatggcatcagaatacgagcacttcggtaacttatctccggaggatcatgtcaaagaagttcaagatttgcataaagtctgcaaaggagagcctcatcagacaaaaaaaggttattggtatcacctgacttgtgatgctattgattgtggtgttgttctattttttattcgcaccatcttctttctagtccctgcaatcccagtaacctcttatggaaaaatcctattcgcaactgggatcagttggattttttataccagctgtaagcgaagctcaagcagcatgggcctacatagaactgacgcatagaaatatgttacaggaaaagaaagagatcgagacaaacccagaacaagaacgcatagaattagcggtgctttatgcaaatcaaggatttcaggagccgctgatctcacaaatgctcgattttgtgtgttccgactcctctcttctcttaagtacgatgctccgagaagagttgcatattcaattagaagattatcctcatcccctcaagcaaggaaacgttaaagcgcttggcgggattcttggattactcctatttgccccaattacacttgctgtaagctatacaatcgcagcgattttagcttccttcatgataggcgttttattcgctgtgaaaacgcgcctgataaaaaacgcgatcacccctgccattgtctggggagtagggatgtttattactgcaattagcctctgctgctctttgatccgattattttagttcatactcttagtaggtggcctatgtctccgcaacttttttcctctccattttctcgagaattactcagcgatttttttgaatcagggatggcggaagagaatagccctctgctctctcaaaaaaaccgtcgtttaagccaaaatttaaccttaaaatctgcctatatctccttggctttatacttaggatcgcttctttctcattggataggatatcaggctctctcctctttacttctcattcttacttttttcttagcgggaactcccgctctcattaaatcctttgaagatattctggatagaaccgtaaacattgatattctcatgacatcggcagcctttggttctatcttcattggaggggctttggaaggagctttgctcttggtcctctttgccatctcggaatccttaggagcgatggtctccggaaaggctaaaagtactctcgcttccttaaaacatttagcacccactgtagcttgggtcgttcagcaagacggatccctgcaaaaagttttagtgcaaaacgtcaaaattggagaaattatccgagtaaaaagtggagaggttgttcctttagatgggaaaattattcacggagcctcttctattaatctcatgcatctaactggagaaaagatccctaaatcttgtggcattggggatactattcctgcaggggctcataacttagaagggagctttgatctccaggtcctccgcatcggtgcagaatccacgattgctcacatcatcaatctggttgttcaagcgcaaagctccaaacctaaattacaacaacgtttggaccgctattcatcaacatatgctctaaccatcttcgctatctcagcatgtatagctataggaggctctctattcacaacactgcctttcctcggaccagacggtgccttttaccgcgctctagcatttttaattgcagcttctccctgtgctcttatcatagctattccaattgcttatcttagcgctattaatgcttgtgctaaacatggtgtcttgcttaagggcggcgtagtcttagatcgtctagtctcctgcaattctgtagttatggataagacgggaacgcttactacaggagatttaacctgttcaggatgcgaagattttggtccagaatcgcctctgttttattcttgcgtattggctatggagcagtcgtcctctcatcctattgctcaagccattgtcaactacctcactgagaagcaagttcggtcgctaccagcgacacaatgcacaacgataccaggagagggcgtaagggagaatttaacggagaacaagcctttgtagggcgcgtctcgacggcgctacgttacgttcctgaagaataccgtgaacagcttcgcgaacgcctcagcaagctcaagaacgcggcgacacatgttctatagcttgcttaggcaaacgtgtttcccttttctatttccgggatgtcccacgccacgatgctgcaaatatcgtatcctatttgaaaaagaatgggtatcctgtatgtatgctcacaggagaccatcgtatcagcgccgaaaatacagctcgacttctgggtatcgatgaggtgttctacgacctgactcctgataacaagctctcgaaaattcaagagcttgctaaatcacggcagatcatgatgataggagatggcatcaatgacgctcccgctttggctcaggctactgtaggaatcgccatgggagaagctggaagcgcaacagcaatagaagccgcggatgtggtgcttttaaaccaagggctttcttctctcccttggcttattgataaagcaaagaaaactcgtcggattgtttcgcaaaatcttgctttagctctagcaattattttatttatttcaggaccagcatcgatgggagtgatccccctatggcttgctgtgattttgcatgaagggggcaccgtgatcgtgggacttaacgctcttcgccttttaaaaaacacatgaccgcttacgagttgtataatgaaggaatatctgtaggcagaacagcaagacttcctttccttgcgggaaggacgcgaataacatccctgttatgaaaaaaacaaaatacttgcgtcaagtgaacttgtgggtctttgtagtcatcattctacttatgagcataagtgtgattgtgatctcttctcaagatccctcttctatgttagtccacacttcacgagggctgttctctgccaaaagcaaaaaacagttggatcactttgctctaggatggtgtgcctacttcatttgcttgtatgtagactaccatcaattcaaaagatgggcttgggttctctattctttgattcttttcagtcttattggactatttttcgtgcccgctgtacaaaatgtacaccgctggtaccgcatacccattattaatcttagcgtccaaccttcggaatatgccaaacttgccgttgtcattatgctaagctatattctagagatgcgcaaagcacggatttcttctaaaacgacagcattcgttgcatgtattattgtggggattccttttctgcttatcttgaaagaaccggatctgggaacagccttggtgctatgcccaatagcccttaccattttttatctcggaaatatctatcctccactagtcaaagtctgttctgtgcttgtcgctttgggcatgttctgctctctactaatcttctctgggattatccctcatgacaaggtaaaaccttatgctcttaaagtattaaaagaatatcagtacgaacggctcagcccttccaaccatcaccaaagagcctctcttatttccattggagtaggagggctaaaaggccaaggatggaaatctggcgaattcgcagggaggggctggcttccttacggatatacagactctgtgttccctgctataggagaagaattcggactattaggactcttattcgtattatggttgttttacaacttagtctgtttcggctgccgtactgtggctgtcgcggttgatgattttggacgatttttagctggaggagtgaccgtacacctggtcatgcacgtacttatcaatgtcagcatgatgagtggtctcctgcctattaccggagtccccttggtgttaatttcttatggaggttcttctgtaatttctactatggcttctttaggtattttacaaagcatctacagtcgacgctttgcaaaatactaactatccttattctcgcccccataacggtagcgtctggataagatgcttgatttctttcgtgagccgcttaagctgttcttccatatctacaggcctccctatcaattcctggagagacgttgcaggctgattaatacctagcaattcatcagcacccacattaccattcacaccgataccaataatgacacacgttccagtcttaacagggatggtctcacacaacactcctgaaagtttttgcccctgaactaacacgtcgttaggccatttcatgacagcttcttgaatgcctaacgattccccgagacgcatcacggcttctgtccctatacgaaataacaaagcactgtccacattattcacacttaaaaagaaacaaaacgaagccaaaagatcttgatctgtggagtgccagacccttccaaatttccctcttcccgccgtttgttctctggtcgtgatcactgtgagagcatagggatcccacaaagaaagcccttcttttgctgtcgtattcgttgattccgtacgtgctatttcataatagatttctttcattcgtctcgtacagctcctattcgtatctatatcgcttcatctaaaggcggaaaggagatttgcggaaaacgaaagagtttcccagaaaatcggattaccggatgaccgtgaagagtcgtataggtttccgcggctttttcgaaagcaaaggcctcaaaagaaaacgcattctcatacgcaagtagttcttccattaaatgctggacagcctcttgatgcaaactntcttgcaacgatgctaatgtctgtttcaatcggagagtaaaaaatcgttccatctcatagaaagtaactccatccgcatcactagctttaagaaattctttcaaagaataggaggagccttgctttaaaaaggctatctcctcttctaaacgaaggagagggaatgtttgcaacgctgcgatctcttgtaaaacctctcttttttttaaggcaagccgaaggagttgtcgccaggataacaaaagagcctttgctgtatagcgcaagcgacaataacccccgaataaccctcctaagcacaaactaaaaataccccaaaaaagcatatccgctcccgagtttcgttatctacaagcccctaattcctgagtgtacctctaaacaaaaaaaagagggagaaagacctccctctttttgttcttaaggaccaaaactctttctaatctaagcgacgagagccacagatttccctgataagcaactatctaactcagaatcggtcaactcccgatattttccataaggtaagccccctaataccaagctccctatgcgaatccttttaagttccagaagctgtaaccctgcagcctctgcaaaaagacgaatttcgtgttttttcccttcattcacaataattttaatagtcccgcggcggactttcttaactgaaactggacgtaccactttcccatcaatcacagtccctgccatcaaagtctctaaatctcgcgctgtgacatcccgacttaccttcaataaatactctttggtaataccgaaagagggatgaatcacccgattagcgaactctccatcattcgtaaccaaaattaagcctgaggtctctttatccaaacggcccacagtgaacaaccggtaagggcagtgcgacaacaggtcaatcactaactttgatccaggaaatttacgctcagaagagcaaagatacccaagaggtttatgcaccatgaaatacacttttttctcagcaccgatacgctgtccccctacctctacggaatcaaactcctcatcaacagtcacaaaggggcctgtagccaccctaccattaacggtaacagacccggcaaaaatgatctcatcacactttcttcgcgaagcaactcctgctgatgccaaaaatttattgaggcgaacctttgccatgccagtccttttgtctttcgactgcttaatattttgaagttcactaataagcgactatctaagaaaccttctctccgaaacaacaccgggaactatcttagattcaagggtaaaaataaaaacgacccccatcatatcaagatttcagtagagagtccagaagaagttctcctctctaagaggctcacaaatgaagagttcccccctcccttataaggtaaaaaatctttgcaaagataatccgcaaacaaggaagatgaagcctttcgtaatcatccttaaatcttgctctctatgacgcttcttatcttgctacgccatggccaatccgtatggaatcaaaaaaatctgtttacaggctgggtagacatccctcttagccaacaaggaattcaagaggctattgccgctggagaatctattaaacatcttcctattgattgcatcttcacttccaccttggttagaagtttgatgacagccctgttagcaatgactaaccacagctctcaaaaagttccatatatcgttcatgaagagcgccccgacatgagccggattcatagtcaaaaagaaatggagcagatgatccctctttttcaatctagcgctctcaatgaacgcatgtacggagaactccaaggaaaaaataaacaagaagtcgctgttcaattcggagaagaacaggtaaaactgtggcgccgaagctaccgcattgcccctcctcagggcgaaagtcttttcgatacagggcaacgaaccctcccctattttcaagagagaattttccctctccttcagcaagggaaaaatatttttatctctgctcacgggaattctttgcgctccttaattatggacctagaaaaattatctgaagaacaagtactctctttggagttgccaacaggacagcctattgtatacgaatggacgggacaaaaattcacgaaacacgctccttctcttggtaaacaaccaacaagccatccctccttccgaaatggtgaaagaggcttttcaacgttacgcagacgtattttcgtacagcgcaaatacctccattctgactttacaagcagaagctgaagcttctgcccgcaaactcacagggtgtcaggagaaggcttttacctttcattttattcttcattacccgaatgtcacggccattatcgtggccgctcttctggaaaaccaaaatgccttccaggggcgtaatcaccttcttgttccttcttgcgagcaacaatttatcatcaatgctctctgccgtcggcaaaacttagggacaacctatgattgggtaaccagcaaaaacggccgcgtaaaagaatccgatctagcagaagctctttccccgcggaccttgctgttttccatatctgctgcgaatggtatgacaggatttctggaagcgatccctgagcttgctgcgttatgtaaagaacgcggggtaattttccacatagacctgagtgatatcttaggaagatgcgcgctacccgcagaactctatcaagcagatatccttactttttcttcacagtctcttggtgggattggtccctcaggagcgatgtttatttctcccgctttaacaaaatatttttccttatggcttcctagtaatccacaagtccctacctgcctcagttctcttgcagctttttctcttgcctgtcaggaacgtacaaccgctttctcctctcttgtgctttctgctatttcttctcgagcagctcttaaacaggctctttccgctattcctcaagtcgaattccttttggaagacagtgcccctcgtctccctaatgtcgctgtctttgctattcctggtatccctgcagagtccttaggatttttcctttcccagaaaaatatttttgtagggttaggctatgaacgcttccagcctctatcgcagattttacaaagttcgggcatctctcccttcttatgccacagcgctttacacgtatcttttactgaacgtactcctactacacacttctctgcattagcaaccgccttacaagaagggatctctcacctacaaccactggttactcaatccttatgatgattccattttatcctttccccttatgggggagcttccctgcaagatccttacgctttttcttccaacctaaacatggcggaccctatcgcatgaccaagaggatgaagaaatacaacttgtcataggaaagcaagggcacctactcatgggaaacactttgctgttctactggctggtagacaaaaccaatggcataatccgtgaagctaaatttcaatatttcggacacccttatctccttgtactcgctgaagccacctgctctttagtcattgggaaaacttttgccgaagcgtataaaatcacaattaatgatctagaccaagaagtccgcggacacgccaacccttccattttcctagaagacctctctcctctctaccatctagtcatagatgccttagacattgctattgaacaatgtgtggatattcccgtgaatgacagccctttccctttcaaagatgcactatctcagcttagcgaagggaatccctactccacagaagagtggggagctctctcccatgacgaacagctctcagcattgaatactatgatgaaagagaaaatagcacctctcgtcgccgtggattccggagatgttcgcatcgttcatttcgaagggcttactgtaaccattgcctactcaggaaattgttcgtcctgtctatcctctgtaggatctactctcaattcgatagggcagctctttcgagctcatgtctatcctttattagaaataaaagtggacgaacagtctctactattttaaatccctttaaactgattcaaaatcctatcgaaatctttcttagataacctattgtttttaatagcctctttttgttacagaagacaaaagggctcttttaattgagagccccttttgagcttcttggtcatcccggatgctaatttttcttcttgttcacaagaagaagccttctttttcatccttttctttgcaggatacttagcgggctctacccttgctctattcctcaacctatacgtggagcttttgtaagaacttacttcatggagaatgccggtgctacctcgctttctaaaaaataagatcgcctccactaaatctttaggctaccttcttgcagctattcttattggcttcatcatgttgtataaaccatcctctcctcagcctacccctactgtagcctctacagagaaaaaaccctcacattggctgaagctctcccatttagggaatcttcaatcgatagaaatccaagcaaagaaagagcaattagaaaaagatctgactctatttgagcctgtgctccaagcaacggttgctctatcccaagaagaagactccttagcagaaatctccgtgatcctttctcttcctcaggcttcgacattatccccatcactcgtgcactcaatcactgattacctgacacgcagcgtccctgggttaactaaagaacatatcaccttgtccgatcagcatggtaatctctactccccgctcttcgaacaaagtaataccctactcactacctcattagaacgctcactacaaacgattcttcctcaaacgcatttcgccttaaactatattcctgtagcggatgaaggccatttgcaacttctcgtcgatgaggactacctcaatactcttcctaaaggtgcacgtgttaagttgctctcgcatatgcaagagattctctcagcattctcagaaatgcatccgtctgtagatattgtccctttcctaaaacccgtagcacacaaaacttctcgcctatcctcgattgtcttgagtattactattgtgttactaagccttggaattctaggctttgctaccttctatcttgcttttcatacctatgaccatgtctctcaacagaaagaaaaaatacagagcataaatataccaaagctgatagagatgatgaaaagagaatccccagaaaaagttgcattgattctctcctatctagactcagcaaaagcggaagaacttcttaataaacttcctgaagaaatgaagagtgctgtgttgaagttaagaacataaacacttggaggattacgtggcttctcctcatcttcgttccctagcgtgtttagataactcacaactacccatagaaacacctctctttgagcaaaaagctctctcccatgagcttctttctcttattcaggtgttccgtaaattatctgtccatcttctctctgaaatcgaaaaattatctcagaaactaaaacctgagcttcttgaacttgctgtcctcgtctgtgaaaaatttctgtacagaaagcttgcctgtacagaagaacttgctctcctaatctccgcagctctgcaacatcatttagctacttatgccgtctctcccataaaaataggtttacatcctgaagatctttcaaacctatctaaatggttaatccttcacgatgttcccttactcaaaaatatcgaattcattgcagatcctttatgcaagaaagctagctataaaatagaactcccttcaggaattctgagacaagacatcggggaagagctgtcccatctactaagtgtactcactccataaagcggcatcagctacaaacattacgtacgagagatcctaaaaaaccaaggaatcccctaaccacgtacatggtatgactcatttacaagaagaaactctgttgatccatcaatggcgcccgtatcgagaatgtgggattttatcacgcatatcaggatctcttctggaagctcaagggctctccgcatgcttaggagaactctgtcaaatttctctatctcggtcagaccctattctagctgaagtaattggcattcacaatcgcacgacattattactcgctctgactcccatatactatcttgccataggagccgaagtagttcccttacgcaggcctgcctctcttcctctatccaaccatcttttaggaagagtccttgatggattcgggaaccctttagatggaggatctcagctccctaaaacgaacctttcccctctattttcttctccctcttctcctatgtcgcgtactccgatccaagaggtattccctacaggtatccgcgcaatcgacgccctccttaccataggagaaggacaacgcgtaggcatcttttcagagcctggaggagggaaatcttctcttctgtctacgatagcaaagggttcccaacagacaatcaatgtcattgccctaataggagaacgtggtcgtgaggtgcgcgactatgtcaaccaacacaaagaaggcctagccgctcaacgtaccgttatcatcgcctctaccgcttatgaaactgcagctagcaaagtcattgcaggccgcgcagcaatcacaatcgcagaatattttcgagatcaaggagctcgcgtattatttactatggattccttatctagatggatagaatcccttcaagaagtagcgatcgcgagaggagagacactatctacacaccactatgctgcatccgttttccatcatgttgcagagttcctagaacgtgctgggaataatgataaaggatctatcacatctttttatgccattttgcattacgcaaaccatccagatatttttactgattatgtaaaatctcttctggatgggcatttctttctctcccctcaagaaaaaagcttttcttctcctcctatcaatgtattaacgagcctttcgcggtcttctcgtcagttagctctccctcatcattatgctgcagctcaagagcttctctccttactcaaagcctatcatgaagctattgatatcatccaactaggagcttatgtctcaggacaagatgctcacctcgatagagccattcgtttgctcccctccgtaaaacaatttttatctcaaccttattctcattactcagctattcatgaaactattgaacaactgtgccaactgttgaaacatgaataaaaaactccaagatctgtctaaactgctcactattgagcttttcaagaaacgtacacggttggaaacagtaaaaaaagcgctctccacaatagaacatctgcttacaacaaatacaggagcacatcgcgaaaatttccttaacaaggcacaaacaattcctatgtcggtcatatacccatgaatatgaccaacatttagaacatttacaaagagagcaaacttctctatataaacagcatcaggccctgaaaacgtctttgaaagatgcttatggcgacatacaaaaacaactagaccaaagaaaaattatcgaaaagatccatgacagtaaatatcctataaagagcgcgaataactaaggccacctacaatgaccgactcctcgtatgtagatttatcatttctattggatcagctgcttcctattcaacaggagcatttattagagtattggccttcgttatcccctcaacaaaggctacggttaggcactcaaatcgctcaaatcgatattcctttttttcttcgtcagcaagcgttactacaaaatcctcaagcctctcatcaagaatatactcccttatcccctgtacactatgctggcgacaaccctgcttatgcccagctgggcttccagctattgcaaagaggtaaggttggttgcgtcgtattagctggtggccaaggatcgcgattaaaatttgatgggcccaaagggctctatcctgtttcctctgtaaagaaaaaacctctttatcaactagttgcagagaaggtagccgcggctagcaaatgggtagggagaccattgccattagcgattatgacctcccctcttaatcataaacagaccctctcttactttgctactaacgactattttaatttgtctccctcccaagtagattttttttgccagccgctctggcctctcctttctttatccggagatctgttcctagaatctgaagatcgtctatctctcggacctacagggaatggctgtctatccacattattacaatcttcaggaatctgggataaatggcatcaagcagggatagaaatggttagtgtaatccctatagataatcccttagcattgccttttgatagagaactcgttggctttcatgcagcggaacacaatgatgtcactatcaaaactactttacgacaaagtgcacaagaagatgttggagtcttaatcgaattagcaaaacaaaaaattgcagttgttgaatactccacactcactactaaagaacgttgcgcgaaaactacagagggagatctcacctataaactcgcaaatatcggcttgtactgtctatctatggactttctagcacaaacagcataccaacctcttcctctttacaaagcgaataaacacgctaagcaattacatccctctaccactgaaaaaaatgcttggaagttcgaagaatttatttttgatttgttccaatatagcgaacacagtcaagccattgtatatcctcgccacgaatgctttgctcctctcaaaaactatgaagggaaccatagccctgcaacggttcgagaagctatgcgcaaaagagaacatgctctatttactgctgttacggaaagaaaactttctccaaatacaatatttgaattagaagcggatttttattacccttcctcccatacttccttagagtgggaaactaagatatttttccaggaaacaattattgaggcctcatgaaagagactatagcctacctaggaatgggcatgtggggattttccctcgccaatcttcttgctaataatggtcatcgtgtagtgggatgggcaagaaaccctgcactgatcgaacagttgtctgtgcaacgtcgacacccagcagctcctcatatctccattcctcagaatctttctttcacataccacatggaagaagctctagatggagcgacgatgattgtagaaggagtgacctcagcaggaatgagacctgttctaacacaactcaaagctttgacagagcttcgcgttcctctagtaatcacatcaaaaggtatcgaacaaaatacaggcttactcctaagcgaaatcgctttagaaatatttggccgtcccgccgcgcaacatctaggctatctcagtgggccctctattgccagtgaagtccttcgtggatgcccttgctcggttgttatcagtgcgtataaccctgatactctaaaacaaattcatcgagcttttctcacccctacatttcgtgtctatcctaatagcgacctaaaaggagttgcgttaggaggagcactgaaaaatgtaatcgccatagcctgtggaatctctgacggattccgcttcggggataatgctaaatctggacttgttacccgaggtctgcatgaaattcgtaaatttgccaccatcatgggatgccgtccagataccttgaatgggctcgcaggtctaggagacctctgtaccacctgcttttctgctttcagtagaaataccctctttgggaaattgctagccgaaggcctgactcctgaacaggctaaaacaaaaattggtatggtggtcgaaggggtgtacacggctctctctgctcatcaaattgctacacaccacagaatagacatgccgattaccaccagcgtctatcgcgttctctacgaaaatctcgatattcaggaagggatcgctcagcttctccaacgtgatacaaaagaagaatatttataaggttcttcttcaatgagaaaagactaaaacgccttccctgctagagagacgatgtttttcctttgtacaattttttggcatttgctaaagatacggattcagtcccagaccacaaagaaaggcccttgactaaatgagtagcaagctagtgaactatctccgtttgactttcctatcttttttagggatcgcatctacttcattagacgctatgcctgcggggaatccggcgtttccagtcatcccggggattaatattgaacagaaaaatgcctgttctttcgatttatgtaattcttatgatgtactatccgcactgtccggtaacctgaagctctgcttcttcggagattatatcttttcagaagaagctcaggtaaaagatgtccctgtcgttacctctgtgacaacagctgggattggtccttctcctaatattacttcgacaaccaaaacgcgaaatttcgatctcgtgaactgtaatctcaatgcaaactgtgtagctgcagctttttcccttcctgatcgttcgctgagcgcgattcctctgtttgatgtgagtttcgaagtgaaagtaggaggactgaaacaatactaccgccttcccatgaatgcctatcgagacttcacctcggaacctctcaattctgaatcagaagttacggacgggatgattgaagtacagtccaattacggatttgtttgggatgttagcttgaaaaaagtcatatggaaagatggcgtttcctttgtaggcgtcggtgcagactatcgccatgcttcttgccctattgactacatcattgcaaacagtcaagctaatccagaagtattcatcgctgactcggatgggaaactgaacttcaaggagtggagtgtctgcgtaggtcttactacctatgtgaatgactacgttcttccttacttagcgttttctatagggagtgtttctcgccaagctccggacgacagcttcaaaaaattagaagatcgcttcactaacctcaaatttaaagttcgtaaaattaccagctctcatcgtggaaacatctgcatcggagcgacaaactatatcgccgataacttcttctacaacgtagaaggaagatggggaagccagcgcgctgtgaacgtctccggaggattccaattctaaccccccgaaccctcttctcttaacctccccctcaagggagattaagagaagatttcctctcatgtctagctagaagccaatgttctatatacattatgtaagagtttcagagaggctgtaactaaactccattgctgatgcatagctcgcatttgtagttctaacatcaactgattcgtttgtgctaaatctccaaaattctgtacgtctgcaagaaaataggtaaagaagtttaaaagcccacctttcgtttctccagaggaaatattgatctccccatcgacaaccttcccttccaagttttgtaaagtaactacggaaaaagaagatcccataatctcataagcagggttgtattcatctctaccagggataaatgataatcctcgcaatccagtagacagctcttgcatttgggagatacagacatctaaagtctgaatatacccatttgccatatccttgagctgagtcttgtgctctgtcgttaaagaattatttgcctctacgttcttaataatctgtgccagctgctgcttggcattctcagcatttttaatatcctttctcaactggccagtctctgtttcataacgatccaagaccatctgatagccatatttaaagttcgcagttcctgctgtctgcccaatgtaagagcctaagttgtaaacgataggcgcgttattaaaacttttcactaactctaaaactgggctaaataatgtctgtgcataccctgaaaaattgagctctcttgctaatgcatacagagcctcttcctgtgcaggaatatacttatcaagaaggatatacgcaaaagccgattgaaaaggcatcttattcacaatactatcatccacaggatgcaactccttagcagtcgtcaatgcctgaggacctagtaccttggactctagttgttgctggagctcttttctctctcttttacgcgcttctctttgactctcttcagtccatagagcttgcatcaaagacatctcggagcctgtttttaagaaatcttgacgcaaactctctacgaactctttatttagtcctaactgatgcgcatcgttcaataaatcttgaaatacttgaagatacgttgccgcctcatgcaactgcgtgtagtcggctgctacttctgcaggggagactctgcgttctcgaggagccgcagtctctattgttggaacaaaatacttttgtccttctggaatcggatggtttctcataatcgtttttgccctctaaaacgattttatttaaatctacggatcaacttagcaaaaatctgattcattaatgctaaggctgctgctaccatagtccactcttgttgaatcgctgcagactccatttgtagagctaattgctgattctggttgaacgacgtgtaatcttgctgcttgctctctaaactctgtaaaacctgctgctctcccccaggcatcacaccattacgcccaccttcaatcacagcactttcaaatgttgtaagctgctgaatccaagtatcgaattccttcgatccaatcttagcagtaaaagcctcatccacttcatcaggcatgttacgccagaaatctgtaccttagaaaccatgacgtaaacattagagaggttgtgatagagattctcaaattcaaaagcataactagctaacgtctctaataactctgcacgctgagatgaggtcaattcagtatccgcatttatagaagtcactaattctttaatcttttcgatagcttttttacagtgaaagagatccgcacgactccgatctatctcttttttcacagtatcgttagcacgagaaatcacctcaggaaattcctgctggttcatttgtcgaagatacatccctaaagaataatagacgttagctgtttggaagctaactgcatgcgcaatgatatcatttaaataccgagcagccttgttagagaaagtcatctgacttcctaatgtctctaatatgtactgctgattcggaagatacttatccaacatcaaagatgaatagaccatctgtattggagaggtctctacgaaggtcttcttcgcttcgaccatagcattaaaataatttaaactggatggttcgacttcgcttttttagtcccacattctgcaatagctagttcccaagcggtaatagcctgattaatcttctgaatactggattccgaggctgtaatcaccttattgtaatcctgtcgagacatagtcttcgtaggatcagctgtcatgagactcacaacatcaaagaagaatgtaggattaaagagattagtcgctaatcctttattatcaaaaagatatacgccgttataatcaccgaaggcttatttttaaaggttcgcaatgcttgattggagatattaaaacttgaagtctctctaggcctccaatattggatctcttggtttagaaaattagtataatctgtaaaagaagcttgtgcattattgaatacatccttcttagcaaaacctaaagtactagcataataagcatatactaaactcaacagaccgttgagtttgacctgttcattggctttcaaatcagctaaagaattcacataatcatcaatagcagtatgaatgacgtcttcgtttttatcatttttaggataaagtgcgcctatctcatcaactgttgcagtacgactcattaactgccggaatagacccgcaaagctaagcaagctttgaatcatattgccttctaaagcgttatactcagctccttttaacctaaaaattcctgtttgttcacgcacatcccaaactggattgaaaatgtctttgatcgtgttggttatctcccgtatcaacttggcagcctctgtagctctctcaatataaagagagtactccgtcatagtcgtattcatcgcatcggcaacaggttctgataacgaggttaccgagttgtaagtgagcatgatattctgccaaaagttagtgactttacttttgggaattaacctcacattattttcattctttaagctttctatctctttaacaaagttttgaggaatagcataaagcttcgtatactcatcgtctgttaaagattgttgcttgagtttattgcgcagagtattgagttctgtttgatacttagtaacaatctcttcttctattgctgtaggatcttgaatccccccattttcagataatctgagccaatcatcaaaactatctgcaagcccctctccaaaaacctgagctgcagctttattaggatctgccaaaattgtttctgaagaaagctctccaacaatctcaatcccatcagcggaaattttactcgttgttcccgtagtgataggtgtaggtgatttttctaaagacggtataaatttttctagatcaacctcttcgagcaatcctaaagcccgtttcagccccttgcttttttcatccagttgctgaaagaaaaaaacactgcggcatatacactgcagcagcatcgacctgctctccggctaaagctgccgttatattcttagttaaagaaatggatgtaggttgtattgacacgagatcatccagaaaactattgtttttctaattttaaaaataaaaaatgttttttaaaacagaaaaacaatagtatctaaactagaataatcaaaactcgtttctttttaattatttcaattcgctttctattctggataattcttcaagaatgcgctgtggcatatcagctccgaaaatcgaacaatacttccgaatattactgacctcagctttccaaccctgcgcatctacagtcaacaaagctcgcaaagcatcctcggatagatcaagccccgatgtattaagcccttctgctgtaggtaaatantctaccggagtacggtgcgcaatggcatcctctccatccgtacgacggaagatccattctaatacacgaagattttctgagaacccaggccaaatgaactgcccgtgctcatccttacggaaccagttgacaccaaaaattctaggcaactgcaaacctttagtagcaaacgacaaccaatgctcgaaataagctgccatgttatagccacaaaatggaagcatagcaaaaggatcatgtcgcagtttacccaactcccctacaatcgcggcagttgtcgttgaggacatccctgcccccatcatcaccccatgctcccagcttaacgcctcatatactaaaggaatggtctctgtacgtcttccaccaaaaatgaccgcctctaaaggaaccccttgaggattattccattgcggatctaaagaaggacaatgatccaacggagctgtaaaacgcgcattaggatgtgctgcaggctcccctccagagacccaagctcgacccttccaatcaatcataccttgcggaggcgtggtagttttaccttcccaccatacatctccatcagcagtcaaagctacgttcgtgaatagtgagtccgcatgacaagtggcaagtgcgtgaggatttgtagtctctgaagttcctaatgccactccaaaaaatccaaattctggattcactgcgtataatctcccatcattaccaggacgaatccaagcaatgtcatccccaatacactccaccttccaccctggcagcttaggcatcaacatagcaagattcgtttttccacaagcgctagggaacgccgcagcaaaatacttcttccttccttcagggttagtcaccccaataatcaacatatgctccgctaaccaaccttgttgatgtcctaaataagaagctaaacgcaaagtancgcacttcttacctagcaatgcgttgcctccgtatccgctaccaaaagacatcacactactgtcatcttggaaatggacaatacgcatatgctcaggatcacaaggccatgctacatctttctctccaggagctaagggcttccctacactatgtaaacacttatagaaagtcccattagaacccaacatcgctaaaacagaagctcccatacgcgtcatgatcttcatagaacatacaacataaggagagtctgtaatctcaacaccaatcaaagaaaatggagagttcaaaggccccatacaaaaaggcacaatgtagagtgtgcgacctcgcatacaccctcggaataatgcgtgcagctctgcacgcatctcttgaggatctctccagttatttgttggaccagcttcttcttgagtcttggtacaaataaaagtaaattgttcagcacgagcgacatcactaggagaagaacgaacgaggaagcagttaggatgcagctcaggatttagaggggtcatcaccccagcatcctgcatctgctggcaaagctgttggtattcggcttctgaaccatcgcataaccttacgtcgtcaggtgacaccaaagcaattacttcttctatccaagattttaatcctgaatgggttatcttagatatccaatcgccggtcatactaaactctcttttcgtttcttcaattgatccagatgttccaaagctttccctgtacctaaacagaccgctaaaagtggatgcggcgctgtaataacagagagcccggtgtttttacttaatgctttatctaaccctttaatcagagctcctcctccggctagcaccatcccacgctctactaaatctgcagagagttctggaggacacttctctagagtcaaccgtacacattctataatttgctgaataggttctgctaagcactcccggatttctacggaattgattcttttcgtgataggcagcccagctacctgatcgcgtccgcgtacttccatctccaattcctgatcacctaacggataagcagaacctatagtaatcttgatctcctctgctgtccgcggaccgatcattaaattgtatgtgcggcgcatataattaataatacactcatcgaactcatcccctgctatacgcaaagaacgcgactctacaattcctccaagagaaataatagctatttctgttgtccctcccccaatgtcaataatcatacttgctgcaggttcatgtacagggagatcgacgccaatggctgctgccataggctcttcaatcagaattacttcctgtgctcccgcatgcaaagcagaatcttcaacagcgcgtttttcaacaccggtaattcctgagggaacagcaataagaattttcggacgaaacatactacgagcaggagtcactcgtttaatgagggcttttagcatcccttctgctatttcaaaatccgcaatgacaccgtccttcatgggacgaacagctacaattttccgcggggtcttccctaacatcgccttcgctttatgacctacggctaagaccgcatgagtctgtgcatctacagccacaacggaaggttcactaagaacaatccctcgacctcggacataaactaaggtgtttgccgtccctaggtcgataccaacattcccggaaaaaaaattaaatacacgatcgaaacgacccaacgccttgttatacagacggttagacaaatgtttaatcttatataagctgcggtatgggctcataaaattatatctgtagaagttcgagcacttcttcccaagttaacttagaaacgacttcatcatcagaattgatcactttctttacaagaccctttttccggttctgcaaactcaggattttttcttcgattgtattcaatgtaactagtttataggaagagaccgaacgactctggccaatacgatgcacccgatcggtagcttgattctccacagcaggattccaccacatatcgtaatgaatcacagtatcagctccaaccaagtttaatcctgttcctccagcttttaaagaaaccaagaaaacaagaagacctggatcttcattgaactgttgaacaatctctaatctgttcttggtggaaccatccagatatacgaaaggaatacccttagcttccaaatcttgtctaataatacctaacatcttggtgtactgactaaagacaactgtcttatggccagaatccactaatgagctcaacagatccatcaacatgtcatattttgctgaatctcctggctctggagtatccttcgcaaaaattgcaggatgacaacaaatctgttttaatcgggtaagcgtagccaacacatgaatgtgaattctctcgaaaccttcttgtttcactaagcgagataattcttgtctcgccgaagccgcataggactgatagagttctcgctgtgattctgtgagatgacaatgataaagaatttcagacacaggaggtagatcttctagaacatcctctttcattctgcgaagaataaaaggcgcaacctttcttcttaaagcttccacattgtccgctttattccccatatagttaccgatacgaatgtatttacccacaaagcgatcatagctgctaaggagacctggcatgaggaaatcgaataaactccacaactcttccaatgaattctcaatcggagttcctgtaagaatcaaacgatgacaagcgcgaatcatttttaccgatttggcgttgcgggtagttcgattcttaatgtgatgcgcctcgtctaaaacaacgtagtcaaaaagaaaatctttgtagatatcgatgtctttctgcaataaattgtaagaagtaatcgctacatcatactcttctaatgaagctaactgcttacgtcgctgagacggaataccgtcaactacgagagtcttaaactctgggttaaattttcggaattcttctttccagttgtacacaagagaagtggggcaaatgattagagaacatccgccgcctttttccaagcgactctgtgtcacagcaataatggtctgcaacgtcttccctaatcccatgtcatctgcaagaattccattaagatgcatcttacgcagacgctctaaccaatgcaccccttctttctgatagcctcttaacgttgcctgaatttgagaaggaacctcttggaactcaaagtctacttctccacgaatctgtttctgtatttcagcgagatcttctgtcatagaaaagttcacaggaagatctttgaaagattccggcgaaattccagatagactccataaaggacattgatcaacaaaatcatctagaacttggaacccaatttcattgaaaatttgaataacaggtgcgattttttctaaatcgaggacaaggatgcatggaagtttcgaagcagaagcctttcctcgccgcgcttttttcaattgaccgccctttttaggcaactctaagaagcgcttcttcgcactgacacaatcccaaagtaagtctaaactgatgcctttcagcaagccatgaacttttaactccgcttcgtagtagttgatatcctctcctgctcggaaaatgagatcaaagacagtttcatcataaataaactgatcagacagagtttctggacaattaaatgtgatgcgatgctggttattagggatcgtctctgtcataaattcgacaatcttcttctcactttttacatgaaaagctccatcgcgctcgtcatagacaaacccagaaaatacctcttctagaatttttctctcttcaactaagttccgagctaaaatcccatcaggacgaacaaaagtgcgaacttcttgatactgcaaagagaaagaagttgcaggaactttctgcccgtcgtaaaggaaaaagagtctcgcctcgagttctccatccaaatagctaatatcacaaacgccttgtaattcctctgtatatggcaatgtactgaaaacatttaaagcctcgacattggacaattccgcaataaatttcggaatactggcaaagcgttctcgcaaaaggaaccaaacagagcttccgggatagctatatcacgcaaccctgcaaaagttcttaaatgagcacgcttaatctgcggcaagaaatggtgataaacattcttatgaataatcccaggataattggattccagaagaactgcttgctcaggctgtaattcctcttcatccacaacaatcaaaggtttcattaataacgctttgtatggcgtatcaaagtaatctaagtggaacttcatcttagcgggagaaactgaccaaagcaaaggttcttctaaattcccacaaaagatcccctgaaaacattctctctctcctaattgagagcctccgctttctgccatttgatgttcgaacattttggataaaatcatccccaaagatgctggagtcagaaaagcagactttaataatttctcttcagaacttcctgtagcataacgcgcataacgaatcagcaaatcgatgagttttctgtccgaagcactaaaagactggagcgtaaagaaaaatcttcttccactaaagacaataggctcttgatacaaaaccccttctaaaaatgttttgatattggaaatgtaaaatggtttagaacgcccaggaagacgcagaacaagctgaaattctataggctggttaggagagaagacttccccttcatttttttgaggaacaaacaaaacagctagtcctgcactatctttctcagaatactctaaaggcaagaagaagggattttcacttaaaacattagcagcatgattgtattcccgaagatttctttttggtgttcccgatctcttcgttcctcctctcgaatcgctgcaacgacaaaagtctcttgtaattccttactcacctcctcattagaagaaagatctgcttccttagagtaggtaactaccatttcattgaagtactgctctaagtaaaataacaaggcaacgacatgctgacagtcgtaattgtaagaacaatcgcagttggaatccacggtgtcagattccgctcgatctacttcaatttcgcactcgtaaacgttatcgtacgaaccacgaatttgagcgctaatacacaccgtctcgccattcatagataagattttggcactaaccacagctccttgagcaaaataactcttttccaatcttgnagtatgttagctgtaaaatctcttcttaatttacgaaaattaagcattgatcctctaaaacatagggggttgacagacctgttacttgtacctttttacttccgctaaatcaatgaaaattttgacgctctcttcttcctctatttttcccctttttaaagctgtttgcagtccaatttttctttttttaccacctcttcaccttctcaaaaaacctttttccaacgtttttttgtaaaacctacaagcaaaggattgcgaaaaactccccagattatctagaatgctcctcttctcgcgggtgtagctcagtggtagagcgccacgttgccaacgtgaaggtcgtgagttcaagcctcatcacccgcttctcttttcccggataacttaccaaatgggtattctgtgtcttcacgagatttttctaatgatttgttttctataaatatagaagaaaatgctggttgtgttgtgtctgcaaaagtccaagctaatcccttggtcacacaaaagtgtcataaagaagctctgaagaccgtcaaaaaaaatgttgttttaccaggatttcgcaaaggaaaagcacctgataatattgttgagtctcgctattcaacccaagtggagcaggaactccgacgtttgttccttagagcctcttttgaagctctttcacaaatgtgtgatagaaaacctttatctccaaaagctgtgcgctcctcggcaattgatacttgcaacccggtaaacggaggctctgtttctttcctgtacgaagcattccctgtcattccttctctaccatgggagcagttaagcttgcctgatcctgaacctgtcaaagagatctctgaagaagatttagagaatgggttaaaaaatgttgcttacttttttgcaaccaaaacacctgtcacgagaccttcccaagaaggagactttatctccttatctctatatgtctctaaaaggggtgatgagaattcgactccagtagctatttttgaaaataaatatttcaaaattagcgaagaggatatgacagattcttttaaagctagattcttgaacgtgtctacagggcatcgtgtagaggaggaaattggttctgaagatattcaatccttcctaaacggagatcttcttaccttcactgtcaacgctgtgattgaaatttcatctccggaaatggacgatgaaaaagctcgagaactacaggcagaatctttggaagatctgaagaaaaagcttcgcatacaattagaaaatcaagctaaagaagctcagcaccaaaaacgtttctctgatgcagaggatgctttagctcagcttatagattttgatttaccagagagcttattgcgagagcgagaagaacttctctctagagaaaaactgttaaacgctcgtttagtcaaatattgctccgattccgagctagaggaacagaaacaagctttactagaagaagcgaaagcagatgcaaggaaggctgtgaagcttctgttcttaactcaaaaagtattctcagaaaaaggcttgtctatttctagagaagaactccaatatatgatggatgtttgctccagagaacgttttggaggctaccctccaaaagatatttctaatgagatgatccaagagttagttcttgttgctcgtgatcgattgacttatcgtaaagcaattgaagcaatttcatccgagaaaaaagatttagaggttgttccttcttaattttgatcgcaggaaaacgcttgacccaagagacacttaaacatagaattcatcattttgatgcgtaggtgtattttgaattagataggatctttcttttctagggtcaagagtagccataacgtaagcacacctgtaaccaaatgatttgagaggaagcacacatatgacgttggtaccatacgttgttgaagacacgggtcgcggcgaacgagccatggatatttattctcggctactgaaagaccgcatagtcatgattgggcaagaaattacagagcctttggctaatacggtcatagcccagcttctatttcttatgtctgaagatcctactaaggatattcaaattttcatcaactctccagggggatatatcacagcagggttagcgatttacgacaccattcgtttcctaggctgtgatgtaaatacgtactgcattggacaagccgcttctatgggagcgcttttattatctgcagggacaaaggggaaacgttatgccctaccccatagccgcatgatgattcaccagccttcaggagggatcattgggacctctgcagacattcaactgcaagctgctgaaattttaacattgaaaaaacacctctccaatattcttgcagaatgcactggccaatcagtagaaaaaatcattgaagactcagagagagacttctttatgggagcagaagaagcaattgcttatgggttaattgataaagtgatctcttctgctaaagagacaaaagataagagtattgcgtcttagagaattgttatgacaaaaaaaaaatcttgcggtctgttctttttgtggacgatctgagaaagatgttgagaagctaatcgctggtccatccgtgtacatttgcgactattgtattaagctgtgttctgggatcctggataaaactccagctcccgcaacacaggagatcgcaacatcttccacaagctctccaacaagtctgagagtgttaacccctaaagaaatcaaacgccacatcgactcttatgtcattggacaagagcgcgcgaaaaaaacgatttcggttgccgtctataaccactataagcgtatccgtgctcttatgcaggataaacaagtgagttatgggaaatccaacgtattattactaggcccaacaggatntgggaaaactttaatcgctaaaacattagctaagattttagatgtcccatttacaattgcagacgcgactaccttaactgaagccggttatgtcggagaagatgtagaaaatattgttttacggcttttgcaagcagcagattatgatgtagcgcgagcagagcgaggcattatttacattgatgagatcgataaaattggtcgcacaactgctaatgtttccattactcgagatgtttctggagaaggcgtccaacaagcccttttgaaaatcatcgaaggaactgttgcaaatatccctcctaaaggaggaagaaagcatcctaaccaagagtatattcgtgtaaatacggagaatattctcttcattgtggggggagcttttgttaacctggataaaatcattgctaaaagactcggaagaacaacgataggcttctccgaagaaaccgatctggctgtaacgaatcgcgatcatctacttgcaaaagtagaaacagaagacttgatcacctttggaatgattccagaatttatcgggcggtttaattgtattgtcaactgtgaagaactcactcttgatgagcttgttgagattcttacggagccagctaacgcgattnttaagcaatacagagagttattcgaagaagaaaacgtcaagttaatcttcgaaaaagaggctctttatgctatagcccaaaaagctaaacaagccaaaaccggagcccgagccttaggaatgatcttagagaatcttctcagagatcttatgttcgagatcccttccgaccctacggtagaagccatccgtatagaggaagacactatcacacaaaataaacctccggtcattattcagaaatcaccagaggcgattgcttaacttttaggaattgcatgacccagtccacattggaagttgcaaaaaagattgttcgaaaattacgcaatgctgggtatcaagcgtatttcgttggtgggagcgttcgagacatgctcttaggacgccccatcgaagaggtagacatagcaactaatgcttctcctactattgtcactacaatcttcccggatactctttctattggcgcggctttcggcattatcgctgtaaaggagaatgggcagttatttgaagtcgctactttccgtagcgatgaagattatgaagacggtcgacatcctaatcgagttgtctttgcatcgatgaaagacgatgctattcgtagggattttaccatcaatggcatgtactatgatccctttttagagaaactattcgacttagtagaaggtagagccgacttagaaaganaaatcattcgggccattggcaatccaaaacaaagattcctagaggataaactccgtatcctaagagccattcgttttgctgcgacattaggctttgctttagatccgcaaaccgaacaagccatcattaaggagctgccttccttaccaaattctgtcgctcctgaaagaatttggcaagagctcaaaaaaatgctccggacagccccttacgagtctttgcagttacttaccaaattaaaagtgcttcctatcctattccctgaattaaaagtatcctcgagtggatttttacgctctgcaattgcttttgcacaaaaaatccatgattctcagattccagagatcgctttgttgctacctttattccgagaagtagacaaggaaaaagctctagaagccttctctcgcttacgcgtatccaacaaagagcttaaactattggaagactggtacgcagctcttcctcaatttttatccaaacaaaatgacaagtttttctgggcacatttttttgcttcagagacctcctctttgctgctttcgctcttcctgtcgatgcagcgctcaccagacgagcaagaactatttattgctcgtatacatgacctaaaaacacgtcttgcagcattcatagaaagaatccagtcaggagctcctcttgtttcggcgcaagatctcatcgcgaagggaattactccgggtcggttactaggggaactactcagagaagctgaagcgctatccatagaacacgagtgctcggacaaagaaaaaattttatctctactgaagagcaagggattttggaaataactcctcttctccgataaaacattctgaaatagtttattttagttctttagatttaattttttactctttatcatttcttcctaattattcaactttggattaatagagcctgtttatgcgtattgctattttaggaagacccaatgtagggaagtcttctctcttcaaccgcttatgtagacgctctttagcgattgtgaactctcaagaaggaactacgcgagatcgtttgtatggagaaattcgagcctgggattctattatccatgttatcgatactgggggcgtagaccaagagtctaccgaccgattccaaaagcaaattcatcaacaagctttagcagcagcagaggaagcctctgttctgctgcttgtagtagatatccgatgtggtatcaccaaacaagatgaagagctggctaagcgtctcctgccgttgaagaagcctttgattcttgttatgaataaagcggattcccagcaggatttacagcgcattcatgaattttatggattgggaatctctgatatgattgccacatcggctagccatgataagcatattgatttactcttggaacgcatccgtcagatcgcgcagatccctgtaccttctgtagaagaacaagatgttgtacaagaagacgagctcccctctgaagaggctgctatatctttgcatgcctttgctgatgaaactctttttgaaaatgaatccctatcacaagaagaagcttctttcctggaagagctcgttgcgcagacggcgacgccagcccctgtagaccgcccgttaaaggtagcgttgattgggcatcccaatgtagggaaatcctccattatcaatgctcttcttaaggaggagcgctgtataacggataattctccagggactacacgagacaacatcgatgttgcctatacgcataacaataaagaatacgtctttatagatactgccggattaagaaaaactaagagcattaaaaactctgtggaatggatgtcttcttctcgaacagaaaaagccatttccagaacagacatttgcctattagtgatcgatgcgacccagcagctctcctatcaagataagcggattctatctatgattgcgagatataaaaaacctcatgtgattctcgtaaataaatgggacttaatgtttggtgttcgcatggaacattatgttcaagacttgcgaaaaatggatccctatataggtcaagcgcacatactttgtatttcagccaagcaacgccgcaatctgttacaaatcttttctgctattgatgatatctatactattgcaacgacaaaactctcgacttccttagttaacaaggtattagcttctgctatgcaaagacaccatccgcaggtcattaatggcaaacgtttacgcatctactatgcgattcataagacgacgacaccatttactttcttgctgtttatcaattccaatagtctgctgacgaaaccttacgagttgtatttaaaaaacactttaaaagcagcttttaatttatatagagttccatttgatttagaatacaaagcaaaacctgcaagaaaatcaaattaatttgtaaaaaaataaaaatcttttattagaaataataaaaactaaaattagttatttcttggagattttaatccctatgcactacgaaccctatgatgaattcgagcccgataatgaactagatcatcttatctgcgagtctgataagacaaaacctctagatgcctaccatgatacaggggtgtatatagaagaagatgatcgagaaaatggtgacttactgattgtattagggaagtccatattaaatggtgcgattcgtcaattctatattagtgatcataattatgcctatactcgcggctattaccaaggttgttgggaagggtggtttaatattcctcctaaaaagatcactacagccgaatatgactgcgatcaacttcttcagccagatttgctactcaccactaatgtggaaaagctgattcatgctcctgaagacttcccagcccaaaatgccaacttagacaatatcatcatttgcatgaccgcattgaatggggaacatcgtgtacaattcttaataggtgataatcatcgctctttctggattcgtcaccatgacggggaatcctggtctaaatggtctactttcatataaccaatacaccctagctcttttcgaatcctaacgaactctctaaatagaaaaggcaatctccaattaaggagattgcctagtttgacaagcctcttacgactcttcttcctcaccgacaattgtcaactccatagggcgaaaattgtcatgattatggaaagccgtggctactgttgggatagcattatctggtctatcgctacgtgttaatgataattctaaagcgaataagtgtttcactatagcaatgcgaatatcgcgaatcagcccttcaaacagcaggaaggactcattcttaaattcgattaaaggatctttttgcccaacggaacgcagtcctacttcagaacgtaataagtccatatctacaagatgcactttccattcctcatcgatatgagaaataatcaccgaacgaagaatgtcattacatatcccctgagcatttgctgctgacccaataatctctgtaaactcagcaagcatcgcagagaacttaacatcgaaggcttctattaataaatcccctatgtagtctgtaccgcatctacatcaccgagtcgacggatttcctgatcatctagcttcacagggaacgaataactcaaccactcttctatcttaggcaaagagcaatgatccgcatgagcatcttttaaaatcagaaaggctaaggctaaagcaacatgttctatctgctctttagcaacaacaaacaagtcttcagcatgaagtacatcattacggaaggcgtaaatggtttgtcgttgtttattcatgacgtcatcatactctaaggtatgcttacgtatggtatagttacgtccttcaacacgcttttgcgctgtttcaatcaatcgatcaaacataggatccgacatcgcctcaccttctggaggaccggaaatggcgaatcaatgtattgagttttggagaggcaaaaagcctcatcaatctatcttcaaaagaaaggaagaatttcgcagcaccaggatctcctaaacgtgcacaacgaccacgcagctgtctgtcaatacgtcgagattgatgtcgtgacgtaccgataacatacagtcctccagcagccacagcctcttcatccagcttgatgtctgtccctctaccagccatattcgtagccaccgtaaccgcgccaacctttccagctcctgcgataatttccgcttcttgcgcatggtttttagcattgagtacagtatgattaatacgattttgccgcaaaatacgagaaagtttctcagacacctccaccgattctgtcccgatcagaatcggctttccggaacgatgcgcagaaatgatctcagcaacaatagcctgatacttctcacgctctgtcatataaaaggcatcattatgatctatacgcaagcaaggcttaaatgtagggacttgcagcacatagagactataaatttccttaaactctcgagattcggtgattgcggttcctgtcatccctgctaatttttcatataatctgaaaaagttctgcaaggtaactgtcgcgaaggtctgcgactctttacggatcgttacatgttccttcgcttcaatcgcttgatgtaatccttctgaaaaacgacgtcctggttgcgggcgtcctgtatgttcatcgatgatcacgatctgatcatcgcgcacaatataatcgatgtctttctccatcaataagtgtgctcttaacagctgccgtagcccatgagctcgggcttttctttgcgtatccttctcggaaacagctatcttacgatttaacttatctgctggtgaaagcgttgcatcttcttcaatcagagcatattcatgccccatatccatcatcacaaagtcttctgcagcaccaccgatcttctcaatccactgcaacattcctttgtctgttaactcaaaatcattattgtgttcatcgactacaatatatagagaagagagcttctctagacattcctctttattttgttcggcatgatagaacacatcccatttatcgatcatagcacgaagatctggatgctctcgtacacgacgcaacactctgttgagcggcattcctttgctaactaaccataaggctcgacaagcttcagagattgcctccataacctttttatccttaggaagcacatcggttcctaaaaaaggatccaagacctttctagcttcaatagcaatatggttgcacatttccctttggaaatacactaattccgctacgcgatcttttaattcaaaatacacgggattatgtttttctcctggcccggagataatgagtggagttcgagcctcatcaatcaacaccgaatctatctcgtcaataatagcgaagtaaaaaccgcgacctacttgctcttcttttcttgtggcgatcgaattatcccgaagataatcgaacccaaatcccgaagctgttccgtatacgacatcacactgataaatagctttacgcttctctggtgggctcccggcagactaaaaccccggtcgtcaatcctaaccaacgcaacacagaacctacccactcacaatctcgttgagctaaataatcattcaccgtaacgagatgaacaggctttcctgataaagcatttaaatacagcggcatcactgcagttaatgtctttccttccccggtttgcatctcggtgataaagcctttatgcatagcgatanacccagaatctgcacatcgtagggaaccatatcccactgctgatgatacccagatacctccaccggagttcctgccaaacgccggcatacgttcttaacaactccataagcctctggaagaagtttatctaatgactccccgtcttgatatctttgcttcaattgaggggtcttttcgcgaagctcgtcgtcagacagggacgagaatttctcatcgcaagcattaacctcttcaaccaacttctggaatcgttttaatattctctcttgggaggatccgaaaaaacgcttaaggaaatccatcatatgttcaatacatgctcttgaaacgaacctactctcttatttaaaggcgcctatacaacaaggatggttcttttctatttctttttgataattatctttttacgcacaaactctctcagggaaaggctactcgagagaaaagaaatccgtgcattcaggcacattctagactatcctagagaaaaagaaaacaaaaagcactcgagcaatacgagggctaagatcttatattgggcttacttacaagagagaaaaaggctaggcagctagcagtaaagaaacctctactatatgctgttggtctataggaagtttctgtcgtaaattcttcaaaatctgtgaccgtcgctcacgttccttcgccgtcgtatctcgctcggctaaaatagcctgaatatcataagcaacatcaaaattaccttctcgagcttcacaagcactcaataactcgagtacttccggagatcgtttgatctgcagcgctcgcttagcataagctattccttctcgagcagaaatcatcgtcgcatgtccgactcctgcgagccaagccagtgctttacaagcaaccaaacaatccggagtcttttgaatcactcttaaatataccttctcagcctcggcatatttctttaaatggcataatgctaaaccataatgaacacagcaattccaatcatcagcataactttgacaacggaaagctaatgtccagcagtgctctgcgagctgataatcttgctgatccgccgccgcaagagctgcataccgcatcatcaaagcatctccgcgaacccataactcactattttgatagatcagcagagcctttttcgaattccctaatttttgctcacataaaccgatattaaacatcgcttcgtctttataaaccggatcccctaaaagctctctaaagagcatcccagcatcgacatactgcccgcaaatacgcaaagaatgtgctaagttgtacaaaacatcgatagggcaagatcctaaggaccgtgcacgtcgatagaaatcgatagcatctgcatagcgcttcgtcgcaaaatagatatgtcctacgctaataaagacttcttggtgagcaagtggaccaatccatggttcaatgatccgacaagcagcatctacttctccaagatataccagagaaatggtgtagcgagcgacctctcgctcgcccataagctcagcggaaagaagagaaaaagcatgtgcagcctctttataggcgccatgccggaaagccttatgtgcaacctctaagaaaaaatgggcgcctgctaatttcaatttcttagcttctcccaaaagcttttcagcttcttcaaaacgttcgagctctcgaagaatacggatatattcgaataaatatttacgtcgatattgacgttttttcaggatcggggccaagcgcatttctgcgaccgcccactcttttaaatctacgctcaagcgcacatcccgcatcacttgattcacgtagctgcggaagctgataacatgcctataagctttaaagactaaagccatcgctaagcaagccaagagtgtccatgctacgattagccacataatgcacaacttctgagttttctctctcttgcaataccaaaaaaaacgttttaagtctttatttttatgaagagaaacgttttcctaacgattgtcccattcgacaccgggtttctaaaccctgagcagaataaccaactagatctgcatcaaagataatccgttggggctgaaataatagaacaacagtcgatcctccaaaagcaaaaaaacctttttcggcaccttttttcacataactaccgggagaaaacgtttggtggatagaacccacatttaacgcccctacttccacgtaggcaacctcaccaaactcttttgacgtaattatggtaatttcgcgtttattctccgtaaacacttcgaaattccgcttaagcataagaggatgaatagaaaaaagatggccgttgatacggcgcggtgcctcagcaatacccgctataggaaagtggaagcgatggtaatcaaaaggagctaatcgagcgattgccatactcccttgcgcatattggtgagccaattgcggatcccctaaaaaactttctaaagaaaacggcttatttttaatggtaaacaaggatagatctgccatggaagggaaaacaagataggcaccatcagcaggagtcacacagatatcctctccctggcagataggtcgagcatctggtttgagttttcgtacaaaaaaatcattaaatgacgcgtagtcgtgcagaggagaagcactctcttctatgcaaatacgatattttgtaacgaaaggtttaataaaatatcgcgtcactcgcagtctttgacaccagcctacgatacgggaaaacaggctattcttacataaaacagagtacagagctctccctattctcgtttcaataaaaaactttaccagagaagaacagatgatacgttcctgttctaccttccctgtttcgcgattaacatataacatttcccgcgctgccatgcttatctcctgctctgcaagcggctgatttgctcttcttatagaagccttttacacacaaagcataaagaactataaagaagtttctctttctcaaaaacacaaaccctttcaggataccgaactcctaaaaaaagcttcttttatttaaaaatttttatatgaacaacccgcctttcttcgattagcccttcttgcttagaaagatcatccaaaagtataatcatttccttttcagcactttatttagcctaaaggctgctacccatgcttcgaaatgatacgatcacagctattgcaactcctccaggagaaggaagtattgctattgttcgcgtctccggaccggatgctatttctatttctgatcgtattttttctggcaacattgcgggttacgcatcacatacagcccacctaggcaccgtatcccataatgctgtctgtattgatcaagcgttagtcttagtgatgcgcgccccgcgatctttcacgggagaggacatcgtagaatttcaatgccatggaggttactttgcttgctcccaaattgtaaacgctctattagcggagggagctcgtgcagcacttcctggtgaattttcgcaacgtgcatttttgaatgggaaaatcgatcttattcaagcggaagccatacaacagttaatcgctgctgataatatcgatgcttttcgtatagctcaaaatcaattccaagggcatacttctcaagcgatctcctctatctcctctttaattatagaagctcttgcttatatagaagtcttagcagacttccctgaagaagatatagaaactgaagattcgctccctaaacatcgaattatggaagctctatctatcacagacgagcttctttctagttttgatgaaggacaacgtctggctcaaggaacgagtattgttttagcagggcttccaaatgcaggaaaatcatccatcctaaatgcgctcactcaaaaaaaccgagcgattgtcactgatattccagggacaactcgtgatattttagaagaaaactgggtcttgcaagggaaaaatcttcgtctcattgattctgcgggtctaagagaaacagaaaatttggttgagaaagaagggattgctcgtgcccgagaagccatgagtcaagcagaaggaattctctgggttgtggatgcgtcgcagccacttccagaattccctactattttgtatcaaaagccgaccattttactttggaataagtgtgatatcgtatctcctcctcaaatagaggttcctttccagcaaatttctgtatctgctaaaactggagaaggattgctggaattaaaacaagctttgcaaaaatggctcaatactacgcagttaggaaaatcttctaagatctttttagtctctgcgcgccatcacagcttgcttcattccgtttatacatgcctaacagctgcgttgaatggatttacagaacatcttcctaatgaatgtatcgctttagatctccgacaagctttgcattctataggcaatttatctggatccgaagtcactgagaatgtcttaggagaaattttcagcaagttttgtataggaaaataacctcttatgaagtcactaaatgtacaagctaagcgtgcatttattatctctactttaaaccgtcttttccctaatcctgcgccttctttaacaggatggcaaactccctttcaactcctcattgctatccttttatctggaaattcgacagacaaagctgtgaactctgtcactccctctctctttgctaaagcaccagatgcacaatctatgagtatgctggctccttctgaaatctattcactcattgctccttgtggattaggagaacgcaaagctgcgtatattcatgctctatcacatattcttgtggatcgttatcatcaagaaacccctcacacccttccagaattaacagctcttccaggagtaggcagaaaaacagcttctgtttttttaagcatttattacggagaaaataccttccctgtagatacacatatccttcgcttagcacatcgttggcaactttctaacgaaacggagtccttcagctgtagaaaaagatttagtacagttatttggaccaaagcactctccgaaattgcatttacaactcatctactatgcaagagcgtattgtccagcgctccaccacaacatcgatgtgtgtcctatctgctctttcttacagacagactaacgagcttccttacggaaagttccatctcctgattccgagggaatcatttgccaaaaaggcggtcgtggcgggcaccgtagaatttcttcttttaggtgcgcatacacatcaaaatgataatcgagcaaccagcgcattaataacactcgcatcatccttgcccaagcttgaggactatggtctctaatgctgtacagactgcctacctgctctggggaagtaggtttaacctttgcatttaaatgaatgtggtgttnaccacgtgcaacacaacttctgctaaaaatgcttgcgtatagagcatatcatgtgggtatgtctgtgatatccctttccaagaatcaaaaagttctctcccttcctgagagaaaatcatacatcctacaacgagttgatcttcctcttgaaagagtgattcggtaatcacgcctccgataaacgtttggaaatcctcagggctgactaaatacaaatcttttatcttcttaattgcctcgtgactacgcggagacaagctccttttcgacaacaccttctcttctaaaaaatttcgaagaatttcgaaacttacagagaggtacatatcttgattatctaaaaaggctagcagaacctctacgatcatttgcgaagcagcatcttcttccactcgtcctcgcaatgaatctggcatgtctgtttccctaccagatttttgagtctgcacatcatgtgtaaaatcgtcccaagacgaaaaatttcccttttgatctctgtaaaatagaatcggcaaccgattcgaccttcttaacaggccgttggcgttcaaaaaataggatactttttaacaaaagcaacttattaattgtttgtcgttttctagcccgctctctcttccgaaagattcgagcgaaccatgaattcgacggttgctcttgttttaaataaatatcgattacggcaagtaattgagctgaaatcgcataactttccccagaatgcgcaagtagctcgctaatcacttctcgtaaaatacttgattccccctcttgatcagtagaaagtttttgatcaagagggatcgcctccaacatatgcaggcgtcggttatataccaatttacaagaagcatcccggatgactaattctaggatacgtaaataataatctgtagggaaacgagaatctaatagcatataaggatttaggtctttttgcctattcttcacataatcagtattatttcacgctatttatcctcttccctattagaaaatgttcttagatattcccaaccgaagaaggatcttcctcgctaggtaagaaaaagaaattggttaccaaaccttcgatcatacgcaaataagcttgtggctcatgagcgaaagtggaatgcaatcgttctacgtttgcattaacaatttgcacaacgagctgctcattcacaggagggaatacnctccgcggccaaccttccatacaggaggaagcaaatcgagaataatgagttctcctatgagctccgaagttcgaacacgcaatgcatccaaaacatactttgcagccataggggctttctccgccaagcgatctattatccctgctaataataaagcttgagaatagtctgaagaagggtcttctttttctaaacgaacaatcgacttgaaacattcttgagaagtcgcattataaggagtcgcacataattgaacgagaccacgagaaaaccctatcatgacatgttgaggccagttggttctcgtatttaaaatcgattcaatatcgtctacagcatcatatacaagagttctccccgcacctgtcaccggagcatcattatttactaatcgatcttcgtaattcccaccgacatgttcaaaagagcgtaaggtagccatacgcaaaagcaaacccaccgcaacaagaacttctaaagagtctttatcagctccacaaaagttgatcccagaacgtgtacaatgtcgataatacgcatcccttaaagcacgaaaaatggtagcgaaaaactcacgaatcgtacgtaagcatgcagaattgaaagcacggagatggcgataggcacgcgttaaagcaggcattttcgaatcctgcagatattgcacaatcccttgctgctcttctgcttttttcacatcatagttttcattccttcgtgcaacacgacgcttccaaatagaagcntactgcatcacggatccgtccaaggaaacctcgttgtcgtggagattcctccaagctaacgtgttgctgaagatcttcactgacccctgatgaagaagtagtacgaaacagcgtttccgagctctcggtaatgatagactctgcatgatccgaaacgcgctcttctagctctccctcttcactatctggtacatcatcaatctcatcgcctcgagatgcactagaaaatccttctggcccagaattccccccgtatagggcttatgctactcactactacttcctcttaatagttgaaaggaccgaacaccgtataccttctctttagtctaagaaaacagaagaagttatgacagttagtgtttggaaatataactcaggatctgtttttcgagcattttctaacagtttttgtaactcttttgagttatcttgaacacgttgaggatcttgcccattttgatcttctaaaacaagctggttcatcttctcgttttctaaaacgacttgtccacaatttcctatataattaagaatgactggccctgaaccaggactagagaattccgtcgcatcgatttttgctgctaaatctaaaatggcatctaccgtaggatctgtagcctcgttctcatcagtaaacgtaccctttacagtattcatgtattctcttaaatgccctgcaggcacatgcttccctcccacagataggttagccattaacataagcccatctgtattcccattggtagcaagatctcctgcagcctgttcccagagatcccgacccgtaacgcacgcttgacgttcccgctcgctactcacagtagtttcgcctggagtaaacagcatcaatcttagcgcactatacgcaccagctttataatcttgaggagattgtccctccatagaacctagcttactttgaatatgtgtagccaaagtctgtttattctgcgcacgcaaatctgcttgaataattgcgctatctaatttcttatctcctgtagagacaataggttgagctccttgtccaaaaatagtcggatgataaatatctgcctgagtgataacaggtcgagatggagtagtagtgcctctattacgagagaaacagttacggaataaatcggctattcgtacgcatatcccttgaaatcctcctcgagaagataccgtatggcctccgtaattaggcccagaggtcgattgcacaagaccgtcttgattatcgttagaaggattaatagacgggtatccatttccactcccattagtaggtcgaatactcataaatcctccgccgaagcaataacttttaattccaactatttttattaaattttaaaaacttctttttaagaaaaacaattgttctgtttttaaacgaacgaaaattagtttctaattaattaaaaacaatggggttaagagttatcttttttgcaaaggatcttaatcattctaaatctcgaattcagacctccttttaaacaaaaaaaagccccgataaacagggcttttcattaacaaagaatgcatacgcagatatttagctttgagctggagatagtatttccgtaccaggaagactacctttttctaagaattctaaggaagcgcctccccctgtagatacgtgggagatctgtgaagtacaccctgcaagagctactacagcagccgcatcgcctcccccaaccacagtcacagcagaagaatggctcgcgagacattgtgctattgccttcgatccttgatcaaaaggagggacttcgtataccccgacaggaccattccaaaatatcgttgccgactcctgaatcaccttagaaaatagttctattgtctgtgccccaatatcaaaacctgctaatccttcagggattccttcctgtatagacagctccctccaatcctctccagagtcacactgtttagcgaccttcgcatccactggaagatggatcttcacccccagagcttgagctttctctaatacttttttcgctaaagggatccctgattcttccactaatgaattccctacctggcgattcatagcccttaaaaaggtgtaccccatacccccagctaatacgagatgatccacgcacgaaagtagcgcctcgattactcctattttcgaagacattttcgcgcctcctaaaatagcagtgaaaggacgtttaggctcaactaatagatgctggcccaaaaattctaattctttttccataaggaagcctgcggctgcccggtcagggaatagttgtggcacccgatatacagaagcatgcttacgatgagatgtcccgaaagcatcattcacataaaaatctgcataagcagcaagctcaatagcaaaactaggatcctcgtcaggatgttcttcccccttatggaaacgtacattctctaaaagaagaactctaccaggagaaagttgcgcgaccgcctgtcgcgcgacttctcctatacaatctggagaaagaggcacatgatgccctaaatacccctctagcacaggaacaataggagctaatgaatatgcctcttcaaatacgcctccctttgggagtcctaaatggctcaccaaaatgactgctgcatcttgtttcaaaagataatggatcgtaggcattgcgctacgaatacgcacatcatctaaaatctttccatctttaataggaacattaaaatctacacgaactagtacctttttcccttcaagagaaaggtctcttatcgataatttatccatgcttatctgatccttaacctaaattttcttataggcctaagcaaaggaaaactcaagcctttatctcagtgccacatgaagaatcgctcagacaaaacatttttagtctgcatatagtctgcatatagagagttgcgcttaacaaaatagtgcgcgcagtaacaaaaaaaatacgatagaaagcgccgctccagcaggaactgtaataaaccacgaaagcacaatatctttaatgatccgcaaattaatggctcgtaaacctcttgcgaacccaatccccaataccgatcctacaacaacatgcgtagtagatatagggaatcctaaggaggaagcggccgctatagtgatagcggaactcattcctacggaaaagcctcgtgatggagtcaattctgtaatttttttcccgatagtatcaatcacacgccagccccatgttgctaatccgcaaactaaacctagtcctcccaaagacataaacactaagagaacttttgaagaataactttggggatagagtgtccggtaaatacctgcaacaggagcgatcgcattagcaacatcattggatccatgcgcaaaagacataaagcatgcaatgatcatctgtaagtaagcaaaaatgcgttcaactataagatacttacgcccataatcggtgcttttggataacaaccgatctaataatgttccaggaagaacttcctgaggaagaatcgcaagtttaaagaagcgtattccccatatcgtgaagaaaaaagcaaaaagagataaaccacaaacaatacgcaacgctggagaaaaggaaataacgggagcaactgcaccactcaggataaggactagtcctaatgcaaaaataatgatcgccgataaaaatggcgcgatacgcaccatagcagagacgggatcctttttatataggatagctttccgaataaaagagaagatgaggaaagcaaagtatcctccaataatgggagatgctaaccagctgacaaacactcggccacaagaattccagtagataaccgcatcctctttaaggatgataccgaagcccaacactgcgcctacaatagcatgcgttgtcgacactggccatccacagaaagaagcgatctgcaaccacacgccagtggcaagaagcgctgcagccatcccaaagacatagtcttgggatgacaacacatgaccggaaggagctaccagcccactttctatggtgccgataactcgatctcctaacaatactgctccaagaaattcaaagacggctgcaataagaacggcttgctttagagttagcgcaccggctcctacacttggtcccacagcattcgctacatcattagcgcctatgttccaagctgtgtagaatccgcctacaactacacaaaccagcagcaaccacatgcctatttctcttctagcgtcatactcactcgataagctagtttctcggaattattagatatccccgatatccccttaataatctgcatccagagaacaaatccttttgtccctatagcaaaatcgtcagagaagaataccttcattaattccctctgcaataaatcgcactcatgttcaaggttagatacttcactcactaaaacacgagttttgtctgcccgatttccaccgaaagaagattccaaaaggcgatccatctctcgtatagttttcgcaacagcttcgaaagattgcacagtcttttgcagaaactcgaagaacaactcctcaaattctggataaaactgcagctctttcactgtcaacaaaattgcgatatcctcagcanatctgctaaggaatcttgtatcgaaatgatctccaacagcgctgcgcggaatacaggaagaaatactcccgaagccaagtgtcttcttacatcgtttttcataccatcagcttgccgttcttttgaagaaacgagctgagccaacaccccaaccctttcataatcgccttctttaagagcgctgaaaagtgggaaaagaacattgatagtcgaagaaactaattctaaatgtgcttgtaatggagcaaaaggagattgaccgaataaacttgctaggacttgcatataagccttttttaattgtctttgagaaaaatgctcccaaaatatacctccttcatatatatatttgcaatctagaatgtactaagaaccaaaattttttgtttttttctaagatttttcacgctcgaggtccccttcaaatagtaggagatacatagctatgtgtgctcagccgcttctgcaagttaaaaatctttctgtatctctaaatagaaatcgtgtatcatttctagctgtggactctttgtcctttgatgttttcccaggccaaactctggctattattggggagtcagggtcagggaaatccattacagcacaatctcttatgcagcttctcccggaagagagcttttctctttcaggagaggctctttttaataaagagaatctcctcgatcgtaagaatacaaatgcgaaagtcctgtttggatcaaaaatctctatgatttttcagaatcctcttgcttcctttgatcctgtttttactattgaacaacaattccatgaagtcattcgcacacacttaggaatttcgaataaaatggctcatgagcaaatgttagctgtattgcgagaaacaggattccaagatcctgagcgttgcattaaattgtatcctcacgagttatctggaggaatgcttcagcgcatggctatcgctatgaccttgctgacctctccagacttattaatagcagacgaacccacaacggctttagatgtttctgtgcagtatcaaattctacaactgcttaaaacattacaaaaaaaaactgggatgagtcttttaatcattactcatgacatgggagtcgttgccgaaatggctgacgatgtctttgttttgtacgcaggccgtatggaagaatattcttctgtccaagagatctttcattctcctgcccatccttatacagaagatctcttagcttctcgtccttcacaatatagacagcagacctttgttcctattgcaggacagcctcctcattacacaagacttcctaagggctgttgctattctcctcgttgccgtaaagctcagcctatttgctttgaaaaatccccggactccctatctttaaatgatcatcatcgtgtgaggtgctggttacatgaataatcctcttctcctccaagcaagccgcttgactaaacattattacaagcgatctttctggtttcagaagaaaaaagtggctactacgcctttaaatcaggtgtcctttagccttcctagacataaaattatcggtctcataggagagtctggatctgggaaaactactttagctctggggcttgcagggctcattccattaacttctggccatctgatactcaatgacaaggccatccctctacataataaaaaaggaaggcaatatcttagttctcaggtgcggatggtgtttcagaatccccgctcatccttaaatccgcgtaaaaccattttcgacacgttaagtcattccctactctatcatcgtttagtttctaaagaagaacttggtgctacagtagaaaaagctttatctctggtggggctctctacagattacctttattcttacccacaccagttatctgggggacagctacaacgcatctctattgctagagctttgttaggagccccacaactgattatctgtgatgaaattgtttctgctttagatctatctatgcaagcacagattctgaacatgctaacttcgttacagcaacaagcgcgactcacctacttatttatttcccatgatcttgcagtcgtccgttcattttgttcggaactcattatcatgtacaaagggcagatcgtagagactggggctacggaagaaatcttttgtaatccgcagcattcctacacacgaatgctgctccattcacaattaccctgaatttcccgaggaccgccgagacgtgcaggttcctttaagttaagatagcttcagaagaagatgttgttaaagctttttccaaagcttctaacgcttcctctccttctacaaaaaatgatacgcatatgcgtcttccctgaggctttaccgttacaggatagccaaaggttgttgctaaccgttcttgacaaaaccctagtcgagaagaaggttgtgaagaactgtcttctttcaaagaagctcctttacctttcactagacgtttagcctccatctctgcctcgcgtactgctaacttgcaggagataattttctgactcagaatctgtctaagattttcatcttccaacgataagatgactttggcatgccctaaagagatctctccagagttcattttttcttggacctcttgaggaagagagaacaaacgcagataattagctactgtcgaacgcttcttcccaacttttttagcaaccttatcttgggtaagaccaaaaacaacaatcaaacgtcgaaaagcttctgccatttctaaagggttcaggtttaccctttggatattttctattaaagtcgcctctgctgccatatcatcagctagcacctgcttcaaaacaacagggaccgttttatatcctgctaattgcaaggcgcgccaacgacgctcaccagctattaactcataatacaaaaccttatccccattacggatctccctaactacaggaggatgaatcagtcctaccgtcttgatagaaagaactaattcttttaaatcttcctcaagaaatgtacgtcgaggttgaaaagggctgacccggatgtcctctatattcacttctaaaagtgtatcttcgctaggtaatctactcacaatattttcctaattcacagcccaattcgttgtattctacagacagtcctcagaatacaaaaactcaagatacaaaatcttataatgcaaatcaagagatgcccactccgcatctctcttgaaaacggaagcgcattacgaacgatatgctcgtaaaatatctttcaaagcttctacgaaaagaagaatatcttgctgatcattatagatacccaaagaggctcgcagaacatgtcctaaatcccaacgcaccatagctggctgtgaacactgatgcccagaacgtacggaaatccctctcccgtctaacaaaaaacctaaatccgaagcttgcacaccaggaatactgatactacacagagaacctcgtgcagctccctgtttagggccaatgatctgaatacctggaactgtaagtagctgctcgtataagaaatgagtaagctctgttaaacgatctgttatcgaaaaaggaagagcctgcaaataatcaatcgccgcacctaatcctaatactcctgcaatatgtggagtccccgcctcgaaacgcaacggaggttcttgatacgacagctcttcaaaatcatatacgatcaccatatcgcctcctccttcaacaggaggaagcgattccaaaagttcttttttgccgtatagaacaccaattccagtaggagcatacagcttatgaccagaaaaggcatagaaatccactccccattcagaaagattaagaggccctttcccaactccttgagctccgtctacagcaaataaagcctcgtaacggtgcactaaatgagcaatttctggcaaaggaagaactgcccccgatacattactcacatgagctaagcttaccagctgtacgccttgttttaatagttgctcgagatggttacaatctaccatcccttcatcatccacacgcactttttttatggtagctccggaacgttgacaagcgagttcccatgatacgagattagcatggtgctccgcctcagaaatcacaaccgtccctccagctaaccaactatcgttagctgcaatagcgagtaggttcagtgaagatgtagttcccctggtaaaaatgatttcttggtcatattgcgctccgatccacgaacctacttttgaacgcacttgccaatgtgcaaaggtgatatcatgagacgctgtgtaaagagctcggtttacagtcgcatatgaagaactatagtaatccactatagagtcaatcacacactgaggcttatgtgtcgtagctgcagaatccaaataaacataaggatccccctgattcttaaaaatagggaagtcttttttcacattatacatggtaaagatcctgtttctgcagttttgggaaatacggtttctctatatctaacgtcaaaaagctcttttgtagagcctgtttggcttctattaaactaaatcctcgagatcgaagataggtcaaaaggtgcgcatttaaagagcccacagtggctccatgcgaagctttaacatcgtcagtgagaatctccaaccgaggaaatgtggatgcagaagctcgattacttaataagagggtatcgtgcttctgataagcattagatagcgtcccgcgaggactaatatagatgcctccctcaaaggagaagctcccctcttccaagatggagcgaatattttgacgcgaagtagtctctcggtcatcatgatgcatcgtgttatgcacacctagaaaatctccacctaataccttaactagagattctccatgagcagcttctcctttcaagaaaaagctattccggaaccagcctttccccattgaacgcatgtcttggatcaatgcgcaagcccctcttcgttcgacttctacatgatgagcccatatgattctttctgtccctttaggaagcggcttcatggtcaaaacaagctctgcttcctcgcctaggaaacagagcgtttttccaaaaagatatacgttatccggtagggcagacattcccatttcaatcgaaatggcagctcccttccctaaaacaaaaactatataggggacgctcaccgtcttcttattttcttcctcgctacagacatagtgatgctgtacaaataaaggtgtttgcagttctctaccttcaggaatatagataactgtcccttcttctccacgaagtaaagaatgcaactcttctacaacatcttcctcatcgtgcttctgaaaaaaagcacgcgcttcgcgtaaaggggccacgatgatttctgcaggcaatacagataaagaaggcgcaaaacatccatttacaaatacacaagttgcggatctctcttcaggagaaatggctccaatctcacatcctcctacacaatagatccaagaatcttcttgtgtcatttccttcaaccaggagcaagcttctcgaaatacgtgatcgcgttgatactgacgccatacagagcgtgtaacgtctgccagtcgtgcatcgggatgaatctgtctctgctgatgagtcccccacatagtttactcctgggtaacgacatctaataattcttgataactcttcctttctagctcttccataagatgcatgtctccggaaaagacaacgcgtccattcaaaagaatatgtacatggtctggctgcaggagatcacctaacctaggattatgcgttacgatacaaaaagcggtctcaggatgctgttgacgatagcgttgtaaaacagaacaaatccctttcaaagcatcgacatcaagacctgagtcgggttcatccagaaccaccatcttaggctctaaagccaacatctgccaaagttcgtttttctttttctctcctccggagaatccttcattcacattcctattagaaaaaaaatgaaatcccgggaatccatatacctcttccagatgcgtaagcagctcttcaaaagcagcatcatctaacaccacttgattgcgagcttttcggcaggcattacaagcttcttttaagaaaatacggttgttcaccccaggaatttccggaggatgttgaaaactaataaacatccctgcatgagctctctcttctggagatagctccagtaaatcctgcccagccaacgtcattgtcccagaagacacctcaacactctcatctccagatagcaccttagctaaagtggatttccctgcgccgtttggccccataataatatgtagctcgccaggatgaatggataaagatagcccttccaaagatctttttttcttcacaacatacatgtacatcacatagatgaagcatttctagcctacactattttctaacttaatcattaataacttggttgcttcccgagcaaactctagaggtaatagctctataacctccctacagaaaccatgtaccactaaactaaccgcttcttccgtattgaatcctcgactacgaagataaaacaactgatcttctcgtaatttagaagttgcagcttcatgttccacgcaactctctccattgtttacaacaatttgtggatccgtataagccccgcagcgctctccaacaagcatagagtcgcctgcgtgtaattacaacttcccactgcctgagaagaaatcgaaaccaaactacggaaagtattgtgagactcttctgcagaaattcccttagaaacaatggtagatgaagagcctttcccaatatgtaacatttttgttcctgtatccgcctgcatcttcccattagttagtgctatagaatagaactcacctacactgttctctccctttagaatacaactcgggtatttccaagtaatcgcagcacccacttccacctgagaccaggaaattttagaatgctctcctgcacataatccccgtttggtaacaaaattataaatgcctcccttccccgtcttacgatctccaggataccaattttgtacggttgagtagcggataaccgaacggttatgtgctaccagctcaacaacagcggcatgcagttgatgcgaagagaaagaaggtgctgtacatccttctaaataactgacataggagtcatcttccgcaatgatgagcgtccgctcaaattgtccggactctttatcattgattctaaaatatgtagatatctccatcggacagcaaactcccttagggatatacacgaacgacccgtcactaaacactgcagaatttaatgccgcgaagaaattatcccgagctggcactacgatcctaaatagcgcttcactaaatcaggataattgtggattgcctcccgaaatgaacagaaaatgactccagcatcttccaaagtttttttgaaagtcgtccctatggaaacggaatcaaacactaaatccatagcaacatcctgcacattgagaagccttttttgctcatcaatagggatgcccaattttttaaatgtctctaaaatttctggatctgcgtcttctaatttccctaggggtttctttgttttgggggccgaaaaatagacgatgtcatcataggcgataggtggataacgcaggcgagcccatgtaggttcttccatcttttgccacaaacgaaacgcttttaaccggaaatctaataaaaatttaggctcgccgcgtaaatgaaccaattgctctatatgttcttcactaatacctggcgctaacccttccgactgtatcggagtaacaaatccatagggatattcctgctgctgcagaaatttatctaccggtgcgtccatgatcctcctctttcatcaggatgccactctatttggagtggagctcgtgagaaaagagcctattatctcctctgtctcaaaaaaggcaaaacaaatcctgaactgcaattcgagatatttttttcgaacacctttttgaaaaaaaagaaagacagcctagggaaagaggatgtctctccctagacccaaggaaaggactgtcaaacagcccttaagaaaaaaacttgttggccacggatcgtaaaaaaaatggaatttttctacaacacaaacaaataaaaaatcaaaaaatcgctagacggtcagagagagtattgctaagcaaaaaagggttcgcttgttcaaaataatgtctcctttttactcagaaaaaccgagctgcttacggttttttgtaacaaaggagcaaacacagattctttagcaaccaaaaaagaaagttccgtttctgctttttcagactcgccttgcatatgatgtaaatatcccaataaatagtgcgaacgttcgtgatctaaattgatccccagagctcgataaaatgcatcatatgcctgctcattttgcttaagatccatatgagctaatcctatataaaaatgcgcatccgcatcttctgcatttaacagcaaagattcttgaaacgctttcaatgctaatcgcgttttatctagcgttaaataacataacccaagattgtaatgcccaacccaaaaaacaagaaccaaacgcaaaaaaaccccaaaaccctcccgtgcaacaacccaaaacctaatttctagaaagtaaataacctaatttaacccaagctttccaatatagagggtttctcttcaccgtagattctaataaatcaatagcgccttcctcatcctccatatctgataaaatgaccgctttattgtatagaccttgaggattccatggatctaactgcgcaattcgatcaaaacaggcaatcgcttcttcataacgcaataaacgatgatatgcactccctaaactaaataaacattctatatcttcaggatgtaactctgcatacacttgataatgcccgatcgcttcttctaagcgatcggctttatctaaagccacgccataacaataacgtaaatagctgtctccaggctcagcttctaacccttgcttacaccaaaccaaagcctcagctgtacgtcctgtttctaacgcaataatccccagataacaataggctagcccagcttccgagtctaactctaaggactctttcaatctctcttctgcttgctcgtactcaccactcaaaaataaattaatgcctgaacacaaaaactctttcgctaaatgcttttccgcctcttccatagtcgttccctgtcaaagtaataccttaccttttacaggagcaaaaaccatgccaatcacgaattagctgaaagattttttacgaatctcttcccatttctctatcatacgcactgccataggcgcagatcccttccaaactctcctagccgtaagtacacaacaacaacaatatccggatgagataacgcttcatcttcatatcctaccgcagcgaaccacacgtctttcaatttcatgcgtcctcgctcacgatctaaccctactcgcgcaatcacttctgctgtgctcgttttgccaataatacgagccaatcgttcaggagcaaaccgttgacgcatgaaccgcgtcgtcccgtattgaccccaaatcacgttatgcatacctctcttaaatagatcgacgatcgaatctggcaagaaaatttctcttttcttcttagcttgttctggagaaaaacttccttgataccactcaccttgtatcaaactcggctgatagacaatccctccattaactaacgtcgccatcatcactgcggtttgtaaaggagtcaccactaatgtatgttgcccaatagcagtcgcatataaccccgaacggttatatgcgacatcgataggcactcttccagcatattctccaggaagtcctatccctgttttttctccaaaaccgaagagtttagctgcctcgcataaatcttcaggatcagaaagatattcactaacgagaagagaaaaatagggattgctagacatctccaaagctgcgatcagatcgatataccctctcccagaataatcattcccaggcagaatccctcctttaaagaaagaagcaataggagagccgtctttaaaaaatccaacatgaggcttcccagaacgcagccccagagattgcttatctacgatcaccaataacttagataaatcttcttggtcagaaagatgctgcacaagaacggaataagcagatactaacttaaaaatagaccctaaagtcgctgcttgaccgaaagcatgagcagatagatgcccataaccatacaatgggtaaaaagaagcgatcagatcctgctctatttgctctatgttccgcgtcagtgttagtggatattgtccatatagaggacgcttaagctcagaaaactctcgaaaagctgcaaacagttcgcataaatcataagaggtctgcgacaaatgcttatgtaaaaaatcgtaatgctctcgccattctaaagcagggtaggcgccagaacgtagttcttggcgccaacaagcaatctcctgataatagggattaccaagaggaggctctatctctgacagtaaaaaagtaataaaagaatccatatgctctcggcaaaaaagagcatattgccgagaccgctcttctactaaataatccacataaggggttgggtatcgttgcttcctctccaactcctcatcgcgtttctgcttaataaactgtgtgaaatgctcttcacgccaagcggtaaaatcatgatcgataaatgcattctccatcagtttagcaaatgatttccgcaaagcaatgaaatgcccttgataatctacaaaatccaagacagacatatggccaatttctgctaataaagagatagagactttttctggatctactgccgtacgcaatagatccagaaatagaattttatcgtagttggcagatagatctgcaaaaatagagccaagacgctcgcgaaaagcttgtacctcttcttctctttcagcaaggatagctttaaactgtttctgtcgtttaagagatgtgacctctccgataatctcatgcccatcctctttagggaatagaacatcaaaaacgagaccacactctttttcttcacactcaaacatttccaaaagctgctcgatcgttccttgcagataaatagaaagcccaatagaacctttctcgcatagcatctgcttaactttagacgtgtctggcaaaataaaatctaaaaaagctcgatacgaaaaagagagctcttcatcaaaatattttccactgagaggatccaatcgctctcttcgtaaaggaacgcgtctatcaaatacttctccgatgtactcaaggttttccagccatcgcaatacagaagaacgacactcctcctgattaggagagtctttcatattgataaagtcattattgtcataacgtggtgaagaggccatcgctagaatttgcccattcttaggatccatagcaacaatcgccccgccttttatccaagggaaaaaaggcggcaaaatattgttgctgacgccactgtcgataatcgtgaaacactcacctcgctcatgttctgcaaggagctcatgagcaaaagcttgtagctctgtagagatcgttaactggattgttctacctgggcttccaacagaagaaccttccatctcctgaataaaattccctcttcgatctaccagcatagatcgcttgcctatcaaacctcttaatttacgatcacaaaaagcttctacaactaatttgccgatcaaggagtttaatccataggcatgcatctctaactcatgcaaaagcttgcgtacttgatcgacgctcgatattcctgcaggaaatttaggatcctcaccctcttcataagcacgaatgcattctcttaggtttcctaactccctcgtaatttttctatgttcttctgcgctaataggtccgacataccccaacaaatcagctactgtgcgcccttcaggataatgtctgcgaaccgaagattcgacatgcaatcctggccaatccttctccagcatcttgagccttaaaaaagtacgctcagatacattagtctgaaggatgtaaggtacagaccctaatacagaagctttggcatggatcgtatcttcaacgaaatcacggtccatatgcagctcttgagccaaaaaatctgcaaattttttaatgtaatccttacgaacaggaacaagcctcttattcccttgctcatctgtatgccaaacacgcgtcggaatatcacgtatcgctcgataagagatccccacattatattgtaaaacgttttctgccagcgttttaccaaaacgatcacatactcctgcgcgatcacaatgctcaggaacacttctacgctgaggacgataagcttcttccttctttttctcatgctgcacaacagcaacatgccatatacgcaaagtgatgatagacaaagcaataataaatcccacaagtagtctgttagccttttctggcacagaaagtggggtgcgtcgttttcttttcatatatggttagatcaatctgtttttattggtcgaccgtttaaaaacactttcttnntagtaataaaaacgatttctatcaaaacaaattcttagattttcttacaaaaatctcctcttttcttttagccaaacccccatcttcgagctattccaaacacaaaaatcttaggttttggaaattaacaactcataaaaattgaactgttttgtaattaactcaaaaccctctcattctcaacaatcaacatattgccaacatggcttttgctctcggtttcagagcgatttttttcgcaaaaaccaagaacataaaacataaaaagatatacaaaaatggctctctgctttatcgctaaatcaggaggcgcttaagggcttcttcctgggacgaacgtttttcttatcaactttacgagaataagaaaattttgttatggtctcgagcattgaacgacatgttctcgattaaggctgcttttacttgcaagacattcctcaggccattaattgctacaggacatcttgtctggctttaactaggacgcagtgccgccagaaaaagatagcgagcacaaagagagctaattatacaatttagaggtaagaatgaaaaaactcttgaaatcggtattagtgtttgccgctttgagttctgcttcctccttgcaagctctgcctgtggggaatcctgctgaaccaagccttatgatcgacggaattctatgggaaggtttcggcggagatccttgcgatccttgcaccacttggtgtgacgctatcagcatgcgtatgggttactatggtgactttgttttcgaccgtgttttgcaaacagatgtgaataaagaattccaaatgggtgccaagcctacaactgctacaggcaatgctgcagctccatccacttgtacagcaagagagaatcctgcttacggccgacatatgcaggatgctgagatgtttacaaatgctgcttacatggcattgaatatttgggatcgttttgatgtattctgtacattaggagccaccagtggatatcttaaaggaaattcagcatctttcaacttagttgggttattcggagataatgagaaccatgctacagtttcagatagtaagcttgtaccaaatatgagcttagatcaatctgttgttgagttgtatacagatactacttttgcttggagtgctggagctcgtgcagctttgtgggaatatggatgcgcgactttaggcgcntctttccaatacgctcaatccaagcctaaagtcgaagaattaaacgttctctgtaacgcagctgagtttactatcaataagcctaaaggatatgtagggcaagaattccctcttgatcttaaagcaggaacagatggtgtgacaggaactaaggatgcctctattgattaccatgaatggcaagcaagtttagctctatcttacagactgaatatgttcactccctacattggagttaaatggtctcgagcaagttttgatgcagacacgattcgtattgctcagccgaagtcagctacaactgtctttgatgttaccactctgaacccaactattgctggagctggcgatgtgaaagctagcgcagagggtcagctcggagataccatgcaaatcgtttccttgcaattgaacaagatgaaatctagaaaatcttgcggtattgcagtaggaacaactattgtggatgcagacaaatacgcagttacagttgagactcgcttgatcgatgagagagctgctcacgtaaatgcacaattccgcttctaattaattgtataattttgttaaactttggcaagtttatctttgttaataacgttaataacactatccgtgtttctgggctcgacttcggtcgggtccagttttttttgcaaaaatttttgttcttactttcgatctccctcctatctctcttaccaacaaaatctaaaatttctctaaaagaagattgcataaaaaccctcttttccaatactatatcggtctacttgagcgcgcccgtagctcaatggtagagctgtagccttccaagctaccggtgtcagttcgattctgatcgggcgcttttttactcctgtatgactcccaagtctgaaatctgagcgtctctcagatgccttgttaacacataaaaagaggaacaaagcttggaacttccctgcaaactcactttaaaagaactattagaatccggggcacattttggacaccagacaagtcgctggaatcccaagatgaagccttttatttttgaagaaaaaaatggcctttacatcatcgacttggctaaaactttaggtcagttgaaaaaggctgtttcttgcattcaaaaaactatcgatcaagagaggtctattttgtttgttggaacaaaaaaacaagcaaaacagatcattagagaagctgctatcgaatgtggcgaattctttgcctcagagagatggttgggcggcatgttgaccaacatggcaaccattagaaactctgtgaagacattgaacagaattgaattggatcttgaggcttctaattctggtcttacgaaaaaagagctcgctttattagcaaaaagacatcgcaaattgctcaacaacctggaaggcgttcgtcatatgaactctctcccagggcttctgattgtaattgacccgggctatgagcgcattgctgttgcagaagctgggaaacttggcattcctgtcatggctttagtggatacaaactgcgatccaacaccaatcaaccacgttattccttgcaacgatgattccattaagagtatccgtctgattgttaatacacttaaagacgctgttattgatgcgaagaaacgtttaggcgtcgaaattttatctccggtgcgtcctgcagaaagacctgcggaagaagctgttgaagagcttcctcttccaacaggagaagctcaagatgaagcttcttctaaagagggggttttactctgggcagatattgacaattgcgaggcattgaaatgagcgacttctccatggaaacattgaaaaatttaagacagcagacaggtgtaggcctgactaaatgtaaagaggctctagagcatgctaagggtaatttagaagatgctgttgtttatttacgtaagcttggtcttgcctctgcaggcaaaaaagagcaccgagaaacaaaagaaggcgtgattgctgcacgagttgatgaacgtggtgcagcacttgttgaagtcaacgttgaaactgattttgttgctaacaacagtgttttccgagcattcgttacgagtttattgtccgatcttcttgaccacaagcttagcgatgttgaagctttagctcgcgtaatgtcctctcaagagccttccttatctgtggaagagcttaaagctgtcacgatgcaaacggttggagagaatatccgcattagccgagctttctacacgcctgttaactctggtcaaagtgtagggatttattctcatggaaatggaaaagctgtggctatagttttcctttctgggtctgagaatcaagaggctttggctaaagacattgctatgcatattgtcgcaagtcagccacagttcttaagtaaagaaagcgttcctcaagaaattctagaaagagaacgagaagtattttcttcccaagtggctgggaaaccccaagaagtagttgagaaaattactcaagggaaatttaaagcctttttccaagaggcttgtttattagaacaagccttcattaaagaccctgaagtcacaattcaaggtctgattgatagagctgcaaaagctagtggtgagccactcagagttgagcactttgtcttctggaaaatgggcgcataaccaaatggcgagatgatgaaaaaacgagtgaaacgagtnttattcaagatctctggagaggctctttctgatggagattctagtaacaaaattagtgaaaaaagactctcccgattgattgcggaattaaaagtcgtccgcaatgcagatgttgaggtcgcggtggtaatcggtgggggcaatatcctccgcggtctctcacaaagccagagcctgcagattaatcgggtttcggctgatcagatgggaatgttagcgacattaattaatggaatggcgttagcggatgctttgaagactgaggatgtgcccaatttattgacatcgactttgtcatgcccacagttagcagagttatataatccgcagaaagcatctgacgccctaagccagggtaaagttgtgatatgcaccatgggagcaggagctccttatctaacaacggacacaggtgcagctttgcgagcctgtgaattaaaggtcgatgttttactaaaagcgactatgcacgtggatggggtgtatgaccaagatcctcgtgaatgcgctgatgcagtaaggtacgatcatatttcttacagagactttctctcccaaggattgggagcgatcgatccggctgccatatctttgtgtatggaagcaggaatccccataaagatgtttagctttgctagacattctttagaggaggcagtctttaatactgttggtacagtgatatcttctgcggaaggaggacaattatgacactagcttctgcggagaaagagatggccggagtgttaacgttttttcagaaagagacccgtggtttcagaactggaaaggcgcacccagcgttggtagaaacggttactgttgaggtatacgggacaaccatgcgactatcagacattgcatcgattagcgtgtctgatatgcgacaacttttaatctccccttacgatgcagggacggtttctgcgatttccaaaggaattttggcagcaaatttaaacctacaacctatagttgaaggagccacggttcggattaacgtaccggcctacggaagaataccgacgagaagtaataagcagctgaagcgcaagagcgaagaagcgaaggttgctattcgtaatattcgacggacttttaatgataggctgaanaaggatgacaacctaacagaggatgctgtgaaaagcttagagaagaaaattcaagagctcacagataagttttgtaagcaaatagaagagcttgcaaaacaaaaagaagcagagttagctacggtgtagttatgcttctgtgcaacttccctattctctaaaaataaatgcgttagagaacagaaagagttgcagaaaaaaagggtttagtgataacattagacccgtcctggccccatcgtctagcctggcccaggacatcggattttcattccggtaacaggggttcgaatccccttggggtcattacaaaaagaaatgcgggtctttagctcagcggttagagcatctcacttttaatgagagggtcgaaggttcgaatccttcaagacccatttctttctctaagagatcttccctcctcatcaaaaagatttccttcctttgtttttttctgttattgctgaaagtacctcgttgtatctgcacggctttcgatatggatcatacagaagagtctcctgctctttgctataattgtcagcaacccgccactatctgttttacagaaatttctgaaaacattacctctcgatgttatgtatgtaacagttgtccatatccctctcgctattacgatcgcgagacgattctagcctcccctactcatgaagcgctcattctngagtgcggtaattgtaaaacgaaatggtgtatccgtgatacggatgagctcctattaggctgtcatctatgctatcgcacttttaaatcccttatcctatccaggctcctgcgttatcaggcgatttcatcctatacatcagagaaagcaaataactttcatattggtcgaggtttggggaattccgaacaaccaatcatcaacccagctatgcgccttattgctttacacgaggctttacaagagactctgcgccgcgaagactatgaacaagcagcagagatccgtgatcagattaatcagctaaaaaatcagaatactaccgatgctccctaatcatattcttactgctatcgcaacgatcaagcattctttgagaacagagacgccacgccctatttgcacgctctctttatctagaaatctttctgtttccaaattcgttccctgtctttctaaggaaaacaaacgtgatgtgttagagactatagccaaacagttttcggctatcgaaggtgaggaaattctttgttttaccccttaaagatttgcctatctggcaacgagaatgtttattagaacattatttgtttccatatcatttagggagttgtttggaaggtgaggctctaattgtaaatcaggcaggcacgttgttagcaggcattaatctacgtgaccacgtagtgatccatggcgtagattttgtatggcagccggaagtattactccagaagctgatcgatttagatatacgtttacaacagtctctgtcttttgctttttcttcagattttggatttttaaccgctgatcccctacgttgtggaacagcgctgatagcgcgagcctttgttcatgttccggctcttaagtatggagatgcgttatctgagcttttagttccctatcaacgtgagttcgctagctcttctttactgccgttatcacaagaatcattaggagatatcttgtgcttgtccaatatttgttccttagggctatcagaagagcagatcctatcttcattaagactagtagtgtcgaaaattttatctgctgagaaagaggctagaaaccagcttgtgaaagaaaatcntacagaantaaaaaatcgcattttacgttctgtggggatgctgacacattcttgttgtttagatttgcaagaggcattggatgccactagctggatacaattaggaatgagtatgcagtggattgaagatagtgaaaaccaccctttatggaatcctttattctgggatctacgcagaggtcaccttgctctgtataaccaagatactgcgaatagaagcattgaaaaggaagtgatcgcccagatccgggccaaggcaacaaaaccccaggcagagcgactgattattcgaatctgagagaggggacgaaggaatggttacttgcctccttcaacctagatattgacggcctgtatgtgaaaatatctaagcgactaccctaatcgaattactctgcctaggaatgcccaaagccgggatcgaaccgacgacctacgcgttacgaatgcgttgctctaccaactgagctatttaggctaactccataaaaagccaagagaaccggagatacggctaactccagtccatcttgacttcccccctgtgtacaaacactagagtcagaagctattccatggcgttagaataccaacttgcaactcttataacattattccgcttctatttccagcattttaaaattactttctgcttggaccttaggaatatgctggcattcaggggcgtgacgaggggctacctctaaagatcctctttcgctttcccagttataacgatatccttctgtgtttgataacgctgttccttcctcgaagctactgatgactttcggcttaatgaaaatcataatatttcgtttctgacgctgatcgatagaccgactaaagagtcctttgatcagaggaagagaactgagtaacggcactccggatacaatttttgtcagtttgtcacgaatatgcccactcataacgaggaaacatccatccggaacttgtagtctcgtagctgcaaatgttttatctgttacaggagtcagcacaccttgcgccgaatgtaactcagaaatcgtttgctctatctgtaaagtgactacattattaggagctattgtcgaagttacaacaagattgactccgatatcttcgtattcaatattttgtgtaacagatccggtttcctgaatcaccgtactcgtagtctggaacggaatcgtctgtcctacaaagaacgatgcctgttgtgtatcttgcgccataattctagggttaagtaccactgtggtatcgccatcttgatctagggcgctcaataacccccctaatgttaaatacgattttccattatggctgagaacgtttccaataattcctagtccgaatgcagaggatccgtacatcatatcactgatccctgctaactgaccaggtgttggcaatgagatatttcctgggttaagtgctacaggcagagattgattacggaggggatccgttaatcctgtattactcaacaatccggaagcatatgccaccttcccttgttcatctccaagagctgcccattgtactccgaagtcccaagacttctctaagcttgtctctagaatcaatacttcaatgtacacttgttttggagggaggtccaacccatttagcaagctaacgaccttatcgacgttagcttgatttccaatgacaacgatggagttgtttacaggcaaccattgaatactattcaatgtgttgatgaaatcctcatccattgctgttgtcacgtagagattgtatccaatatcttgaatcgcctgagcgatagctgccccattttgatattttaatttgtacatgaagaagcgcaaactcttaggattagcagctccagagcttcccaaagcagcagcaggacttgtgacatcgtctaacgtatgtgccatttctggaatgtccaaggactccaataattgaattgtctttgctgttaatcgtggcgaggaaataacaaaaattttattggtcccaggctgaataaaaatttgaaaagcctcttcctcagccatggcaccgagaacatcctgacaatagctgaccaaagcagcgggatttgcaaactgcacatcatattccgacatgtcaatagcggtgcctgggctatccaatgcttgcaataactcccggactttctcaatatttcctgctatatctgatacgataatgtgtctcgtagactcggaagcactaataattgcatcatgagagagcagcggttgaataatgcctaccgcagcagaaggactgacgctgtacaaacgaaatactcgtgtaactactacagcttcacaagtatcttttgctgatccatctgtgactaccgtggaaagcttggaaagcttcggattgcggtagatcaatacgttatttccttgttcaacgactttcaagtcatgcattttcaagacttgcaacagaatcgttgctaaatcatctacggaagtaggatcgtgagaaacgatagtgacattgaattgcaagtcattgctatcaaaaacgaaattcgttcctgagatcttgctcacaaactggagcagttctaagatagaaatgtcctcaaaattgacagtattatccgacttctttaagatcctgacacgtcagagaacgtttgtttaatcgctctagaacttttttctcttgcttcttgatcctgagaacagtcttgtaccgtttggataacaggttctccggatgtatgtggatctttcttcccaggaagagtctggtcatttcctggattggaaatggttttctgttgctcttctatttgctttcttacactgaaattgatggcattcacagcacgacgagcataactctgtttctcttcccagagtttagaagcttcttcttcttgtttggatacctcctgttcaagagcctttttttcctttgcagcagctgcctgcttagccgcgccttgtaagtatcgagactccaaaggacgtcttctttcctcaagtttattcacctgttgggaagactgcgtaaaattaggagagaaaatctgatggctctttttaaaatgccgtgtttgtgcgacaggagcttgtggctttgcaggagctgcctttacagaaactggccgtgcaggagagggagctcctactgtaggtttagcccctggagagcttttctttgctaaattcttagcaatatttttagggcaagcagcgatctgctgttctgcctcatgataattcggcaaagaagcggactggcctattaagccttcgccagatcgtgaattcacacttaacaacgccgcatctagaacaactaacgcagacaagaggcctaatttcttgttattttgaatgattcttaaaatcttgcttcctatgttcgacgtcactatgttcaccggactctttttaagctgataagtgttgagggataaagacttctgtcatacttctgccttattcccttctgcaggttatctgtttcgcagaatatatctatttgccctctatcttgcaacttcaggaaagaagggcaatataaatataccaaatctctagcttttggggtgtgtacgataagctcatctccaggctcccacaaaaaggactgttcgtggatctctaggggagtttcctccccaattccttgcgattccgcttgaaatcgttgcaccccccctgtttgcttttttaacgagaaatcagttttcccacaagaaaagcacatgagttcttctaggaaaaatataaaacagcaacaagaaatcccttctttacaaatagggatatgcatggttttgcacagagtatccatacttttgattactgtttgaatatcttttgctttctcctctcgttgattaagaaactgtttcatcatgctaagcgcaaaactacagtttcctggagcgtagagaaccaaaattctgctacgtttccagatgtaagcatatcatagtaaatattatgtaaataacagggctctttttgtgagtaaatatgaacacagatctcttccggagcagataacttttctggagatagccacgctctctgattgtgccactgttctatctgtgcaacaacatggtctttcttacgataatcctcatgtacatcgtgcaataagtaatcttgtaaagcttctgcaaactcttgcatggatgaaaagcgtgctgccggtgatggctgtaatgcctgtattaaaattttgctgatcttagaaggcagtaacgatacatatacctttcctaatgcaagctgccccatgatcagttcataggccaacaaagctaaggaatacacatcggatgccggagagggcggttcctgtctgctctgctcaggactcatatatgctggagatccccaatgattgaattgccaagcggaaagcccatagtcaatgagcttgatctcgcctgattgcgagagcacgatattttctggtttgatatcgagatgtaaaaccccatgccgatgcagagtcgtgataacttgcgctacttgcaagacaatagaaatcgctttatccaaagagatttgcgatgaaagaatactatctcgcagagaactccctaaaatgtattccgaaaccaagtagcgtccctgctcacactctcctctatcctccaagcgaacaaacgctgggtgcgttactagctgcataatccttgcttcttcttcgaaagcacgaagaaaacgtcgatcatgaattcctggcgataccaatgttttaataacaacaggacgagaagagtgctcatccacaccttgatagacagtcaaccctaccttacgactgagctcccgtgttaggagatagttcgtcttagaggaggagaaggatacacccgatctgagcataaaaacttacggtgtgacaatgctttcagaactcgatacctctagcattttgctaggtccttgccgcttgtgaaatagcggcaagcaaacaattctcacgtagaatgacagaggactctctattactaaaaggcttatacttctaaaactcgaatccctagaacatcttgcaaagcaatgatgttaccacgccctacctgagctccattcagaataatatctacgcctaaagttggatgtacaccatcgaattgcaatacactgccaggtcctagtttcaaaaattctccaacggaaagagaatagcgagctacttcagcaacgatttttgttgccgaaggcaaagggagttgccggacctccttcactaggttcttcaggcgcctcttctggttgcatctcttgcaatcctgtaattttaaaagatcccgactgcttatctaaaaaccgtccaccaaaaaaacgggtccgttgaatggacaagaaagcaccagcatctcctgtatctggatcatacagacaagcatctaacaaaataaaactaccaggaacaacctggtgccaatcttcttctgaaatttgacaaaagcctacttctacagcgagagtaattggggtttgcaaatcgactttttgcatatcaaaagcctgatctttctcttctaagaatctacaaggctctgcgctgtagtttcaggcactaagatagaaaaccgtatacaagatccatctaaacaacaagagacttggatcacatgatactctccctccaaagcacgcgcagaaaaagcaacatctcctgttacttttacagacatagaaggaatccaaggactttcttgaagcagcttgcagatctctgcaacaaaataataatgaaatcctaataaacgatctttttcgtagaagtaagaagctaaggaactatcattaaaaatcgttcctattagagcttgcaaatcttcttccgaagaaactatgtaaaattccccagattcaaaggggtttgctaaaaacggttggagcaaaatacgctccccatattcctgtacagcagctgcaacagacagaagccctcgagactcaaatgacaattccacttcttccatatggaatttatctttgagtttctgctcacactcctgctttggaaaaacaggaaaagaaaacattccttccttctgttcttgcaaagaacttagtaactcgtctctagcttttaaccaattactactaggctctgctgcaactgccatgggaataccttatatatgagcttcttctactttcttctcttgatgctggccttgatgttgatcttgacgaccttcgccttcttgatctccttcttggtcatgatgccgaatagttgcagcaatcatatgcaaaggagtttctattttttcaatcataggcaaactaacagctacattccctacaaccaactctgtaagatttaactgacgagctttcaaagactccaccaatgagactagctgcttaggattctgctgtacgagttgtgtagcttctgtaagctgagcttggtctacaaaattcgaaaaggaaacggaaatttcttcccctgtttgtaccagagtcaggttagctccacagaaagctgcaggtactgtattgctattatccaatacaatttctactaactgcttgccatcgatatcggcgactaacagggattctacagtagatgttaccaattgctctacccattgtagatctacctgacttaccgtcatcgtactcgtttccatcatagcttcgctcactacagccataggagtttcaactaatgccattccggatgtaggattgccaccagtgaagaatccgtctcctttgctctcttcttcttctttagaagagacgcctgctgtactctcatgaacagcaccctcttcagagcttttagaagactcttgtcgtgacgaggttcttcctggcatccgatctgctttctcttgtctagtcgaagatcttccttctaaagagaacactcggacttctctttgatctctaggctcatgagcctctgtacgtggatgattatgatcaatctttgcactaaacaaagattccgaagttttatttaattccataaattagttctccccagattcccgttgtttttgcttaagtaattgatgaagcaactgccccatctcatcttgctctttttcttcctggcgagcctcttctttcagagcttctttcatccattcttctttatgcagtcgagttttttcttcttctttacgtcgtttggtcagctctacttcagccctttccagctcctttgntgctgccagcacattttctttctgcttattgaccttttcttcttcttcagaaagctgtatcgcaactactttgatatacgctttcattttaagaatcgcatcgctggttgttccgtcatctaattgctcgcggagtggcgaattttctgcatatagtgattcttaactttatcacgctccgattcgcgttcacgcaatttctcttgttctaactctaaaagtctgcgtttctccttaacaaccttctctgctctgtctacacgatccttcttaatagataagacaggttctaaaggatatctaaccacacaatcctactattttccagacttaccggaatattgctcgcaactgttgagcagcttcctcataatttgttttttcatgaatgtcttgtttaaggaatcgatttaatttatcgatatgatcgattgcgaaatcgacttcacgatccgatcctcgacgatattccccaatacgaatcaacatctcattagctttatatttagctaaaacctctctagcacgcccaataattcgacgttgttcctcaggaacaatagctgtcagcaatcggctaatagaagccaacacatcaatcgctggataatgatatgcttgcgctaatgcattagaaagaacaatatgcccgtctaaaatggatttcacctcgtccgctaccggctcgttcatatcatccccggccactaacacagtataaaatgctgtaatcgttcctttatcagaggctcctgctctttctaacagtttaggcaaagtggaaaatacagaaggcgtgtacccagcacgagcaggaggctctccagccgctaaccccacttcacgtaaagctcgcgcaaaacgtgttactgagtccatcatcaatacaaccgttttaccttgatctcggaaatattctgctatcgcagttcctacgtaggcagcattgagtcgcagctgagacgactgatcagaagtagagaccacaataatggaacgtttcattccctcttcaccaaggtcattttctatgaactcgcgaacctctcgtccccgctctccaatcaaagcaattacgttaatgtctgcttcttcagcattacgagcaatcatgcccaataaagaggacttaccaaccccggctcctgcaanaattccgattctctgccctttagctacagtgagcatcccatcaatacagcgcacgcctgtagacaagatcgtacgcaatttagctcgatgcaacggatccggtggagctttaaaaattggataaatggcatcgacattctctaaaggtcccttggtctctgtatcaataggatttcctaaaccatttaatacacgacccaataacccttctcctgctcggatatgcaatggcaatccagtagccatcacttccgaagaaggactcactcctgtcaactcccctaaaggagaaaggaagacaaaattctgcgtaaaaccgactacctctgtaactagaggctccatcccgtgacgtttcaccaagcacacttcaccgacacgaacatccggaacaacagccttgattaacatcccgacaacttcgataatacgtcccacaactgcggttaattgcacgtccggcaattccgtcatgagcgtattaaactcggtcgttatctcttccatgttaacctaactgggttgtcataatcgtttttacactactcaccgtggcacctagaatactggcaaataactcggcgcgttgtgtagctctttgaacggcatactgaacttttaagaaatcggctaatgtttctctttctccattacgatcggagaaatacaacaaagcacgattcaaaatttcttctcctgaagagacccaatcgactatcttgcgtgtaacagatttttcttcgtcaccattaccctgcttgaccgtctgttgtgtatgttcagctatcgcttgaaaatccccattgattaaatcaacaatgactcctaaagcatctacatgctcagaggccaacttgtcgggatcttgcatttgcatctgcgtttgtgcatcccacaaacgactttttaacaaatggatctgctcttgtaactcttcagagttcagagcttcctccaactcaggatcgatcaactgcgaatttttatcctgcatcatagccatcaacgatagcttttctgtggacactgtcgaatccaacgcagcacctccaccccctaaagagaatgaggcaacatttttacttaattcgctgggcataggagatgctgaaggtttattcaccgcagcactctccttatccccatcaaaatttggaaaaagcttaagaggatctatcatggaataccccactctttccctaatttaaaggcccaccacttttagcaactaatccatcatgccaatccagaacagacttagctaaagctcttgtagactctacttcacaactttctaatacctgatcagctaactgtaagcagcgctccaaactcgatctacgcacttcgaaagaacttccttgctgaagaacgatcatcataagtgtgagtgataaaaatgccttagcactccaattctcgggatctttttcaacaatagcacggaataaaacttctgcttttgtgagctccattttatgcaaatgcaacaatcctgatcctaactcatgtgctgtatgctcaggatccaatacttgtaatgcttgaaataacgctttagcgcttgcttcatccccttgtttgatagcaaccattcctgcttcaaacaacaatgcaaaatcttctttaaatacatccaaatctgccatgacccatctcttattttattaacttcctttaacagctcttgccatggtgatcatttcagtattcaccgcagtcaagatattggatacagactccatatattgagacaaaatttgcatgcggaattgcaaattaaacattgtccctaggtctacagttccttgcgtggatgtttctaattctgttagatattgttgtactccctgaacgtatttacatacgccatccagcatctggttgaaattaaaagccgaacaacttccgctcgccatagataccctctcttttaccgtttacattacaccattttacggttgatacgtcctagcaccttttgaagagctacatatgcccgcgagtaatgtttgttgtttctcaaaagactctttaaaagccccttctcgaagagaagatgtcagcgtctgcaccttactctgtacattagcatttacttcgtgggctttggctacatcgtgcatgtcttgttcaagatcaaacaactgacgagcagctttttctcctttagctgccgaattttccatattaaacatagatttattcctacctggaagaattaaataaacctcgaactgcctatttattgtactcaattttatatttcaacccctcccgttctaaaaagatacaatgcggttgaatgcttgttaccgtcattccatctaaaatatcgcctcgagttaaaatacgcccattaactacaacattaatactaatatccccgcactttgaaaaaccggttacccgataacggcctggataccgcatatttagatcaataacaccttcttctgcagncagcaaaacgacaaaattcttcaccgcacgaatccctgcaatatcttgcagttcttgcacaaccgttcggaatttatctgcatctttattattgatatatcctgtcaaaacagcttcaccattggtgaaggacacatgaacgttcgcaaaacctgattgcacaagatgtccagcaagagctttcatgacttgtgattcgataatcaccttattatccaatagtgaaaggtaattaaaatgtagatttagataatcagccaaacaagctgcttgttcttctgtctttagatacccgctgattacaaaaatccccggctctggagattgcatgctgatacctttaaattctggattcttagacaagagaatgttcatctcttgccatactgcctcgtcatcgatcacgttatcatctaccgacttgacaaacgagagagcatccactttgtaaagtaactcgctcttatcaatgctatttcttacatgcccaattaagaacaactgtccattgttcttattgaacgtaaaccgtacagttggaaactgctgaattacatgttcaatatcatgaatcaaatcgatttgatctatagaaactacttccttcgtatggaacaaagaagttgttcctattccaaagagcagagctaaccctccaatgaacaaggttaatataaaagcacctgttggcaacgtagcacgttttctcttctcttcttcctcttccgcagctctggcagcaatctcttcaggagattgcggacgaccaaataacccataatcttcagaagaaatcgtcgccattaccgtatcggaaggagcagtatagtcgacaagtaagaataacgttgttcctagagcaacaacttgattggcagagagcgtagattgatgttcaatcttgcgcccttcaacaatcacgccattcttactacccagatcttcaatcaaaactgaattatcattgccgataatgatcttcgcatgttggcgcgaaatactcatatcacttaagacaatgtctgcaacctgcggatcacttcctacgatataggttttcccactatccaaatggaattcagcaccgatattcgcaccagcaagaaccttcaacaaaaatcgtgatggttgcgtcaaatcaaccgcaacttgtttctgtgcaagatcttctatctcagcagggaagattccttgatcaaaacggaaaagatcctgaacattaaagggagcaagaacctctnntttatcttcctctttcttctcttcttcttgagaagcctctgcctttagctcttcatttgctgcgctttcagcagtatcttcttcaccctctttttcttcttcactcgtccctgagctgccttcttctgttacggaagctttctccattggagatggcgagttttcttccgtagcgctattaggttctcctgacggctctggagtttccggggatgggggaggcgtttgagaaggttgttgctcctgattttcgggactttgagaacccgattctgaagcagaagaaagctgtggctgctgattttgatcgggcgatgttctgttttcttccatactcgcgttttgagattgggttggttcaccactgcctgatggagtagtttgtttaggttgttcttgacttgccaaaggaagctcaagatcctttttttctcctgtaacagaaggagtctgtccttcttgtgaagagacctttggctcagagacttcttttggtgttccaggctccttctcaacagaagctaaaaaaaacaccgctaactcttgttctttcgctattgctgaactagatacctctccagaaacctttgtctccgaaggaagacttggatttcctgtctcctttttaggaccttcggacgaaacgcttgaagagccttgcgctgcaggctctccctcattaccaccttctgtctggaacgataactctatatctccttctacctcttcccctttaaaaaacgagacttggcagcttcccattacaaaggaaaccccatcttttaacaaaacaggggcagtgataactgttccatcaacagaaaccggcctcggaagcatctaaattttctaaataatactcgccatcttttaaagtgatgcgaatctgagagggagcaagcttttcatcttgcaggagaatatcactagcttttccatcactgccaagagaccaactcgtcccattttctaaaataagaacagttccagacaagggccctttatcaatagactaagcgtatacccatccccttantcctgctccgttttactcagtcctaaatcttctagccacgcttcagcataattcagaacacccccaataaaacttgcaaaatcttcttgagacacctctcctgggactcgccgtacgagcactgcatgcccatcactatcaagccctaaggcagctcccccagtctcctggccaaacaaattgccttccatcattcgagcatatgctttttctatatccataaatgcgggaatctctcccaaaaaagcactgatgataatttcctcatcagcattctgacgaacgcgcatccgcacaaggctgctaatcggaagcacataggatccatcggcatcgaattctaattcggaagccactcccatatacgccacaaaattctttatcaatttttccaacatgtgttcacgtgctcatctctaactgagagctctgggtccgaaatactccctccctagctattggaatgggccccgctgatcttatgctgagttatgccaatacctactttaaaaagaaaaacgatttctcatctcgatagtggagccttttctgttttctctttcatccctttcaatttaaagcacaaaagaattttagaaaaaaatcgggcacgaacgactcgttcttttgatttctaaagacatctcccaaaacacattttcccggcacaaatcaactcattcagagcagctctcgtatcgacaacacgcagggacatcgtgccactgcatcaaagagtcatttatgtgcgaaaagtatgtatccaagaaatcacaagagaagccttccctctcttcgttcttaggttaagcgcagcttaacagatccccctcccctgctttctatcaaggctttgcattccatcatattagagaaattgcaagcttccgaatgaaaggctgaatagggcagcgtacctctaatacacaaataaatcaacttgaaagttcacagtttagaaagtctagaactaagctgaagagaaaaagagtctcaaggcttttaatagaaacgatcgctctccatttccttgctattttctatagccttaacaggagattctattctgtttgctctgtactttgcaaacacacccagagacagtccaactaggcgttcgctcctacacagtcatgccgttctaatctttgatttagagagttccaataacggtacgcaacctctctcaagctgtcgagatgtgctgagttcacttcctttcgatgctctcttaaccaatcactgatttggtccatatccatgtaccggtgagggaataccgtatgcgaaggcagagcacgaggaacagcaaaatcaaaaacaatccgatcggggatatcccagatactttcccaaagggaatgtggcagagcatactgcaattctaaagaacctaaaaacacgacgcgataaggatcttgaaaacatagctcctctcttactacctgacgcatagataacgtcggcagctgctgacgagaacaaaaggtgatacaagaaaatccttgccttcgcaaatgataagctacagaacgattgatctcagaatagcctataaataacaaagaggccttcttatctatttgacgtcttcgtaactcctgatccacgagaatagggatagtgattgctgcataaggcgcgcctcctttcgctcgaaatactttcccttccttaagggctttttgaaagagaaaatggagagcaaaagaaagcttttgctctctagcagcttgtaaataggcacgtttcacttgtccttgaatctccgtctctccaagaactaagctatctaacccgcctgctacacaaaataaatgtgcaaagcaatcttgatttcgataaaaataaggcgagacacctaagagctttatttcctgtgccagtgaatcaaatagctcggctggcgcgacgctatacaactcgacgcgatggcacgtagccaataaaacatagtccctctcttcttgaaagacttcaggacgaaaagacccctgtgcttgttgtaaaatatgaagaacttgctctcgttgctgcaaagtagtctctcgataactcacgccaataacgcccaacaaaactctattacctatacgttcttccccttccctaaccatcacggtttcttctttactccttaagctccctctcatcattccctttctaaagaaaaagattgtatgcttcttctctcggttggcttattctctttgtttcgtatttttataccaatatttttgagactctcttcgttctctgcattgaaaaaattttgtagtctggagacgaaaatagaaaaaccgttaaaaaaggcgtttccacggcttaatcttagtatctcaagtcctcaccgctcacactgcttagtgagacagaagactaaaagaaatactacgccttacattatttttctaaagagagcataactattagctgattgttttctcagaaattatagaacccgaatcaaacttttgtcttattccacacactcttatgcgaaaaaaaactgcgtattcagaatcttctatcatttctttagcttccttggatcatatccgcctacgcgcgggaatgtatattggaagattaggcgacggatctcaagctgaagacggcatttacacgttatttaaagaagtagtcgataatgctattgatgaatttgtcatgggatatggacataccatccacataacaggagacgcacacgaactgtctattcgtgatgaaggccgcggcattcccttggggaaggtgattgattgtgtttctaaaatcaatactggcgcgaaatacactcaggatgttttccatttttctgttggattaaatggcgtgggactgaaagccgttaatgccttatcgcaacatttctctgtacgttctgtgcggaacaaaaaattcctcaaagcttctttctccaaaggcattctcttacacacagaacagggcgctacccaagatcccgacggtacagaagtcgttttctctcccgatcatgaactattcgagaatttttctttccaagtggagtttctaaaaaagaaaatccgtcaatacacctatctccatcccggactgacaattatttataacggagaacgtattgtttccactcgtggtcttcttgatctttttgaagaagaagtgcaaacccctcttctgtattcccctattacgtttcaatactccgatctcgcatttcttttctcccatacagaaacgtcttccgaacaatatttttcctttgtaaatggccaagaaacaactgatggcggaacccatctcgttgcctttaaagagggtatagtcaagggcgttaatgagttttttggaaaaaacttttcctctcaagatattcgtgagggacttgctggctgtatcgccattaaaattgcttctcctatttttgaatcccaaaccaaaaataaactagggaatacgaatatccgcgcagagttagccaaacgcgtaaaagaagctgtgctctcttctttgaaaaagaatccttccagcgcggaacggatccaagagaaaatcaaactcaacgaaaaaactcggaagaatgcgcaatttctcaagcaagagctcaaagataaacaaaaaaaactccactataaaatccctaaacttcgggattgtaaatttcatctcacagacaattctctgtatggtaaaaattcctctattttcattactgaaggagaatcggcttccgcttcgattctagcttcgcgaaatccgctcacacaagcagtgttctctttgagagggaaacctatgaacgtcttttcctccaaagaagaaaccatctataaaaatgacgaacttttttaccttgctacagccctcggcctgcacaaagactctctacaaaatcttcgatacaaccaggtgatcttagcaacagatgcggatgttgatggtatgcatattcgtaatcttatgattactttcttcctaaaaacctttcttcctcttgttgcaagcaaccacctatttatcctagaaacccctctttttaaagtacgccacaaagatgccactttctattgctactcagaagaagaaaaactctcgaccatagaacacatcggtaaaaaagaatcgtctcttgaaattactcgtttcaaaggcttaggagaaatttctcctaaagaattcaaatcttttatcggcgcagacatgcgcttaactccagtttctcttcctgatacagaaaccctcgacacacttttacaattctacatggggaaaaacacaaaagagagaaaactatttattattgagaatcttgttaccaacctctagctataaacgaacttatgagcgacctctcggacctatttaaaactcatttcacacagtatgcgtcttacgtcattttggaacgtgcaatccctcatgttttagatggcctcaagcctgttcaaagaaggcttctttggaccttattccgtatggatgatggtaaaatgcataaggtggctaatatcgcaggacgtacgatggcgctgcacccgcatggtgatgcgcctatcgtggaagctcttgtcgttttggcaaataaagggttcctgatagagacacaagggaactttggtaaccctctcacaggagatcctcatgcagcggctcgttatatagaagcgcggctaagccctttagctaaagaggtactttttaatacggatctcatgaccttccatgattcttacgatggaagagagcaagaacctgatatcttagctgcaaagattcctctactactccttcatggcgtggatggcattgcagtagggatgactacaaaaattttccctcacaacttttgtgatctactagaagcacaaatagctatactgaatgaccaaccgttttctctccttcccgacttcccttcaggaggcacgatggatgcttccgactaccaagatggcttaggatccattgttctgcgcgcaacaattgatattattaatgacaaaaccttgctaatcaaagaaatctgtccttccacaactacagagactctaattcgttctatcgaaaacgcagcaaaacgaggaatcattaaaatcgattcgattcaagatttctctacggacctccctcatatcgagatcaaactccctaaaggtatccacgctaaagatctgttacgccctctatatacacatacagaatgtcaggttatcttaacctctcggccaacagctatttaccagggaaaaccttgggaaacaacgatcagcgaaatcctacgcttacaaaccgagactctccaaaattacctaaaaaaagaattactcatactagaagattccttaagccgcgagctgtaccacaaaactttagaatatctattcattaaacataagctttacgataccgtgcgctccatgctttctaaaagaaagacgtctccttcatcaagtgccattcacaacgctgttttggaagctctgactccatttcttgacacgctcccggctcctgataagcaagcaaccgctcaactagcagctctaactattaaaaaaatcctctgttttgatgaaaattcctacgagaaggagctggcatgcttagaaaagaaacgcagtagcgtacaaaaagatctgagccaactgaaaaaatacacagttctctacatcaagaagctgctcgaaacctacagacaactcgggcatcgaaagacaaaaattgcaaaatttgatgacctacctaccgagagagtctccgctcataagaaagcaaaagaacccgctgcgctcgatcaagaagagaacttctaaaacgtgactcggcccttgagatccttaaactctcgggccaaaaagactacagtcttctcgagaagaaaaacggtgttagaaaatacgcgcgctaagactttctctaacaatgactcaaaaagctgtaaacgtatacgtttaccgctcttccataatttctaggctgactttcacattatctcgacttgctacggaaaccaataaagtacggatagccttaatagtgcgtccttctttaccgataattttaccgatatctcccttagcaacagtcaattcgtagataatcgtattggttccctgcacctctttcagatgcacttcctctggcttatcaacaagattttttacaatgtacgctaaaaactctttcatgcgaagcaaatcctacacaagcttttttctgaaggtgtgaaagaaaaataaaaatagtatttataatctaattttatacttcttacttaaaaaacaaaactacctagtgattttaaaccaatcacacgaaccatccagtatagagacaccttctctaaattccttttctattaaggaagtcatatcgtctggaagctttgtcactagcttcactcgctccgcactctccggatgagcaaaaaccaagctataggcatgcaattgttgtttgtcaagaccataacgaaaatttatagaggggatcccgtaaacgggatctccgagaatcggtgtgcccaggtgcttcatatgtacacgaagctggtgggttctgcctgtttctgggtatagagcaaccacacttaatcgtccattcgtagctagaacatgacaatgggtaatggcttccttaccgccttcagcatgtgtagaaagcacagtcatttctttccgttttagaggatgacgcgttatccgagtatgaataagttcctgagacggagcattaatgcaaatggctacgtaaagcttttttacctgtttggtagcaaaaagctcactataaagagccttagctcgccgagtttttaccgtaatcaataagccggaagtatctttatctaagcgatgtacaatccctgggcgccatggctcctcggggcaactcttgtttcagacgctctccgatttcatgtaataaagcatgcaccaccgtaccttgcgtatgcccaggagcaggatggacaaccatatctcttggtttattaatgaccaaaatcatatcgtcttcatataccttatccagaggaatatcttccgggattaaagaagagggttcttcctcttctatcaattccacttctaccacatcccctagggataacggatgggaaacacgcgtatacacccgcccattaacacggacacgccctaactcaatttgttgctgataaaaagctcgtgaatacgctccattatatgagaccagccccttatcaaggcgtcctgttaattgttcatcaattacaaatgaaaaaacagccgttggagcagggatttccagaatcaagcctccttaaaacaggactcgtcttttgaaacccttctatgatacggttcggaaaagattttattcaaccttccgaaccgttaagaaatgttaacaaaactatctaaactttcgagaagaaccacctgccgggcttcacaggctagtaaaatcggggcatgatctgtaagaatcccgaactgctgtttcaataaacttatcacatgttgcacatgcaactcccaaacctcctgagtcataggaaatctgcttaaaggtttggctaaataaatagtttgtttgtaacaaatcggaatcaaatatttctcggcatcaaacaagaagttcttcctgttattagcaagcctgcacacctcttcttcgagaaggggtcgtgctaagaagtagcgaatttccatcaatctctgtataccgaacgcattttctttgaagcgcgttgtgctcgatccatttctttatgaaccgttgtgaatgtggaaatcagtaaagactgtatgaaacggtcgtacatctcctgccctttctgttctcccatttttgcgataagagcttgccgcaactggtctaaagaacgaactgggccctcaaaagtcatatttgatggggacatcaactcttcttttacttggcctgaaacagaagtaactccttggtttcgaacagaccgactcgctatgaattgcgtgtccattacaagagactcccccaatacaaagatttttctgtattttacttgagtcaaaagtatttttcacgagagaaaggagataaaatctgaaaagaaagaagcatgtgtctcggaccgagcaggattcgaacctgcgaccatccgcttagaaggcggatgctctatccactgagctatcggtccacagcaaggaaacactcccatagtgctggaagatactataccttagacttngattttctggaagcactcttccttcttctattccttgagatgcttgttcaaantgctaatccgccgaatccttgcccataacccattccttggattcactatttcctcatttaaaaaagccctcttcctaggattttacaaggtttctcgtaccaatcaaacgcaaatggtgtatagtcaaatttctgtcagctgagaagatcgttaagaactctgactaaaggcgcaattccactctaaaaaaggatacccttttatgtttccggaaaacaaaatgctcttgatagcaggcccttgtgtaattgaagacaactctgttttcgaaacagcgcgacgattaaaagaaattgttgctccgtatgcttcttctgttcattggatttttaaaagcagttacgataaagccaatcgttcatccgtacacaattatcgaggccccggactcagactcgggttgcaaacactggcgaaaattaaagaagagctagatgttgaaatcttaacagacgtgcattctccagatgaagcacgggaagctgctaaagtgtgtgatattattcaagtcccagcttttttatgtcgtcaaacagatcttctggtgactgctggggaaacgcaagcgatcgttaatatcaaaaaaggccaattcctttctccttgggaaatgcaaggccctattgacaaagtactgtccacaggaaataacaaaatcatcttaacagagcgcggttgttcttttgggtacaacaatcttgtttctgatatgcgttctatcgaagttcttcgtcgctttgggttccctgttgtcttcgatggaactcattccgtacaactaccgggagcactacatagccaaagtggtggccagacggaatttatccctgtcctaactcgttctgctatagccgctggcgtacaaggattattcatagaaacccatccgaacccatcatccgctttaagtgatgctgcttcaacgctttccttgaaagatttagaacgattgcttcctgcttgggtacagcttttcacctacattcaagaaatggatgctgtttctgtatgacgannttctttttcatggcatctggtgtgtggtagttttaatattatgtgcttgcgtaactgcattagcggttgtcaaaatgggagattttaccaatcccacgcttgtacaccaagactccgtaacaccagctccgccatttttgaaaatcaaaaaacttggagtccgcaagcgaatcatctctccagaaaagcaattattttattgcaccatagataagtcctgtatggagttacatttctccaatacaagtttacactgtcgagaactcttatcgcacctaacaggatgtctacaaactgaaancgcggaccccctatgttttttagaggtactggaggacttcttaattacaaagattattctttgagcgtgtataattgttgtttctctattaacactccagatgccgaaccagaaatgggtagagggatggctgaaggcggaatgaaagtcctctctctctctttgcttaaaaactaatcctttttatgtcagtactatccgtttgcaacctcatcaaaaaatacaataagaaacctgtgaccaatgatgtgtcttttcaagtcaatgcaggagaaatcgtggggttgttaggccctaacggagcggggaaaaccacagctttttatcaaactgtagggttgatccgtcctgattctggaaaaattctgttcaaaaatacagatattacaaaaaaacctatggactatcgagcgcgcctcggaatcggatacctagcgcaagaacctactattttcaaagagctgactgttaaagaaaacctaatttgcgttctggaaattatctataaaacacgaaaagaacaaacgcacctattaaatgctctcattgatgatcttcaattgactactagtctacataagaaagccggctcgctatcgggcggagaacgtcgccgattggaaatcgcgtgtgttcttgctctgaatcctagcgttcttttactagacgagccttttgctaacgtggatcctctggtcattcaaaatgtcaaatacctaatcaaaattctggcaagtcgcggtattggtatcttaattaccgaccataacgcaaaagaactcttatctatcgcagatcgttgttaccttatcattgacgggaaaatcttctttgaaggatcgtctgctcagatgatcgcaaatcctatggtacgtcaacactatctaggagactctttctcctaattcttaatgccgtcccgtttttcacaagacctgggcacaacgcccaggtcttaataatagaaaccgaaaaaaagatactgcgggatatgttaaagcccagttaaccttgggaatcttcttcggaaagcacttcgttagctatcgcggctatcgtctttaacccttcaggaaagcctatcgcacacaataaatcatggatgtacgctctttccgactgcagttgatcattgataaattctaaacgagctagctcttgatgtatctgtgataactggtccataacgtccgctccttctttctggaatcattcatctttactaggagcaaaaagtgtgccagctctaattaataacgccctcttttcaaaatgatcgcctctaaagcttctcgatcagcccaaatctcaacgtgttgtttggttcttgtaattgcagtatagagaattgccgaatcaaagacttcactgcctttaggaagaataacaatcacacgatcatattcactaccctgacttttgtgcacagacatgacatagttgtaagaataatagggaaaatctgcttgatgcagaatctccccattcatgaaacgcaattgttccgttacaggatctaaaactcctgtatctccattcgttaatccccacgtttcatatctttctgtcacgatgataggaataggtgcccgtggatgtttctcctgcatctcattaaacaacaaccgattcaactgcaaaaaaccccaaagtccttggcgcatcggagtcaaagcacataacgacaccccttcttttgctgcttgtgtaaaagcaaaagacaatcgccgaatagcttcttgtcgggaaggcaaaggttgaaaaggaatcagctccttgcgcagaacagcgctcgctaattcctgtaattccttatgtttagctcggtggctggtagataaaaagcatgcctgtttagaaaactcagacactacttcatgaaaaggatttcccactccaatacctattggagaaagctgattcgcatccccaaaaatcaccattctatctgcgtagatcgtttcccctcgggattctcctcgtatggttttaatcagtccatgtaacagattcatggtcaccatcgagccttcatcaaccaatagtagatctacaggggagcgccctctacgcatatcttttaaaaatttatgaatcgtaacgacttctacagaatctccaacgattccctgagacgttaatacgctatgcagatgagcggaagctttccccgttggagaagctaccatgatctgcgctgaaggaatttgcgcaagtatcaacngaatcatctgaacagctaaaaatgttttgcctgttcctggtcctccacaaacgagagagaagcaagaatttaatacagttttcagtacctggttctgctcttctgagagcagagcaatctcttcaaaaattaaaggtgtacgtggaaacgtcccgccaatctatgcaatttatgaaacaccttctcccgtaaaagaaataatgagcgtagataaattttatgattaacaacttcaaacagttcttcttttatgcgggatgacaacagctggaaccattggaagagttgtttatttgaaatccctgggagcgtgggatgaatcgtctcatcacaaatagaaaaataaggataaccacaacgcaataatgcggatgctgtagctaagaaagcttctgcttcctgactaaactcttcctgggataaatgcttttgagcaaaagctatatcaaaagggagaagaatatgttgtgctaacaaagatggtacaatatcttgaacgtgctgatttacattcacgggaaagatttttctttttgctgtcgtgctatgtatttatagcacaaaagagaagctttgtgtacttgggaattccaagcatcctcccctaaaggaagcttttgaaatacttccaaagcttccgtgtattctttttgctctactaagcttaacccaagtagttgcaaggcttctgttgaaggagccacacgcgccagccaagaactatacacaatacagagacgataatcgcctttagaaaaaagatattgcgcatctgctaaacaattcgcaatttcggcatcgctagctagagtcttgggcaatccgacctcatctaaaaaattctctatccacactaaatgcgtgaaattccgcatagctaaagcctgggtgtaaaaatccttaaccagacgaagcgtgcgattaagacaggccttctcattctgagaaaataataggatttcctttaagaggcgtaggcaggcttcctcctggcctcctctccataaatgcttggcactgaagaatagataatgcactaactgttgccgatcgacatcagcgatatcttgctcctcccataacagtagatagtcttttaatcgcgagtattgtgcatcatcctcgcaaaccatattcacaatctccttctcggaaagtaacaacttatgcccccaagaagagcgaggatctagcgttttcaacagagctaagtactggtcagcgcacactgtgtttccttgagaaacacaaaaaacgagttcatcgctgaacagctctatcagtttttcttttaattttttgatttttgaatcggcaattgcctgacagattttttgcgtatgtataccatcttgtaaaacagcgggtttcatcctttctaagactaaagaatagtccggatggacatagctattttcccacattaacaacgcatccatgaacaaagggagctgcgtttctggtatgacaaaaatatgctgcatgatcgtaggaaccagcatgctttctgggaaaaaggttttgtatgctcccgcatcaaaacctttcatttgcttctgataaaaaagaatcgtttcataatactccggaagtaaatcgctacgcaccccctcttgtaattccagaaggtagctctgtcctagcattaataccaaccggttatacatgtctacagaccaagcatattctctagaaaagattttgttgaaaatactgttaataacgattcgcccttccgcataccttctggcacctatcagctttcagctgctatctcttctaaaacataaggagaaaatagctcatagacattcgtatctaaacaaagaggcttagtctgatctacatgcccaaaccaccgggataacacatccaccgcaagattatattgtttggtacgatgtgcatgtaacgctttaaaaaataaaagatgagcttctgatccagataccctttctaattccgcaatacattctgccattaatgaaaggttatttaaaaaataggcattgagaatccgcccttctaacaactcacgctgcaaaacaaaaggtgcagaagtttttcttttatcaatgcgagaaaaaatttcttttgattcttgaaactttctttgaatttgtaacgagaacccctgacaacacagtaaatacatctgctcttgttccatggaaagaccttctgacaaggtacttccctctcttaatcttgcaacagttcgatgtgtatgatcataatgcgatggagaatcgtctctcgaagaaaaaaatacatatgatcttccgcctgcagagaaacaagaaaggagaaaaaccactaacaagaaaacgcgaaccacaaagccttctcgctcgttaaaatgcttgatctctaggtgccttactctttgaagtctcttttatctaacctcaacactataaagaagtcgcacaccaaagatccgtggagtttacaccaaaaaattttagcctttcaaagaaaaattatgaaattggctctacagcttccgggaaattaccaaacctatgtagagaaccacaacaaagacgggggagaagagaaactaccaaggaaaaagaagaaaaacttcttttccttgattagaatcgatagggaatacaccctctatttcgcagcctctgctacctcgcgagactctgaatccacgcaagctgccgctggagcttgtgaagcctgtacagactcataaatacggcgttccaactcgtggaacaactccttattccttttcagctcttctcgaaccgcctctcgaccttggcctaacttacgatcctggtagttgaaccacgatcctttcttatcgataatatttttttcgacagcgagatcaatgatacaccctgcggaagaaatcccttcattaaacaagatatcaaattctgcagttcggaatggaggagctaatttattttttgctactttcaccttgatacgattccctatatcgaagttttctcctccctttatggagccaatacgacgaatatcgatacgaatcgaagaataaaacttcagtgcacgtcctccagtcgtagtctctggattaccaaaactcacacctattttctcccgaatctggttaatgaaaatggcacaagtattggttcgtgctaaggttgcagttaatttgcgtagagcctgcgacatcatgcgagcttgcaaaccaacatggacatctccaatttccccttctaactcgctctttggaactaatgctgctaccgagtcaatcacaatcacatcgacagctccagaacgcgctaagagctctgcaatactcaaagcatcttctccgcagtcaggctgagaaatcattaaatcattaatatttgctccaataagcgcagcataattcgggtctaaggcatgctcggcatcaatataagccgccacccctcccatcttttgagcattggccactatatgcgtcgctagagttgttttccctgaagactctggcccgaaaatctctacaattcttcctttaggaaccccgcctattcctaaggctaaatccaacgacaatgcacctgttttaatagttgatatctcatgagctgaagaatgctttcctaaactcatgatagatcctgcgccaaattgcttttcgatataagcaatggccgcttccaaagccctttttcggtcgggaacgctcatgtatactcccttgttgcgctgtctagaagactctactttaagaggttgccatctgcgacctcttatatttcgtggcgtcagtttgcaatatttcaaagacaacagtcaagtgctagaatttcaaaaaaactacactctttttttatctagaatggaggtttctctctattcttgagtacaagaaagaggcctcttttttcaaaaaaaagaatgcagatgcagaaaagaggagggagctttttatacgtaaaacagctctttaagtgagatataactgatctaagggaacatcatgctcttcccttggaagatacgccaacagctgctctttaaatcccacgcctattgtccaaatatacggatacttagacaaaaaacgatcgtagtagcctccgccatatcctaaacgaaacttgttctgatcaaagactatcgcaggaatcaaggccgctgcaatctgttgtgcctcgatctcttctccttctatctgattcaaatctttaggagaatacagactctctatcatcgtaaaaggaagagctatcggaacgatatccatcccttgcattttaggtaggaggagtcggttctcttgcgctaaccatgcattgatccctcgaacatccaactctgagcgaaaaggaatataggataacacaaagccttgcgnaattgtctgcataacaaaatgcatcagctcacgagctgcttcatctctgcgctggacagaaagctgctcgcgcttcgctaacccttctcgtcgcaaacaacgtttctgctctacaatatttttcatgtctaatgaataacaggcttcccatcttcatagaggactttctttaacaatcctcctgtagcactgaaaaagaccgctgtcccagaacctttttccactttagcatatggatatcggtcgttcggccggaaatattctccttttatgagaagatcgtctacatattcctcggtagccatcacttgtccttcgggatagtatagcatgagaatcccagtctttttattttgcacaagttctttgctactttccaaagcgccatttgggtaccaagttttcacagctccttgtagaatgccttgggaccatgttaataacatttttctaccttctccgcctggatagaaaaatacttcttctccctctttctgcccattgattagagaatatgcttgcaacagagatttaccatgttcatcaaataacaagacttccccgtgaggaacgccatgtacaatctgtcgggtctctataatcgcatatttcccataaattacttgtttacctttgccattcactacgcacgcgatttcttccttagtaagaggatcgtaatatttaccactgcgcagtttcccttgtttatattcttcttctgacaacaatgactgtgaacctggctcgtagcgtaatgcacatccagacaactgccctttacaaaaagtttgtttctttaacaaacttccttcttcggtgaagaccaaaaagtctccatgagcaacacctttatggtaaggacattccttccatacattcccattcgcgtggtaatacagcgaaatcccttccagcaagcctttttcataatgaataacagcttctaaccgcccctcgctatcatgtgcatacgttgttccatcgaacaaccatccggcttctgcggaaggatgcaaatctgctatccctccaataacttctgcctggatatgaattttgccattactatgccactcacgataacgtccaaaagcacgattatttaaacactcgagatattgtcggatttggccattcggatagtacgtcgttaaacaagcaaccgactcgcctgctgcgtttttgtatgtacgcatgactttttggtaaggctgaggagagagaaaatcgattttcgtatacttttgtaatttttctttagaacagatcgtctcagaaagaccattcctatcgataatgttaatgcctgtcagtcggagcttatcataaaccccagcgtccacccatccgcacagcaaaagaaaacataaacaccatcttaagcttctacttacacacatcgtccccaagcctccgcgtgaacgacccacacctcatttcctaatgatgacacctgcttcgtcatttcccagtaagaaagaaaaacaatgggtatttgggtatacttaggatcaaacaatcataataatacaggaatgtcctcgtcatctatttggagctctttttggaaagaaaacaacgtgcttttctctcctaaagtctgctcctgccatgacaagcggttatcttctaagaaagccttccgatccttgactgcacgacttctcaccacccaggctgttgcaggaagtttagctagagcatctcgctccttattcaagaaaacgagattctctccttgggcaatccaattggggaaactcgcttgtttatgcgctgctttcagccgcgcattcttgattgctacctgagaagatcgctctcgtttagactgaaaatctctcatatcgatgagtaaattttcccaagcctctgctgtacgctgacgccaacaccatgctcctattgcaggaagagaagcagccccactcgctaatagtaacagcacccatactcctaagcgtcgcattatcccctcccttgcagagcgattcgtacatcaaattggcgatctgccagctttttagaaagaacacgcgcaccgatccaagctgataactgatctataaaagatgcaaagtcttcatcattagctgcaccttgtaaggaaatataagcccgatatccccctaaaggacgctcctcggaaggaatatcttctaatttatacaaataatgggagaatgaaacggaagggagattcgcagtcattcgtccaagcacttccatcacttcttgattcgtgggtaccgtaggaggtattcatattcccaactgtggtccgaatcacagacttctttcactacctgctgtgccgaccgaaagacacgggttatttccttttcaggagcgatctctctaaatatctgttgtgctttatggactaaaagtaatgactctactcccccgcctatgaatatagccagcgcgctggcaaaagcgagtttagaaaggctccacaacctttttttaatccaatagctacatgccttccgagagaaatctccccaactgtaagagaaacaagtatggcagctacgcactccctggaaagcggcagccaccgcatcacgatacacttcttggtctggagagagctcggaaaataaaagactgatgatcacaggaacgccagcccgacggctcagcaaagtacgtaacgaactagatagataagcgccgtggatctctgataaaagaggcggtgtatacttcttgaacgtatgcaaaagaagctaataaatcgtctaataagctttcagagtcatttttaaaggaacgagacagtaatacggagccttcttgcacaaataaacagactgtctcatcaagaccttcgtatacgaaaaaataagtctctagattgcgaagaagagactgttgcaatgcagaaaacagatctttggctcgacaagaaatgtgcgtagcaaatccccccttctcctccaagagagctgttgctaacgcaacagattgtctttgtaacatccatagtgttactacgcgctcctgagccgagttccactctcctaaatcatgcgcaatcactaaatctttcaagggaaatgctgcggttgcttcttgctccgcatacaccatttttaaaaaattctttttgctctttaaagaagagctcacactttttactaaagtctcctgtccttgtaaggataaaactacctttgaagaaagaaatcgttttggccaagacaacgcgcctgtttcggtaagcttttcgcaacgacacagagaccaccctttacaggttttctgtaaaattgctatcctggtaacgttttctgcactttgggttacccctatgcagtaaataggcagcttaaaatccatttagcgtttttctttatctttttaaaatgaagagtgctcattttaaaaaataaaaacatctttttcaagaaaaacattaattaattataaacagagttttttaaatgctttcttatttacttagaactgcggttaatatttatagttttttaattttggtttacgttctttgttcctggctgccagaatgccacaatacacagtggtatcgtatcattcgtcgctgggtatctccctatctccgtatcttccataaattcgttccgcgtatagggtttattgacatcagccctatgatcgctctcctctgtctcggagttttgccctttatgattctaaaaatcgtacgtttcattgttctgaatatttttcaatcaccatggctccttcaatatttataaaaaaccttcctcttaagtctcccgtagtctacgcccccttagcaggattttctgatttcccttaccgtcgtatgtcggctgaatatcggcccgcattgatgttctgtgaaatggtaaaaatggaaggcctccattattgtcctcaacgcacgttacgcctactcgatttcgctgaatctatgcgtcccatcggtggacaactctgtggcagccgtcccgaccttgccggagagtctgcaaaaattttagaaggcttaggatttgatcttatagatcttaactgcggatgccccaccgatcgcattactaaagatgggagcggttcaggcatgcttaaaacccctgaattaatcgggaaggtggttgagaagatggtagaagtggtttccgttccggtaaccgtcaaaattcgatctggatgggatttcgaccacatcaatgtggaagagactgtccgcatcattaaagaaagcggagccagtgctgtctttgtacatggaagaacacgctcccaaggatatcaaggcccaagcaacttggaattcatttctcgagcaaaacaagccgctggtgatgatttcccagtatttgggaatggcgatgttttctcccctgaagccgcaaaaacgatgctagagactacgcattgtgatggtgtcctcgttgctcgaggtactatgggagctccttggatcggaaaacaaatagaagattacctaactacagggacctactcctctccatctttttctacaagaaaacaggcgttcgtacagcatctacaatggatagaagagtattatcaaagtgaagagaagctactaacagatactcgtaaactgtgtgggcattacctcattctttctcctaaagtacgttctctacgagccaacttagctaaagcgtcttcatcacaagaggtgtatcaactgattgacggctttgaagaactcacggaagaagaggagcttctctcggaataatcctcttattccgagtcatgacaaagcccctactcttccttgattaagtgcgcgcttaattttttagatagcgcgaacatgtcgattggatcagctcctatcactccctgcaatttactatcaggaataatgatttttttattttgaggggattgcaatcctttttccttaatatactcccatagcttcttagtggcttcgggacgccctacaggatccgcaccaatcacccctgctaaagcagcagaaggtgtgtacgctttggtagctcgtttttttgttgttgctgagctttttttcactgtttttgcagcctttcccttggtagaggctattgattttttcgcttttggtttcttctcataaggagttttaggcgttcctgcatacttttcaattacagcatctacagagttaccaatcacgctacatgcaggatattcggagcaagaataaaacattttattaaatcgtgagcgtcttttcacaaggtgtcctgtacatccttctgcaggacaatgcactgtcgcttcaggctcagccccagcttctccctttttgaaaagattaacaatgtagtgacacttcggatagttctcgcagccaaggaaacttccaaatttcccatgccggactttcatttctcctccgcacagagcgcagggtgcatcccaaggagtatcttccgcatactcgtttttgtcgaacgtcagctcctcttccgaagttttatagtcgcaagtaggatattcggagcaaccaaagaaatagcgatttttagcccaaatttttactaatttccctttatgacatttggacaatctatttctgtcacaatacgagggataaaggcctctttttctgccgtgactacaaaaggaagaaagagttcacaaaattcttgtaatagctgcttccaaggttttttattatcagcaatcagttctaactcatcttccatgccagcggtaaaaccaatatccataatacgaggaaaattcgtttctaaaaactgacaaactacttttcctaattcagtaggacgtagcctttgcccttctttcaacgtatattcccgactctggattttattcatgatagtggcataggtagaaggtctccctattcctgacttctcgagttctttcactaaagaagcttctgtaaatcgcggcaaaggcttggtatgcgattgttctgcttctaactcttcctttgttagaacatctcgctcattaagcttcggaagatgaatgttttcctcttcatccccttcttcatctcttttctcttcgtaaacagctaagaaccctttaaatttcaaacaagagcctgtagcacgcagatcgatacctttattcgtcgtaatacgaatcgcgagtgtatcgtaaatcgcggatatcatttgtgatgcaacaaaacgcttccatatcaaagaatacagcttgtactgatcttccgttaacttactgcgtatcgattccggagtgattgtaacatctgtaggacgtatagcttcgtgtgcatcctgtgccatttttttcgtggcatacacgttcggagaagaaggaacgaattccttaccaaaatgaccttcgatatatttgcgcacctgttttacagcttcaggatccgtacgtacggaatcggttcgcatgtatgtgatcaatcccacagcaccttgactatctaaatctaccccttcatataaagtctgcgctatgttcatcgttctggaagaggaaaagcggtaatgacgactagcttcttgctgcaacgtagaagtaataaacggaggataggcgtgacgttttttttctttagactctacacgatctacaacatatgtagctgattctaatagagcgacaatctcatctgccttctctttagaatcaattaaaatcacttcatcagaagtcttcccttcaggaatttctttttcccatttcttcccattcacggaatgcaaatgagcccagaatgtcttttgggtttgaggatctttaagatgcactcggatattccaaaattcgacgggaacaaatcgttctatagcatattcccgatctactactaatttaagagctacagactgcactcttcctgcagaaaccccagaccaacgttgcagcttgcgacctaggatcggagagatcttgtatcccacaatgcgatctagaaagcgtcgtgcctgctgtgcattgaccaacgccatatcaatttccctaggatgcttcaaagcttcggtaacagctcctttggtaatggcattgaatgaaatacgttgaattttagtatccttaggcagctgattcgcgatatgccatgctatagcctctccttctcggtctggatcgggagcgagataaactacatcacattttttcgcttcggcgcaaattttccgaataacctcttccttcccttctaaaatttggtagtccggaacaaatccattttcaatatcaataccaaacccttttgcaggaagatcaacaatatgccccaaggaagagtcaaaaataaacccttctcctaacaacttacgcaaagttttaatcttggctggggattcaacaatgattaaggattttttcatacacaatgccaataagcgggatcttagtctctcgcacaaaagcttttttttaaaaaaaaaaactttttcttatacgattatattagtccctcttcatttaacttttatgatttttattcccttccagaggacgctttttctctaatgactcttttttaaaaaattacggttcttcacacccactttttgtttaatgaaacagcagcaaacattgagaagaatgttgtttctttccctatgagccgttttctttgaggacttcctgaacgaagcagaagtatcctataattcgtaagcaaaaagagttctcaatacttcaggacatactatccgaagcagagcccaggtgctattcgcattgatgagctaggccgctcttctcttccgaagagcggaagaagcgcgcttgtggaatagcaacataagaaaacttcagcttcttcccaaaactttaattacacgatcctatatcgtaaagccttaacgagaagccttgtcaggggactttaaacggggtgttaacctatccgccgataaaaattgacagaaggaactgcgagaaaaccttttcaagctttccaagaaagctctcaaaagagcttataggtgaaagactttgtgtcatacaaaacctgcctgctaaagcaagaatttgcaggacgatgagttttcccgggacccaatgatattgggtctcaggaaaatgtcaaggacatttgctctcttgatcccacaaattacgtaaactcttcgtgttattcaagatctttccctcatcaacctattggcacaccgctattctttggcaaaaaacctgtacttacgtatggtgaagtctcgaaactcatctcttcaaagacagatccggagcctttctcctattgtagaccaacatttttgagagcagccttgaatacacttgaatttctttcttctcccccctcttcggatccttacgatgatttattacaattaaacaaagaaggattccttgctggccctgaagaagaaaaacaagctttttttcttcgggtagaaaggacattagcagaagctcctgtacatcccacccctttccccatagaattccagaaactcttcgatgtgaacccttcttttttagaggtagtgtactctaatgaaagtttagatgcctgggaagcgggatgtacatggatcaccgataacagagtgtcgattcaactacgcaagggttttcaaaaagcttctttctggtttggttttttttccaaagaagaagtgctgtctcacgaagctgttcatgctgtgcgtatgaaattttatgaaccgatctttgaagaggtcttggcatacagcacttctaaacacttttggagacgcttttttggtcccctgttccgatcagcaggagaaacgcatttctttctgtttttcgttttatttggagcgtttttattcccttggtttccttggataggcctttcttgtattcttgctcctaatatgttctttttttttcgcttattccgaacacaaatcctatttcgtaaagcaaagaaaaaaattcgaaaacttttaggtatagaacctctctgggtcttactacgcttaacagatagagaaattcgcctatttgctacgcagcccttagctgtgatagaagactttgctaggaaagagaagctgaaaagtgtgcgctggagacaaatctatcaaagttacttcacctaattaccgcgccacactctttctagttcgctaaatgcaaagaatatttcagttcagaatcttgaactaatgtccccgattgcacagccaatcctgaggcttgcaactgagaaaagaagaactgactctgcgcttgattcccaagacatacaacgcctaaagagggttgtctcttcaacaacgccttaacctctaccacctgccgatcgatccattgcgcaaaagcctgcccttccacgccataagagaaaatagtaggcacacaatgcggtattaaataagaagtccatcctggttgcagagctttatctaaaataaacacacagcttcttacggtcttagggaataatgctaaaatacgtcgcgtctctttataggaggttgcgggcacaaaaaagcaccagacttcttcagccttgggagaagagaagctggtccctagttgtctctttaaaacacgagtaagcagaagacgatacacatgctcttttaacatccacagcgaaagtatagcaaaacaaacaactaaggagcccatatataaaaagctttgatcgggcgttaatcgcaaaccagcacctaataatctaacaaatccggcagctaataaaactcctgaaaaatctaagaaattattgagagctaatacctggcctcttttatgttctgggctgacgaattgaatataggcatgtaaaggaacctgataaattcctccaacaaggcctaaacaaaagagtaaaataagcacggcggtgatcgaaaaggacagcaagcaaaggaccatcatagaaaggcccacaccaatagctgctaatggagaaaaccctaatttgatatcctttccagaaatccatcctgccatgtaagagccaactcccatacctactgctacaataggaaatagatacgcgccataatgtttggaatatcctaaagtaaattctacaaaaggaataatttgtaattgaacgtaggccccaacaaaaagaaagaaggcaacaaggaatacggaaatcatcagataagcaatattgcgcgtctcttgaaagacctgccaaagatttctaaagcttacataagcaattttctgtcctttattttttacattacttgcacgaatgcctaacgcaataaataaacttaaaacagaagagactacacagaaacaggccgataactcgtaactatttgtgacaaaatctttcgttaaatccaccataagaggagctaaacaagaccctaaaatacttccagaataggtagctgctgtcattgcgccatttgctttggatagctcctcaataggcagcatctctggtaatattcccatttttgcagggccgaaaatagcagaatggcaagccatcaatactaagacaaaatatcctcctacaacggaatggatgtggaagaaatatactcctagaatagcacaaaagatttcgatgacccgagtgaataaaataatcatttctcttttgaaacctatctgccaaactacctgaaaagggggctaacaaaatgtacgggagagcaaaaaagaaactaactaaagacagaattttagcgttttcttccaaagtttttcccatctaacaaggaaaaaactaaaagaaacttatagagattgtcatttataattgtaagaaaatgtgtaacgaccaatgcacggaaagatcgtttcctcgcaataatacccatgaatgtaaaccgatgaatgaactatctcacagccaatcaacgtttagcaactatcccgaagtcttgctggctaaacttgctcaagatctgttctctatcaaccaaactcccatgacaaaacgatggattctggtgccgagctcagacacagatcactggctacgaagagaattggtaaaggcttcatccaatcacatcttcatggggacacatatttttgcctcttttgacgcttttgtcaaatacttatttacggggacgcgtctcgtcgacctctctacccccgatcacattaccctccctctaactatttataacctgttaaaagaatcttctttcaactcttcttccgaggtttcttattcccatctacaaaaactttcttctattttcaaaaagttttacacgttttctcaggagccttcgaccaacaatccttactacaaaaatttatttgcacaacttaaagactcctatactccattagaaaccattttttcttcgattctggatcatcctccggaatatccttgttctctgcatatttttgggtatccacaacttccccaacatgtagcctccttctttgttgctttaggaaaatatttccctgtgcacttttactgtttttctcctagcgcagcctatttcggggatcttttgtctgataaagcgatggcagcactttccccgagaatcccagaaccacatcaagaaacatgggagaaatatgtattaacggatcggttagcattactagccaaccttgctcacaaatcgcagtcgctacaaaacttttttttagattatagcgttccctacgaagaactgtttcaaccctacgaaaaactttcttctttacacattgtaaaagacagttttttccatttacaacctatagatcaaaagctgttctctaattcaccgcaaactatttttgtaagacaagctccttccgcatcccgagaagtccatcaattattttcgcttgtttctcagcttctccattctggagttcctgctcaggaaatctttattctctcttctaatctttctaaatacgaaaccttgttaagagggatctttgaacctcatcttcctttatatttaacaaaaactgagaaaacacaaacccgcacactaaaaaacaagctcttgttagtagtgacctttctattctctaaaggctctctgaacgacctacttcgtatcctttctcatcctgatcttctctcccccttagagactacaaaaatgggcttccttacccataaacttacgcactattggaaatccttatcacaaaaagactctcctcttactcaactcatccatcgtattttggatgaatatccgtttattgatgatactggtagcgttaatgaagctgagacatgggaagttgtcgttcctcttcttcacacactacaacaagtcacagccagttacatagaatctaaagacaaaacctacgaagagcactctcgtcttatcttttctgctttagaaaatattttcttcctctctacggaagagtatgctttgttagtttccttatccaaaacactacaaccttttgtgcgctcttcttgctctttaaccattttcattgagttttgcttagacttcctctcacatattcctggtcatagccaactgtacaatcaacctgggccctttgtagggtctttaaatagtctcagtttaattcctaaagggtatacttttattcttggagcaaacaaaaaagatcactcactcgataccagttttcttattgatccttctctcattcaggaagattttctattttcctccactgaagatgaggataacttacattttctacagactatcgtttctacaaaacaccagctccatattagttatctctcttcatccaagaatccagcattaccgagctctgctttgcaaaacatttgttggatgctgtgcctattcaagaagaacatctttctgggaaactttatgctaaagaaaacttttcttctgaaccgttgcatcagtcttaccaggtttactaccggatggctcaagtctccccgctacaaaacaaggccccatccctgtttaagtctgatacaactaagacgttaccttcacacctatccctacaacatctaatcaaagctttcaaagatcctttaaactttttcctaagcacgcaacatggcttttcctttcatcccaaagcactattttctaaatcagaaaaagtctttcctagtcctcacgatgctaaagctttttggaaccaccttctctcttctaaaactcctctacccactactaattatctttcagcctttacagaatctctatacaccgatgtacaagactctgtaagtaaacgcttagaaactttgcagaaagatcctgctacaacccccttttctgttgtattttccgatcaactttttcacgacccactccatcctaatgatcaacaagtccctcctctactcctatctctccccctaaaaaatattcatcttcaagggacgattcatggcgtatgttcaaaaggggtatatctattttctatgcatccgggagaagcctttaagaaaactcagaaaactcatggattccctaaagatgcctttgaactagaatcttatttagaatcctacctatccttagcgttactacaagcctctcatctacttcctaaagaagctaccatcctccgcgttacacctcatgacattgagcctatcctccctcctttttcctctccagaatcttacttgatccgcgcgatccacctgtatgatctcttacaaaatcaagctgttcctcttccttctgctcaagcctgggaatacattaaaaaaactgattcagcgtcacagtgtataaaaaaacttttagatagcgaagaagaccccctaacaagtagtttttggtggttccataatcgtgatacagaagaaatttgctcagaactctctaatgacgtgctctcgcagcttctttctctctttataaatcaggatagtcaacaaaactgatatgagctcttttgatattttttcaccaacagcttctgtttctgggaaatttttcttagaagcttccgcaggaactgggaaaacattcaccatagaacaagtgattcttcgctcgttattagaaggctcgatcgaacagacaaagaacattttggtggttacatttaccaacgcagctaccaatgaattaaaactgcgtattcaagcaagcctcaaacaagcattgagtcttttctcccaagcactctctcatcccgggactcccttacctccctatatctcttcctcagaaacaaaagtaaaacagctttacatgaagatccgtaatagcctggccactttagatgaaatgaacatctttactattcatggattttgtcgttttacactggagcaacacttcccttggatacagcctattcagccgtcttccattttctcagagcctcaaaccatacaacagtatatcctagactacttacgtaaaaatctttgggacacggttctctctcccaaacaatacgccttcttatcttatcatcaccgcgctactacccaacaaacacgccacctaatagagagactacttcaagattacacttccacaccaaatttagcgctctcgcctctatcgataaccctgcaaaaactaaaagcttgggtctcctgctaccaacacttagctcctctctctctcgaggaaatgcaagctttctctcttcgttttaaacaaagcgatctctctatcgagcgggaactccctgcttttgtgcaacaattcgaaaccaatccttattctttggatatgctgtttttcccaggaatggtacagaagtttcaggaggaaaaccgcaataagaaaaaattaagtgctccagcttctcctttagatccttttttccaagattggatacagttagctcatcctttttgccaaaaagaacctattttccatacgctacttaaaagcgtgcaacaacatctgaaaactcactgcgcacaatcctattcccatgatgaaagcatagctactttagaatctcttctagatcacaacgatactgtcgtctcacaactacgtaaacaatttcagctagtcttgatcgatgaattccaagacactgacaaacgtcagtgncagatcttttctaaactctttgcttctccagactattcaggatccctttttcttatcggagaccctaaacagtctatttatgaatggagaaatgcagacctccccacatacttgcaagcaaaacactccttcccaaaagaagctcgncttattttagatacaaattaccgatccaccccagngcttatgcaaggtctcaaccatttgttttctcttcccacaccgtttctagagactccacaaaacattctgtatcaccctttacattctaaagggagctcggagatctcctactcagagttcagtcctattcatttcttctcctcagaagacattcaagaagaaacgttatggatttctaaaacagcttcttatcttcgatcagcgtattccattccatttggaaatatggctgttctagtacaagactatccacaggctctgaagctaatcactcacagcaccatccccatggcctactgcaaagaaaaacgtatttttgatcgcacagaatccccctaccttctgattctactattggaagcccttctgtacccagagaatcaacaaaagattcaagccattttgatgagccggctatttcagctttcctctacggagattcaccagcatcttaaaacgttttcttctttgtttttcactctgaatcgacatctctaccactattctctattagctaccttctataagctgatgggagaaaacgttttatctcaaaccataggagaaacattattgcaaacccctcttggagatatcattttccaagaattagaagcgctatgcttgtatcttgataaaactacagagaatccccatcacaaactcttacatctcatcaatattctgattacagggaagtatgatgaagagctttctttctcgtcgcaatctaatgacgagaatatgataaaaattacgaccgttcactcttcaaaagggctcgaatacgatgtagtattttgctcttgccttaacaaagcaaaagagaaaactccttctgttcatatgcgagaaatgtatgtcgcatgcacaagagctaaaaaattcttatttattccgttttctcctatagagaaacgctcactaagcacaaaaaaactttctgctcttgctaactatgctaatgttacaaaacatcatagcgttcctcatttagtagaaaccttgacttcctcatctccggaactattttcatcaagcttccaacctcctgaaagctctctaactccggatagagaacgtcttcctcaacaaacatacttttctcttccacatctcccttctcgaactattcactctttctcttctacggtagagaatcttcacttttcggaacctattcaagaactgtcaccttctcttttatttcctggaggctctctaacgggaacgttgattcataaacttttagaatcattagcagggaattttgctgcttgttttgaagaaattttcaataaagctcagacattattgaaaaacactcctttagaaggatacgagtctattattgcagaaaaaatctatacggtcttttcaacgactcttcctttttcttccggatcctttgctctcaggaatatacatcctcataacatacgtgtagaggaaactttcttactacaagaagaaggagagttgtggcaaggaatcgtcgacttattttttgaacataagggtcgattttttatcatcgactggaaaacttctttcttaggagatgaaacctcttgctattccccagatcaactccatctctatattcaacgtcaagggttagatagacaggagagattgtacagaaaagcagcgaaaaggttcctacaccaatttaattcatcattgcaagtagaaatggccttcgtatttatccgaggcttggatgacaagggcaatggatttttgcaaccaggacgttaactaaaccccttctaactactcccaaatcaaaccaaaaatatcaggacgatcattaggattaaaatccattggtggtaacaccaaaaaatccaccgtagaacaatctggagctaaggattgtgcttttatcttcaaagaacaagatccttcacttttaggaagaacttcattgactgtagcaacgagaagtcctggagggaaaacaccatccaatcctgtggtcacaagaacatctccaacttcgatagttttcccatctacaaaaccaaaatcgctaccgctaagtatagaagcctccggtttccaaataggatccccacgaccacaaacaattccacgaagagcaaaatcattttgttctgatagagataaagaatcctctagagcctgcaagagatgtaaagcttcctgtttatcactatctgcaaaagcagatgccggaagattagcgacgttcctagctaatgtacgtagctgatctttcacaacccaagtttgaatttcaccacgaaccgccataacagaaggtttgatacccacatcggtgatgaatcgtacacgagactgcgcttcaccaacaaaatccaccaaccccacaacaaccttaccgcaaacaacaggagaattctttttaacgccctgtcgctttcctatattaatccaacaagaactaccccagtgtgctggatctcgaaagataactcttcccataatgggagattgaaaatacgaggatagaatttctgaaaacaaaggcggagactgttttgcctcttccatagaaagaatacgctcttccaataaacgaattttttctttcaataaaaagcattgagtttcttcaacaagggcctgagaatcagacccttgccgaaatggaagaaatttggaacacacccgaacgaatgtatcctggatagactcgtaagcacttcgaggaagattccaactcacaataatcccgaaggcaacaaaaagatacgtaatgaaccgaacgcgtttatgatacggaccgagggtattcataagcctgagcaaaaccgtgagtaacacgatttatatttttatccgtaatgccatttaaattgaatcttccgctgcggttgtgtaaataccaagctcttctctaaggaacagcacttgttcctttgaaaaacctggatacccaaaaaatcctttctgagaagctatgaaatcgaaagagtgccccgctacatttcgcatggcaatcacaaaactcgaacgaatctcttccaaagactgccgaatgccattcaattcaagctcccattcttgccgtaagtaaggattgcttaatatagaagtcacgatagcaactccttctctagccggagatgagtactccccacgaatctgttcttctaaaaaggataaaatacggtttaaatcctgtttatcttgatggatagctccaaaaaatcctacacgagaaccatataacgaaaaatttttactagcgcttcctgctacaaaagtagtaaccccagcttctatacacagttgcacaggacgacgatcttcttctatcccactagcaaaacctaaataagccatatcaaagaaaggaataagatcccgctccttaataatcgtaatgatttctggccactcggaaagaggaatatctttccctgtaggattatgacagcaacaatgcaacagaactaatgaagtctcaggagcagatcgcaaaacagctttcaatccctgtaaatccagttctttggtctcctgatcatagtaaggataatactctaaagctaacccttgatgagaaaaaatcctagaatggttcccccatgtttgagaaggaatatacaccttacccgctaaagatgcgttggcatatacagaagcccctaaatgtaaggctcctgtacctccaattgcctgcacaccaacccatcgattagcatccaattctccaaaacaaagagctgccatttcttctaaaaaggtagacgatcctttgatgggtagataatttttatctttctcatcgtcaaaaaaaacagactgagcctttctaacgctcgagaaacccccatagcgtttcttttcccgttcgtaagtacctagtaataaattaatcttatcctcacgaggatcctcttggaaagcctgcgctaaaccaagaatagaatccggagaaaaggaaggtaactgttcaaaaagactcacaataaaacctctctatagcgcactgctgcttactgtctttttttccagtaagatgacagcttgttgtcctaaatcgtgtaaacatgataacctagtttcttccctcggggtattagctcagttggtagagcgcaacaatggcattgttgaggtcagcggttcgatcccgctatgctccaatttctgtttaatcccatatagaagaaatttccttgatcttgtgcttcttgccttgaaacagtacagtttctccaacagcttttccaaccatttcttgggccagtttagattttagtgataaaatcttttcatccggattagcatcccatggacccaatatagtgtagcaaaccttatctccttggtcactttcaagaacaaccttacaacccactccaacagaatctgtgaaaacagcatctttagttaagatttttgctcgattgatttcctcagacaaaacacgaatttcttcctgtagtctagcccgtctctctgaagcaaatttgtattcagagttttctcttaaatctcctaaggctctagcatcttctatttccttagcattctctaccatctctttccctaccagagattgtagtttgtttttcatacgagtaaaactatctgaagtagtccaaagaatattttcttcctcttctagagtccctctcttaagagctggctgcacaacttctgccaaacttcttaaaactcccagatccccttgagtaaattgcgggcacttagaagataataaaacaaactctttaagatactctatagaagcttgatctatgatttgacgaataactaaaaaccgttgtccaactaaaaatgaatagagttttttccctaaatctttttgaggcgttgtagcgactttgtgcataagctccaatgcgctagcaagcatttgccgctcgatttccttcttatcagactctgcaaataaaccgtcttctccatcaaccacacgagcaaataaccaaacaaaaagctctggataaagcaaaggctgctcaatcatagcaaaaactttttttaaaatattctcgcgagcttctttatctgcattcaagaccttaaagacctgttcacgaagcatagacgtgcttgttgtgagaaagagtttggtatacacaggaacccaaacaggagaacatgagtggattaaagccagaaaactcttctgtaaagagagaatctctatgttattcacaatatcgaataactgatcttcagagagttttgcaatattttcatactctaactccggagctttttctccaagaaactctgataacaacatcgctctttggatcaacaaagcggaatcagcgggcaaatctaaagcttttaactctttgatgaccgattgtcgattagattcatctttcagctcacttcctaaatctcttacaaaagcataacaagaagtgatcttcttattcgcatcattgcttccagataaagaggcttgtaattgagaaacaaaagaaaatcctttcggatcgaatacataaggatctttagaagacgcaggagctaaaattcgcgcatcttttttcattttaatcttagcagattgccaccaacgactccaatcttcttcaggaatcacaagctccaccagctcgtttcggatctctttagcattcttgggtcctaaatcttttaacagacactctatggctgctacaggctctttgcgagcaaacgcttcaaaagcatctggatcaccaaaccttcttgctaaaaagtgatcttttcttaaaggaactaacatacggaaagctgtttcaaaagagatatctttcgccgtaagaaccccttcaaactcaacaagaactttctgttgaaggaaagagactcccatgatttctccaactccccaaccaccttgatgaaaaacaaagtttccttcacttaggtgcataagcaaagcaaaacgtccgagacaatgagaaaaggtgatcccgtctcgcaaaccaactattcgtaaagcttccttgtaattggctgagtcttcgtatttttttacctgttgaagagctatttctagcagattcttactgtttgttgtttggacatcaaaaaccagagagagtactttatctttctcttctccttcaggaagttgttcccataaaggaattacactttcagcaatcttcccaaatgctggggctatagttgagcccttgattttttccagtaagacaactagctcgtcccccttaacgacatcattaaaacagtactcttcccacaaactaaaaaaatccgaaggatgattttctattaaggactgcagattttctagataatccacgatggctcccctttttagtccggaaatatacgccgaataacaaaaaagagcaatattacatcacaaaaaacaagaaaaattttattattaaataaaacatcgagatttttgttatgaaaaataattccgctcaaaaaattatagattctataaaacaaattctctctatttataaaatagacttcgacccctcctttggagcaactcttactgacgacaacgatctggactaccaaatgctgatcgaaaaaacacaggaaaaaatccaagaattagacaaaagatcgcaggaaattctccaacagacgggaatgactcgcgaacaaatggaagtatttgctaataatccagataacttttctcctgaagagtggcgagctctagaaaacattcgttcctcttgcaatgaatacaaaaaagaaactgaagagcttatcaaagaagtaaccaatgatattggtcactcatcccacaaatctccaacgccaaaaaagacaaaatcctcctctcagaaaaaaagtaagaaaaaaaattggattcccttataaaaacttctataatcccgagatatgaaaatagttgtttctcgcggattagatctgtctttaaagggagctccgaaggaatcgggtttttgcggtaaggtggaccccacctatgtttccgtggatttgaggcctttcgctccccttcctttagaggtaaaggttactccaggagaccaagttactgctggttctcccctggctgagtacaagcttttttcaggagtgtttattacctctcctgttgatggagaggttgtagagatccgtagaggaaataaacgtgctcttttagagatcgtcatcaagaagaagcctggtatttctcaaactaagttttcttatgatcttcaatctttgactcaaaaagatcttttagaagtttttaaaaaggaaggtcttttcgctcttttcaaacaaagaccttttgatatcccagctcttccaacacaatctcctcgagatgtttttattaacttagcggataatcgccctttcaccccttctgtggaaaaacatctcagtcttttttcttcaaaagaagatggttattacatttttgttgtgggagttcaggcaatagcaaaactatttggactgaagcctcatatcatttctacagacagactaactctcccaacccaggatctcgtatccatagcccacttacacacaatagatggccccttcccatcaggatctccttcaacgcacattcatcacatcgctcgtattcgaaacgaaagagatgttgtgtttactattagcttccaagaggtgttatctatagggcatctatttttaaaaggctttgttttaggacaacaaatcgttgccttagcaggatcagctcttcctccttctcaaagaaaatatctcattactgcgaaaggcgctagtttctctgatcttcttcctaaagacattttctcttccgatgagattacccttatttctggagatcctcttacaggaagattatgtaaaaaagaagaaaatccttgtttaggtatgagagaccataccataacactccttcctaatcctaaaactcgtgaatctttcagtttcttgcgcttaggttggaataaacttacagtcacacgaacctatctatctggttttttcaagagaaaacgggtcttcatggatatggataccaacatgcatggagaaaaacggcccattattgatgctgaaatctatgagcgtgtttcagcaatcccggttcctgtagctcttattattaaagctttggaaacacaaaactttgaagaagcgtgtcgcctagggctcttagaagttgctccagaagattttgctctccccacattcatagatccttctaagaccgagatgttctctatcgtcaaagaatctcttttacgtacgcaaaagagaatgtggtaacctcctcgtaaacatctcggtgctgcacaaagttcttcaaagaacacttctctcaaagggaagagcatctttagctagccattctaaaacccatggtgttgcgtaactaattatagctgttgcaccagctctcttaatcgctaataaagattcttttattacactttctttgtttaaccacccatgaaggcaagcagccataatcatagaaaattccccgctgacttgataggctaccaccggaagatgggtgttttctctcgctttaacgattacatctagataaaaacctgcgggttttatcatcaccatatcagcgccttcttcttcatctaactgacactctagcaacgcttcttgaacattggcaggatccatttgatatgtacgcttatctccagactgaagatgtgaagaaagagcatcccgaaatgggccatacaatgcagatgcatattttgcactgtacgagagaatacccgtgttgacaaaccccatctgatccatctgctctcgaatatgcttcactctcccatccatcatatcgctaggagcaacaatatctgctcccatttccgcatgcatgacagcgatacccccatatacacggacactttcatcattgataacgtagttattatgaaaaatcccatcgtgaccactggttgtaaaaggatctaaagctatgtcactgatgacacataattctggaaaagatttttttatcgcttgaatccctttacaaacaatgttgtaaggatgggacgcataggatccaaattgttcttttttattagcatcaattacaggaaagaggataactgctttcaatcctatcgtacaaagtctctctaactctttagagaccatgtctaaactccatctgtatactccaggcatactctctatttcttctcgaattccagagccatctttaagaaagatgggccagatcaagtcactagaacagagttgggtttcttgaattatagatcgaacggctgcactttttcggtttctgcgaggtcgttttagtaatggaagccttgtcataaagttgtacacttatcgaaagtttccacccccctagaagaagattcgtagagatatttattagtttcttcttctttaggggatgtggaaattgtttataacattgttgtttcgagagaaaaagctgtgaaaataatgttcataactttgttcacagcttgtttaaattgtttataacaaaaagttatgcctatttgtaaacaggtggtcaacaagtttttcaacaagctttttgctgaaaaactttgagtgttttgttatgtgtggtaggctaatctgctttataggagttttcttatgttgagcaaagagggtggtttttctgaggagcaaagagcgcgtttatcgcattttgtgacgaatttagactcgcctatatttgctttgaaaaaccttccagaagtggttaaaggcgctttattttcaaaatattccagatcgactctggggttgcgaacgcttcttttgaaagaatttttagatggggaaggcggtaatttccttgatgatgaccaacaagattgtgagttgggaatccaaaaagctgtggacttctatcgtcgcgttttagacaactttggtgatgattctgttggagagttgggaggagcgcatcttgctctggaacaagtatccatgctcgcagcaaaaattttagaagatgctcggattggagggtcccccctagaaaaatcgtctagatacgtttatttcgatcaaaaagttaacggggagtatttatattaccgagaccctattttgatgacctcggcctttaaagacgtctttttggatacttgtgatttcctattcaacacatactccgatcttatccctcaggttcgttcccatttcgagaaactataccctaaagatccagaagtttctcaatcagcgtatacagtttctttacgagctaaagtattagactgtttacgaggtttgttacctgcagcgacactcacaaatttagggtttttttggtaatggccggttttggcagaacttgctacaccgtttgcaagacaatagtttggttgaggtacgcaatattggagagcagtccttaacagaattaatgaaaataattccctcttttgtaagccgcgcagagtctcatcattatcatcaccaagctatggtggattaccgtcgggctttaaaagaacaattaaaaagttttgcacatcgttacggggaagagagagaaatttcgaaagaggctggtgtaaaattagtatacggagatccagacgggttatacaaaattgctgcagcctacatgttcccctactcggaacacacttatgcagagctgttagatatttgtcgcaatattcctaatgaagatctcatgcgtatcttagagtcgggagcttctttccgagagaatcggcggcacaaatcccctcgcggattggaatgtgctgagtttgcttttgatattacagcggattttggagcctatcgggatttacaaagacatcgtatcctaactcaagaaagacagcttttgacgaaaaaattgggttacacgatgccttcacaattgatcgacactcctatggaagctcccttcagaggagctatggaaaaagctgatcaagcgtatcgtctaatagcagaagagttcccagaagaagcacaatatgtggttcctttagcttacaatattcgatggcttttccatatcaacgctagaggtttgcagtggctttgtgagttacgctctcaaccacaagggcatgaaagctatcgtaaaattgctatagatatggctagagaggttattcagtttcatccagcttacgagctgttcttgaagtttgtcgactactcagagactgacctaggaagattacaacaagaatcgcgtaaaaagtcttaaagaaagttctggatgagaggatttgaacctccgcccccttgcaccccatgcaagtgcgctaccaggctgcgctacatccagaaaatagaaataaggggtattaaccgaccacagttttacagtaaaaactttcaaagtcaagctatttaaatacaacgaatataagtttttggaaacctgttataaacaaataattccatcaaactgaaactcgcatttttgaaattcccgaataccaataagagcacagcgttctataatggtttctaaagaatctcctgcagaaacatcagctgcatcgatatcaacggctatagaagctgtaaaggaagccccccctctctctcctttaacttgaaaattaacgaaaataccctgtttggttttagaaatatttttgaatctgacgatgttgttatcaattaacgttttcattttctctcaaatttttcgatcaaaaactagataaagcagagaatgagctgtttatcacagaacaagtgtagtctaaacttgaaaaaaagtctgaagatatcgttttttttttctgaggctctttgaaaaaactatttttgttgtattaggtaatctaatagttcaatgggtttatttatatggcggggcctaaacatgtgttactagtaagtgaacattgggatttattttttcaaacaaaagaattgcttaatcctgaagagtatcggtgcactattgggcagcaatataaacaagaactgtccgcagacttggttgtctgcgaatattcattgcttccaagagagattcgttctccaaaatctttagaaggtagttttgttttagttcttttagatttttttgatgaagaaactagtgttgatcttttggatcgtggtttttggtatttaattcggcctattactcctagaattttaaaatccgcaatcagcttgtttctttctcagcattcgctacattctgttccggaaagtattcgttttgggcctaatgtattttatgtattgaagctcacagtagaaactccagaagggagtgttcatttaacaccatcggagtctggtattttgaaacgacttcttattaacaaaggacaactttgtttacgaaaacatcttcttgaagaaattaagaatcatgccaaagcgattgtagcaaggaatgtagacgtacacatagcttctttaaggaaaaagttaggagcttatggaagtagaattgtcaccttacgaggtgttgggtatctattttcagatgatggagataaaaaattctctcaacaagatacaaagctttcttaaaaccccagggggtgtttaaatacctagctatgcttgtatcaggagcttagttatggttttatcagcctccttattttcaccagaagagtttctttatccagagatcgtaagccaagctgaatttgtttggtctattttgactttgttagaagagaaactagcttctcatactttttcaggaatccatgggcatcttgaagaaggggtgtatctaaaaaataaagagactatcgaaatccaagaaggagcttacgtagaatctggggcttatatttgtggtccttgtattatcggtccctatacgcaagtgcgtcatggtgcatatattcgaggcggtgtaataactagctcacattgcgttataggacactgttctgagattaaaaacagctatttagggcatcacgcgaaagctgctcactttgcttatgtaggagattctgtttttggttccagagtgaatctaggggcaggagttcgttgtgcaaactttagattagatggcaaaaccattttcttccatcattctggagagcgttatgatacaaaacggaaaaagttaggagctttcctaggtagaggagtaagtgttgggtgtaataccgtacttaatccaggatgttatgtagccagtgctacaaagattcttcctaaatcaaaccatttactaagaaacaacctttgtcaaacaaaggttgatgagaaaaagaaggcagttgcttggatatggattatttcagcgtttatcgatcgaaagtagaaaaaaagcttcgcgattctttgggagatttcggtaacactcagggtggattaagagacccaatagagtatgcccttttaggaggggggaaacgcgttcgtcccttgcttgttggtttatttgcggaaggtatccataaagagcgagatgtcttggataccgccattgctattgagtatatccatacatctacgttaatagccgatgacttgccgtgtatggacgatgatgatatgcgtagaggcaagcttcggttcacaaagcttttgatgaagcttcggctctcctggcttcgtatgctcttattccagctgcttatgcacgaattcgtaagaatgcaaaagcgctaaaagctgtagtttcttgtgaacaagatgtggaagaggcttacgaagatattttggagctgattgagttgcgttttggcgtaggaggaattttaggaggacaatatgaagatgtattttttcatgatttctccaaagagaacgtattagggattattaaaaagaaaacaggagctctttttgaaattgcttgcgtatcaggatggttgtttggaggaggagaacgggaaagctccactttagtagctgaatttgccgaacattttgggttacttttccaaatacgcgatgatcttgccgatcttagtcaagatgatcaggaagagaaacatatgaactatgcgttattattcggagaggtagcagcaaaagagttgctagaccattcttttgaatcctgtattaaaaatctccacctattgcaggagaggggattagagtgttcggagccgctagagatgttgtgcaaaaatgtgttttgtggatggaaataaatactttttatgctaacctggctgcagaagactttggaagaggagcccacagaacgtgggcgtctcttttttttatgctggttggttttcttgttcttttaggcaacagctctgttcaattgttggacaaaggtgttttctacggaaaggcttgtttcctctctctgcagagaaagctcgaatacgaggagcttgagagcattcttctgaacaacatcctttatgggtagcgatacaagactcacagcaaataaagaggttgttacagtctgtgtttgcacaattgtagtaggtatctgaatctgtgttgcaaagagagcaacgagcaataggagacacgttaggatccgcttcatcgataggcatagccatccggtcatcgaaaacaaagagtttacctctccattttcctgttcccatttttaatccataggcgatcacgcctccatccagttggtacacttctttaaagcctttctctaaaagaagagcggagtagagttcacaacgaatacctccagtgcaatacatcatgacaggagtttttgcaggatcaatgctctttggctagacgatcagcgtaatcaggaaattctcggaacgtttcaatatcagggagaacagcattttcaaaatgaccgattttccactcgtagttatttcgaacatctaagactaagcaacgattctcttggagtttttcatgccactcttcaggggaaatgtgttttccttgttttgttgtatcgacagagcatcctaaagcaacgagttctttacgatacttcactgtaactctagggaagatattctcttcaatatggtggattttgaatttaatcgaggcaaaatctgggcgttgtttcagccaagccatatagcgttctgcgtctggctgatagccgctaaactgaccgttaatcccttcttcagagatgtaaatccggcaagaaacatccatagttttgaataattgcttgtgtaaagcaatttcttcataagggttgcttacgggaccaaagtagtaatacgctaaagcataataattcttttccatgaagacatcctatatgctgaaaacttatcttaagattaaaatcgagaagctcgaaaagtttgtttaaaaacttttttaaatggctgagaggcagtatacgagatggtaagaatagatcaaagagttttgatgaagaaataaaaagaaacctttttcagtatctttctaaacaaacagctagttaaatcgaccttttttgagattttttaaataagaagagtttttttaagcactgagaatctaggaaatccgttgtagaaaattggaaatagaactagaatgctcttttgtattttgtcaagcgcggggaactcgcgttcaacaacgtctcccaataaaaattagcgaggcgatgttttttaaggaataaaataaggactgaacatggcgagatattgtggccctaaaaacagaatagcgagacgttttggagctaacatctttgggagaggtcgaaaccctttgctgagaaagcccaatcctccgggtcagcacggcatgcaaagaaaaaagaaatctgactacggcttacagttagaagaaaagcaaaaattaaaagcttgctacggaatgatcttagagaagcaattagttaaggcttataaagaggtcgtaaataagcaaggaaacgttgcgcaaatgttcctagagaaatttgagtgccgtttggacagcatcgtctatagactaggattcgcaaaaacgatctttgctgctcaacagttagtttctcatgggcacgtattggtgaacgggaaaaaggtggatagacgctcgttcttcgttcgtcctggaatgcagatctctttgaaagaaaaatcaaaaagattagctatcgttacagaatctttagagaacaaagatcaaagctctcttcctgcctatctatctttggataaagcagcttttaaaggagagttggttgttgctccagaactggatcaaatcgcttctcaacttcctttaccagtaaacgtttctgttatttgtgagtttctatcccacagaacataatcatttggttcaaggatttatatgttctttgaagcctcgcttttgcgaggtacatttttcataaagagagaggagaaaaactccttctgttgactttagcaaactttttgtaggtaacggatttctttagtccacagatctggtcctccaggagtctctaggtatttaggtagcatgcgggtacgctcatcttgcataaggaagcaaaaactgtctgagcctatgcaaccttctccaataggggcatgacgatctttgttttttccgagagcaaagacagaatcgtttaagtgaatggctcgtaaaaaagataatccaatcactgcgtcaaaatgtttgagtacttgctcccatcccgcgaccgatgaaatatcgtaaccagcggcaaaaatatggcaggtatctagacaaacacctatgggtatgagggctttaatcccttgaattaggtaagcaagttcctcaaaagaacttcctattagggaaccctggcctgcggttgtttcaagaaggacaacaagtggaggatggttttcaaaaaggggggccatttgtgaaaaactcgtgatagcacgatcgaggcaactttctttagaatcagaaagagccgctcccggatgaaagttgacaaaagaaatgccgagagagatgcagtccgctatttcttggtgcatacacactcgagttttttctagaatctccggattaggagctccagggttatttaaataaccagcatgactcatgatgtaagatagagaagtttcatttagtgctatgcggaactgatccaccatttcttgagttagtgcgcgtcgcttccactgacgttgatttgcagtgaatagctgaacggtggttgctccgatatcgcgcccttcgtaaagagcattatgaagtcctccagcagcagacgtgtgggctcctagtaaaggctcttgaggaggaggaagtataaacatagcccgttctctatctagtcattcatgatagaagattgccagaggttcttgattaaagaaactataaatagcgagaatagtggtagttattgcattatcagaaaaatatcactagccgttattcggtataaagggcctaaaaaggcttaaaagacataaaaagaggagagtgatgaggaaagatgatgaaggatcgctagtgcgctcattgtttaatttgctgtccggaacgttttttagtcgtcttactgggatgttacgagaaattgttatggctacatatttcggagccgatcccttagtagcatctttttggctggcttttcggacgatcttttttttaagaaagcttttaggtgggcctattcttggactcgcttttattccgcatttcgagtttttacgtgcgcaaaatatttctcgagcaacgtttttctttaaaagcttttcgagattcttttgttacagcgctatattatttactttaattatagaattaggactctgtgtttggtgttcttgcgttacaggaagcctatttgataccctatttttaacaatcatattgctaccttccgggatctttctgatgatgtatacagtgaattccacgctgttgcattgtgagaaaaagtttttcagcgtaggacttgctccttctgttgttaatgtgttgtggattggaacggtctttttagcacggaattatgatccgagaaatcgtatttttggattagctgtagtccttgtcgtaggcttcattttagaatgggctattacgcttcctggagtcatgaagtttttgggacaaagtaaagaggttcctcaggagcgggatagtatccgtgctcttattgccccactgtctctaggattgttatccatgggaatctttcagttgaacttactatgtgatatgtggctcgcgcgatatatcaatgaggtaggacctctgtatctgatgtattccgtgcgaatacagcagttacctgtccatttatttggtcttggagtcttcacagtgttgctacctgcgatttctcgttgtgttcaagatcaagaacatcaacaaggatatgatctcctgcggttttcgttgaagctcactgttgctgttatggtggttataacgatggggctattgctttttgctttgcctggggtacgagtgttatatgagcacggagtgtttccttacaacagctgtgcacgctattgtagaagttctaagagggtatagtggaagtattatccctatggctttagctcctctcgtatcggctctattctatgcaagaaggaattacaaagttccgatgctagtagggatcattgctgccgtagtgaatatggttcttaatgtgatcggatgtttagtttgcaaacaggttgctgttttagcctacgccacttctttagcgtcgtggggtcagttagcgatgctatggtattgtgctggtaagagtcttcctacttacaaaggattgatgtggagaacatttaaagagagtgggaaaactgtcattacaaccattctagcagcggttattacgattggtgtgaacatagtaacgcataccacgtacgtagtgtttatcgagccattaacagtcccaacaaaacctttagtgtcttttttagatcagtgtggagtcttttttgcagaatcggcacttttcttatcggtattgtttggattagctaaattactaaagacagaagatcttgtgaatcttacttctttccaatactggaaagggcatcagtctatcctaagaaactagctgtaagctagtctcttaggacatctttttcttccaagaatagaactgtatttttaaaaaaaatccttcctgagctatagtttttggcttggttacgatcatgcttatgtaagtaagagatttgtaaccgtttgcgaaaaaaatcaagcgtcccaggaagagagatttccgtgagcacttctcgataataaaatacaaaccatgggtcggttgtatgagatgtcaaactttgctaaggacattatgaaaaaatacttttataaagggtttgtaggcgcgcttttattagcttgtgggtctacaaacttggcttttgcgcaggctagttcgatggatagccagctatggtctgttgaagatttagattcttatttgagttccaagggttttgtagaaactcgtaagcgccgatggagctttacgtttagctggagatgtccgcgctcgatggatttatgcaaaagaggcatcttgagacaactcagactcctactaaacctattttacctatcaatcgttatcgtagtgaattcaatttgtatgtggattacaccgctgctaatagttggatgacttcgaaaatgaattgggtaacgattgctggcggagaatcttctgcagcagggttagatattaatcgtgccttcttaggataccgattctacaaaaacccagaaacgcaggcagaagtatttgcagagattggtcgctctggattgggagatatttttgattccgacgttcagtttaatagtaatttcgacggaattcatttatacgctgcgcgacgtattagtgagaaacttcctttcactatgattgttcatggtggtccttttgtcgtgaatatggcagagaaagagtatgcttgggtcgtggaagctattttaaataaacttccaggaaatttcgttgtgaaaacgagtgttattgactggaatacgttaacagcaaaaacgaatgatccagcagacgcaagcactgcacaaccagctaaacctaataccaagtacgattatttagtatggcaatggttggttgggaagagcacagctatgccatggtttaatggacaaacaaaaaatctttacacttacggagcctatctctttaatccattagcggaaataccagagaactggaaacaatcaacaacaactcctgcaacaaaaattacgaatggtaaggaaaaccatgcttggttcatcggctgctctctaggcggtgttcgacgagctggagactggtctgcaacagttcgttatgagtatgttgaagctttagcgattccagaaattgatgttgcgggtattggtcgcggaaaccaaatgaaatatgggtttgctcaagctatcaaacaaggattggatcctaaagaatctaacggctttactaactataaagnngtttcctatcagttcgttatgggtctgacagattcagtttctttccgagcctatgctgcttattctaagcctgctaacgataaccttggtagcgacttcacctatcgtaagtatgacctaggtttaatttcttcattctaatcccttaagggatagtcttttaagagcccacacccaaaataacgggtgtgggctttttttattgccttttataatttaagtaaggtttttttatttttttatattgtatggaatcaggaccagaatcagtttcttctaatcagagctcgatgaatccaattattaatgggcaaatcgcttctaattcggaaaccaaagagtccacgaaggcgtccgaagcgagttcttcagcatcgtcctctgtaagcagctggagttttttatcctcagcaaagaatgcattaatctctcttcgtgatgccatcttgaataaaaattccagtccaacagactctctctctcaattagaggcctctacttctacctctacggttacacgtgtagcggcaaaagattatgataaggctaaatcgaattttgatacggcgaaaagtggattagagaacgctaagacacttgctgaatacgaaacgaaaatggctgatttgatggcagctctccaagatatggaggctaattcagatcctagtaacgatcataccgaagaattaaataatattaagaaagcgctcgaagcacaaaaagatactattgataagctgaataaactcgttacgctgcaaaatcagaataaatctttaacagaagcgttgaaaacaaccgactctgcggatcagattcctgcgattaatagtcggttagagatcaacaagaattctgcacaccaaattattaaagagcttaaagaacaaatctctaattataaagctgttcttacagatgtggaaaaggttatcaaagaattttctgaagcgggaattaagttaggacaagctttgcagtctattgtggatgctggggatcaaagccaggctgcagttcttcaagcacggcaaagtaatagcccagataatatcgcagccacgaagaaattaattgatgctgctaaaacgaaggtaaacgagttaaagcaagaacatcaagaaatagcggactcgcctttagtgaaaaaagctgaggagcagattaatcaagcacaacaagatattcaaacgatcacacctagtggtttggatattcctatcgttggtccgagtgggtcaggtnttccgcaggaagtgcggcaggagcgttgaaatcctctaacaattcaggaagaatttccttgttgcttgatgatgtagacaatgaaatggcagcgattgcaatgcaaggttttcgatctatgatcgaacaatttaatgtaaacaatcctgcaacagctaaagagctacaagctatggaggctcagctgactgcgatgtcagatcaactggttggtgcggatggcgagctcccagccgaaatacaagcaatcaaagatgctcttgcgcaagctttgaaacaaccatcagcagatggtttagctacagctatgggacaagtggcttttgcagctgccaaggttggaggaggctccgcaggaacagctggcactgtccagatgaatgtaaaacagctttacaagacagcgttttcttcgacttcttcaagctcttatgcagcagcactttccgatggatattctgcttacaaaacactgaactctttatattccgaaagcagaagcggcgtgcagtcagctattagtcaaactgcaaatcccgcgctttccagaagcgtttctcgttctggcatagaaagtcaaggacgcagtgcagatgctagccaaagagcagcagaaactattgtcagagatagccaaacgttaggtgatgtatatagccgcttacaggttctggattctttgatgtctacgattgtgagcaatccgcaagcaaatcaagaagagattatgcagaagctcacggcatctattagcaaagctccacaatttgggtatcctgctgttcagaattctgtggatagcttgcagaagtttgctgcacaattggaaagagagtttgttgatggggaacgtagtctcgcagaatctcaagagaatgcgtttagaaaacagcccgctttcattcaacaggtgttggtaaacattgcttctctattctctggttatctttcttaacgtgtgattgaagtttgtgaattgagggggagccaaaaaagaatttcttttttggctcttttttcttttcaaaggaatctcgtgtctacagaagtcttttcaataataagttcttagttccaaaagaagaaaatatgcttttttattcttctgggagaaagttgtaaaaaaaatattattgggataggttcgcgacaagtacaactgtagagttgagagagttggcaatgaaccgtattcatcgtacacaaggatctttaacggattataatagcactcttgaggctattgcaaagaagattgccaaaccagactctgcaacaatagtatctcaggttgctcaatatgagcagttcaaaatggaacaagaagctttaaaagctcttcttgtttccttcgatcaaaaagcagaccagcgatatcgaaatttgattcaacgactggaacagttggatgtagatagacaaacaggacgctctatagagagcccacacatccaagaaaaaccgatggcttccctgcaatctgaaaatcaggttgttgcacaagctgtagttcagtctgattctagcatgcctatttttacaggcattaaacaaagttgggcagtacgattagtgcagggtattcgtgaaattttggatcaactcttagtggacacatccttgtttacggaagaagaacggggagatttacttgctatccgtatggatgccgcttccctacaggacaagcaagagcgtttgtctgcggaagatattcgttctcttctttctctttcgaatgatgttatgcgagttttgcagaaagcttctgtatctagcacgcggcagctagaattgatccaatctttgatagatatttttggtacggaagagaatttagagcagtccttcgcccaggtacgattggagaacttccaagcgattttatctgtgattaaagagcgtttgacagaagaagagtttcgggtattccaagaagtctcggaagaaatttcctctatacaacgcacgagtgaatctcatctcagtccagaacatatagaggcgattgctcgagtcggtgggtatctttctgctaagatcgtggagtctgagctgaaggcaagtcagaaggtggatctctgtcaacgaatagcagctatgtaccaagaacaagtggatgcggtacaagcgtatcatagtctcgaacaagatgctctatttgtgaattctaggcaacatggttacttcgtgcaggtgatttctttagtatcctctcttatgcactcattgtctcctactagtgaagaggagcgtattttactgaaccctgccatgatggtaagtgttcttcccactgtgcgtgcaataggtttacgttttgactttttaacagctgagcagcagcaaatggtgaatgctgcggtatcatcgttgcaacaacagcagttagacgaatttttaggagttctctgtgcgcatttggttgttgttaattgccagaataaagaaacaggtctcttagaaggtttagaagaaagcttttcagaaacgttaagtggtttgagtaataactttgttttgacggccaaaatgcaagacattttgcaggtttgttctttacaaggctttgtcacattagcaaacggggatcgatacgagttattttcctataatgattcaggagaagcggtatgtgatgagatcgctctaggcgatggatttcataaagtgctaggaacgatgttagcagtagcgctttctcaagcagaggtatttaaagcaagagtgcgatcgattcattctgcaagctgattcagagaagaatatgattcacaaacgtatggttcaaggggaacagaagagtctattcttgaccaagatgcagacagagttgaatgctgggaaaactattgcacaaactaaggaagtagaggcttctccgctcccttctgccgttgcttctgtattgattgaccactacatgccaaaggaagtggagtttttagaaaagatctcgtctcgtctgtattacggaaataaaggttcggatataggcaacaccattttagatgcgattagtttgtatgtaaactccgcaacctactttggttttgctaactatattgggcaacctcctgttgtaggtaaaacaggggagaatatttttgcagggtctgcagataatgctaaagccaagttagacgaagaaaggaaacaagtagatgtgtttctagaaattacgaaagcagctaagactaccgtcactaatcaacaaagtgcggttactgatgatgacaagttatctacagagcagaaagcaaaaattaatgcagagttgacacagtataccgatatgcttaacgcaatcaacaattctttaacatcattgaaaactcaattggcccctttatcagtgagtactgttgaaggtgtggatggtgtttttgaggttaaaaatggtaaaccaggagaaaacggaaagaactggagattagttttacagactttagaggatactgtggtatccggagaagtcggtagcccaactaatattggaatgttccaaatgcaagctctggtacactcgaatcagcaggcctatgctgatatgggacagaattttcagttagagttgcaaatgcatctcacttctatgcaacaggagtggatggtggtagcaacatctcttcagctattaaatcaaatttatttgggattagcgcgtaatctcttaagatagcttcagtaataatcgtgagggaaagcagcttaaaaacaaaaatttttaagctgctttatttgtctaactagccagttttcttgttaaaccaagatagatttggttaagaatttgtaaagatgtggctactaccgtccattcttgctgcatggccgtcatatgcatttgcatttccagttggtagttctgccccatatccgcataggcttgttggtcagattgcacacttgcttgtaaggggaacagtcctccgctgatgatattagaaggaagtcctgagacaagagcatcttctagaatttctaaacgtgcttgccactgatcttttcctctgaacacgtggaaagttcctttagggtttgttcctgtatcgttgcctctctggttgccattacgaactcccacgctgagaggattcaggtacacctgtaataggactaaagaaccgctaatggcgttgaggttgtctgcgtatccttttaaagcatctgtgatgcgtaatctctgttcgttagtaataaccttatcgttttggactcgttccatctgttcttggactacctttagagcttgagtagcatattgcaggtagagtttagcttgttgtttttctaaagcgagttttgcttcagctgtctctttagagccagagaaggtatcntgagccatagctgtcataggttgttgtccaacaaagctcgcaaaattgaagtaggtagctccattcacgaattgagcaatagcttcaatcatagcatttccaacactagagcngaagttactgtaatacagatccgatttcatctgngttaagtaatcaatctcttgaggcatgtagcgatctataaggaccgaagcaactgcagaaggaaggggaagagagcgaatttcataggattgtgcaaggagttggtaggaaaacaggtcttttcgtaattgatttattttctgtaagaagttctcacttccttgtaaagttccatctagttttgtactttctacttgcgctagagctctaaatttaaaaaaggctctagcagaagtttctgcatggttatttgctgccaaagtaatgttgggcaagaatcctatagatccaaagttaagaaggattgggttaagagtggctttgttagaacttgtatcgtttttaagcgggccgaaaatagtatattgtctctctataccatcaaccttagctttaaattccccgttttcttgtacaattttattaatcgtagattttaacgtttgggctaaggaaaaatccgagacgatagtattagcttgcgaggttaacgcttgtttgacttcatctgttgtcacagtctttagacgagacgactgttgcagacgtaaagtaagcccaaaaggcaccgatgtagttacctcctgagaagtcatcaagtttcttgaccgtttcattgacgagatttttctgttcaggagttagttcatggaaacgagtgtcaatggcgcgcactgcttgcagggctccagcaattgatgcgttcgttacctctatagtagtctcatttagtccgataggagcgaaactccccatgatgaattcaacgagactgcaaatgtttgagaacagagagctgttgcgagcgtttatataaatggtctcattcaatacgttatctaagtttttgatagataacacttggtctctgtaaaggtcggcaatattacggcagagttctatcttatcgttgctggagagagaagaattgatgatagcggaagacagatctttactcgtctgtaaaatggtatcaaatccttcgtcattaaaaggttcaacatactcacggagagtatctatgatcatctgtaattctttaaaggattcgaattctgtggcagacagtcgtgattggaccatattcagagtatcctgaagtccttcaattcgtatgtctgcaaaaacttgttctatagaagcatcttcgccaaaagaatccaataattgattagaaaagagtactttttgatttccttcgaacgggaaagtttgaatagcagaaaagatctggtcaggaaggagataaaatgtctctaagtcttcgttagatagttctctgtgattagccttatctactagagtagttaacgaatcaaacaaatctgtcagaggcttaaggtctgtttgtggaggattttgttgcccagcgatttccgtagcttttgttttagcttcgtttacgacagagagaaagccaaccaatacattgtgtacccaggcttgtttcgaagcgttatacagaggattagaagagggtggatcgtatgtgattacagctgattcatctgaaggctgagacgtggtcgttggagcgctagaagatagggaagcaactaactgttcgtatttccctttcacatcattatctaaatctaaaagagataaaacattctgaatagcactacgctctatttctgttttttgaaactgcattacttgattcatgcagaaagttttattcttatgcgtaggaagaaataattcttctatttttgtgtaatcttttgaaacagagttaattttattaaatatgttcatagaacacatctcaactaatgtcttttataaaaagattaccataaaaatttttataaaaacaaacatagaaaaaaacttttttaaataagaaaataaaaacataaaagtttttagttttgtttttatgtcttcttactatttaaattttaggccaactactgtatctggagagggtttatttaagattaaactccgccaatccttgctcggattttaaaaaccaagcacggccagccattgatatggaggagttaaactcaggactttatgtactaagacgtttagctgtagctttggaagctggatatntgggagttggntctgtggtcaatccctctaacagagtatttcctggaggagactggggggtaagaagagccgcaggaggcagcactccggcagcaggtactatttctggtagtactatngcagatattaagcaaagtaccgctaaagtattagtaactaccattacagatagtttgaatgctctgatagaagacgtgccagaggtacctatgactcaagtaactggtgtatcgtcgaatttagttttaatggagtcgtatcagcagaaggattctcttaatgatacggagcaggccagcgtttttgctagtgcttatgctccttcagatgaatctatcaagactgttatcaagaaagaacaagaaaaagagcttcaagaaggtaaagatcgtgttacagctcagctaacagctcaaggtgcttctgatcaggtcatagagaagtctttgggctgattatgagaagtattatgttgatgagtactttgacacacatgtaaaggaagctttgtggaaacatcgagcaagcataggagaaaatatccaggagatgctggaccagtgtttgaatttaggtctggatgttccagattctttgacgaaagagaacataaacgatgctaacgcaaagttagtgcttcaagcttggatggaagctttcaataatgctatggaggttgaacccgctttaggtggatctaaagaagtcattgattctgtgttgaaaatgattccttttgcgaagcaatcttctaatttaagtgatactgatatcaatactatttacacacaagcagccttacctcctccagaggtgatggattactatctgaccaggcaagatgcaggaatctgtaagggagaggtggttaaagcctttcaacaagccacgcagaatctccaatctgtacgttctaatgtagaagagcaaattaaagagttagaagttaaaaagacatccttcttacaagcacaagcatcgttagagagtatgctggaaggggtaaagcgcctcaatgacaaccagaaatttacttctgtacgcttgacatctgttatggagtgttatgctgggcttatagcactctcgcagataactgatgttttagatagtgcggggattagtcttataacgcaatatgtggataaatttttaaaacttaacaatgcccatacagcacaaacattagcccacgttatatcttacatggcagcttattgcgaagtggctgaatgtacgatggctagtacgatcgtgagcgaagatactgtactccagaaagtcaaagataaatggaacgaacttaaaaaagagaagttttttgaatcttttacgctgcctgatgataacgaacttaaaactaactatattacaagtaccaacaatgtttgccgagctaattttagtaattttgtcaacaccgtaattacagaaaaaataaatcttactgttgctgttagagaagcacaaagtctacttacagaatttcaagggaaagcttcagaatacctcaatacgtttcaatcagaaatcaatactcttaatcagacttacgacacattagatccagccaaagcttcttttaattacttctacagggagtacaccttctttacgtgcacaggctgtagatagctggatcgactctacgagtttaggttctgcttttatccatctcattttaaatacacaaattcctaagcaggagaatttcctgaatcctttgattcaagaagtgaacttcaacaatgtcgctgctaacgctgttaacgacctcctgtccattactaataacttctctacctcatccgtttactacaatctttcttcctatcttgtagaaagcaaggcaaggaaaagatttattctgtggggatttctttgagttcatgggggctttagctaaggaacacgaatatatcgttagggatattaagagctgttatcgcgccgaggtttttggagaagctttactagctagagtggaagctttagcgcaagggcataaagtaacggatgcaaaagcgaacagcatgcgcacgcaagccaatctgtatttatcttttattcgtattatcgtggagcagttagcagttttagactctctgttaagaagtcttaattatgaggttgagaagaaagataacaattacgacaaggataaatataagataactggacctacagattggatttcgacattggcaagtttagaagggtatgcagtaaacggatttgataatgccagtctttcaggaggattggggccgatgcatacgctagtacaaacggatcagcacgattatctaacacagagccaaacgcaacaattaaacttgcaaaaccaaatgacgaacattcaacaggaatggacgttagtttctacctctatgcaagttctcaatgggattttgtctcatttagcagcggaaatttattctaattaaaaaanngctcgcagatatgtacctgcgagcttcaaggatgtggtgtttgcaaaccttaaaaagcgatagaaagaataacatttcccaaagcagataggaagcagaagatacccacaataaaagcggtgtgcactcccataaatgctgtagaaactgcatcgctgatgaaacagaaagcctgagccagcaagtccaagatgctgcaaagcaagttgaacatacttgcacgagctcttttaagacgtgccatgaagccgttttctttagatgttccttctgtaggtttattctgtttgaggttcccgagaacttctcttgagttttctgcgacatcgaaggcggactgacagttccaaacgcagaagcagataagccaataccagttgcgtgtgcacccaactggtaaacagggaaagtttgggagcccatgaatttcacggttcctagaactttgctggctaaacgagttactttgctgacaagtgatagtggagacaggagggttctttgttgcgaaacaagatctaggtggaaagatccatcaggattcgttttgaagaataacccaccggttagtaattgtacaattccacaccntgcttgaacagcattacttgcacttttagctgagcccaatgtggtctctatagtggacagctgctgttgttgcgtcncagagacagtggtccttggtgtcactcttgctaaggtgcaggaagaggatatgaggtcaaacaaatcattaacagagctgagctttgagcgaagggatgttgcgttgcctcgcaaagtagttgcggttgcggaagatagtagtctgcccactgggcttgctatgggtaccgttgctgccattgtggaaacctccaaaaaaaattaagggtcttttgcgtaaaaaatcttgtgaaaccaaaggtttatgactcaaaaggaggcatatcgggaagacattgtaaaaagaaatcgcttttaaatcgatgcaaataaaatctttattgacaagaaacgatccaaaaagcctcagaaagtgagcgtgttcatcagctttttggacctaagatgattaattaggaaagaatagaaaaaattaagctgcggggcaagcgcgttcagaagcgcgggatttaactcgatcagctttacctttcttaaagatgcctcgttttacagctttatctgcgatgctgtaaacggaacgcaaccctgccgaaatggattccacatcacccgattgcactgccaattcaaattttttcaatatagttcttacttttgatttgaagctttgattacgtaattgctttttcttagaagtgataactctcttctctgcagaagggcgtttttgaggtccgactttcttgctcggttttcttggtgccataatctctcccaattaggctatttttaactgttatctttaacgcaaagaacaaacgcgacacctcacagcgatctgctgtgactttcggcatgacatgagagtaggatagatgttgtatccgaaactttacgtcatctctggaagtgtcactccagagaccgacacaaaaacagaagtgtcggcagtaacgatgtcatccgctcagaccttacaggtaacccgggacggaacacgtggagattttaggtgaaaagacaataaaatagaaagaaaaataggatagataaaataaaggaagggggaaagagacctattttaaaggaagtttcagtagttgccaacatcatagtagattctaaaacagttgatattccaaaattcaaaaaaacaatgatcaatcccaaaattcgcgatttgtagggatatagtttggggatgcactgcaggcatgcagtatgtgatgggaaggaccaatagtatgacaaggggttttttgaataagcgaagagttctagagaaatgtaggactgccaaacaaaaaatacattattgtatttcgcgatactttcattacctcccacccgttttggcgattctcctgcctatagggagttggccttttttgtccgagcagcaatggtggtgtggttcctttctcttccctgttgtttcttctttagggtggttgttcgcgattgggaggcgagagcggcagttgcgtgccgccgctgggcagctccttgaagcaaagattcgtaaacttacagagcaagacgaaggattaaaaaatatacgagagactattgaaaagcgtcaaaaagaaacggatcgtttaaaattgcacaatgataagttggtggagcaattgggacaagctcgagaagtctttattcaagccaaagggcgttacgaccatatggaggagttgtcccgaagattgaaagaggaaaaccagcaattacaaatgcagttggaagctgccgttcgtgaacgtaatgagaaaattttagaaaatcaagaattgcttcaggagctcaaagaaacgcttgcttatcagcaagagctgcatgatgaatatcaagcaacctttgtggagcagcatagcatgctggataagagacaggcttatattggtaatttggaagcaaaagtacaagacctcatgtgcgaactacgtaatctattgcaattggaaatgggggctaagacgaatttaccaggaaagccagtagcttctcgagatgtagtggctcagctggtattagagtttcgtaaaattgtttttcgtgtagagacaacggaagcggcggattctttgacagctttgcggtatacaagaacagatccgtctgcccataactactccttagcttgtcggcaattattcgatgggttgagagaagaaaatctagggatgctatttatttatgctccctttgcgcaaagatcctttttgccaatgctttgtttaacggattggacgggatacggattagaagattttttaaacagagagagcgatgttgttcttgagggattcgcgcaatgggagcgggatcttttaacagaatctagagtagaacgttctggtaaaattgttattaaaacaaaagcttttggggcgactcccttctattattgtgtagtcacgttagataagggtccttttgctcaacatatactaggggttttgtaccctgcaaaagccagtttttttacaaatctttcctatatttagggataagtagaaaagacgggaggggtttttctaggcctaaatctgatcaacaggctttttttttatctaaaatccctagatttcttgtttttcttaagataaactgtcactttctaggccgatttttccttagttttaatttgtcagcatgcgcatggatacgctagatagtcaagctgccgaggcagctcaagaagaagaaatccaaagaaagttagaagagttagtcactcttgctaaggatcaagggttcatcacgtatgaagaaatcaatgaaattcttcctccttctttcgatacgccagaacagatcgatcaagttttaatttttctggcgggaatggatgttcaagtcctgaaccaagcagatgtagagcgacagaaagaaagaaaaaaggaagcaaaagagctagaagggttagctaagcgttctgaaggaacgccagatgatcctgttcgtatgtatttgaaagaaatgggaaccgttcctctacttactagagaggaagaggtggaaatttctaagagaatagaaaaagctcaagttcaaatagaaagaattattttgcgcttccgctattctacaaaggaagctgtgtcgatcgcgcagtatctcatcaatggtaaagaacgatttgataagatcgtttctgaaaaggaagtagaagataagacacacttccttaatcttctgcccaaactcatctctttattgaaagaagaagatgcatatttggaagagcggcttcttgctttaaaagatccggcgttgtccaagccagatcaggcaaggttgaatgacgagctggagaaatgccgtatccgtacacaagcgtatttgcggtgtttccattgtcgtcataatgtgacggaagatttcggagaggtggtttttaaggcttatgattcattcttgcagttagaacagcaaatcaatgatttgaaagcgcgagcggagagaaataagtttgccgcagcgaaacttgctgcggcgcggcgaaagcttcacaagcgtgaggtagcggctggacgcactcttgaagagtttaaaaaagatgtgcggatgttacagcgttggatggacaagagccaggaagccaaaaaagagatggtcgaatccaacttacggttggtaatttccatcgcgaaaaaatataccaacagagggctgtctttcttggatctgattcaagaaggtaatatgggcttgatgaaggctgttgagaagtttgagtatcgtagaggatacaagttttcaacttatgccacgtggtggattcgtcaggctgttacacgggctattgcggatcaagcacgaacgatccgcattcctgttcacatgatagaaaccatcaataaagtgcttcgtggagctaaaaaattaatgatggaaacagggaaagagcctactccggaagagctcggagaggaattgggctttactccagatcgtgttcgagaaatctataaaatagctcaacacccgatttctttgcaggcagaggtcggagatggtggggagagctcttttggagatttcttggaagatactgctgttgaatctccagcggaggcaacagggtattccatgttaaaagataaaatgaaagaagttttgaaaacgcttacggaccgtgagcgttttgttttgattcatcggtttggtcttcttgatggtcgtcccaagactttggaagaggtgggttctgcattcaatgtaacacgagagcggattcgccaaattgaagctaaagctttacgaaagatgcgtcatcctatccgttccaaacagttgcgagcgttcctagatctattggaagaagaaaaaattggttcgggtaagattaaaagttataaaaattagtcttgctgcctacaaggagtgttgttgtatcgtttagatatagcggattttcgcgtttgggtatctataggagtctcagaacaagaacggcattatccgcagcccgttcttgtttctttatctcttttttttaaagaagagccaaaggcttggtccacggacaaagtctctgatagcgtgtgttatgcagagcttgtttctcttattgaagaagttgcaacgaataatccttgtgctttaattgaacgtttagctaaggttttgctggaaaaaatagaaaaggctttggctggacaagtttctaggattgacttgcgagtaagtaaagagcgtcctccgatcccagatctactcagtcctgtaagtttcagcataagtagagaggtgccatgactagttggaattttgtttgtttaagtttgggttccaatttaggtaaccggcatgagcatataagacgcgcttatgcaagtttaaagaaggctgggatccgaaatttaaaaagttctgtgattttagagacgaaggctttgttgttagaaggggctccgaaagaatgggatcttccttattttaactctgtagttattggggaaacgcagctatctccagacgagttgattgaagaaatcaagatgatagaaagtcgttttggacaagatgcttctttaaaatgggggcctcgaccgattgatattgatgtgcttttctatggagacgaagctttttcttatcatagtgacaaatgtacaatcccacatcctaaggtattagaaagaccttttattctttctatgatggcttctttatgtccgtatcgtcgtttccgtttggaaggatcttcttgtaatgggaaaacgtttgcagagcttgctgctatttatccattgacagaggaggatgcgttaggcagtttcggttctgctacccaaattatgggtattgttaatattacggataactcgatctccgatacaggattgtttctggaggcgagcagagccgcagcccatgctgagagactctttgcagaaggagcttctattattgatttaggggcgcaacaaccaatcctcgtgtaaaagatttaggaagcgtagaacaagagtgggagcgtctagaacctgttttgcgtttattagcggagggttggggggctgctcaacaatgccctgatgtatctatcgatacatttcgtccagagattattcgacgagctgttgaagtatttccgattcgttggatcaatgatgtttctggaggctctttggaaatggctcatttggcgaaggagtttgggctacggctattaataaatcattcgtgttcgctgcctccaagaccagattgtgtactttcttatgaagaatctcctattgagcaaatgttgcgttggggagagtctcagttagaacaatttgctcaagtaggtttagatacaagttggcaagttgttttcgatccaggaataggatttgggaagactcccgttcagtcgatgttattgatggatggagtaaagcagtttaaacgtgttttagagtgtcctgtattaataggccattctagaaaatcgtgtttgagtatgttgggccgatttaatagtgacgatcgtgattgggaaacgatcggctgttctgtatctcttcatgatcgaggagttgattatctacgtgtgcatcaggttgaaggtaacagacgtgccttagccgctgctgcttgggctggtatgtttgtatgatccaagcaacaggtatcgttgctattgatcccagaggagtgatgggagctttaggcaagctcccttggagttatcccgaagatctacgtttttttgcagaaaccattcgaaatcatcccatcattatgggacgaaagacttgggagtctcttccagacaagtataagcatgggcgggatatcgttgtcttttctcgcaggatgcatccaccacaatgcataggagtttcttcctttgcagagtatgggacactatctttgaatcatccgtttttaattgggggagcggagctctttgaaagttttttccaacaaaaccttctgaaagcttgttttgtcacacatatcaaaaagaaatattggggcgatactttcttccctatcacgcgattatcaggatggaagaaggaatgtatttgtaatacagaggatttcagtatttattattatgaaaataactccgatcaaaacacgtaaagtatttgcacatgattcgcttcaagagatcttgcaagaggctttgccgcctctgcaagaacggagtgtggtagttgtctcttcaaagattgtgagtttatgtgaagcgctgtcgctgatgcaagaatgtgcaaagcagagttgataaaaaaagaagcggatgcttatttgttttgtgagaaaagcgggatatatctaacgaaaaaagaaggtattttgattccttctgcagggattgatgaatcgaatacggaccagccttttgttttatatcctaaagatattttgggatcgtgtaatcgcatcggagaatggttaagaaattattttcgagtgaaagagctaggcgtaatcattacagatagccatactactccaatgcggcgtggagtactgggtatcgggctgtgttggtatggattttctccattacacaactatataggatcgctagattgtttcggtcgtcccttacagatgacgcaaagtaatcttgtagatgccttagcagttgcggctgttgtttgtatgggagaggggaatgagcaaacaccgttagcggtgatagagcaggcacctaatatggtctaccattcatatcctacttctcgagaagagtattgttctttgcgcatagatgaaacagaggacttatacggaccttttttgcaagcggttacgtggagtcaagaaaagaaatgatggaggtgtttatgaattttttagatcagttagatttaattattcaaaataagcatatgctagaacacacgttttatgtgaaatggtcgaagggggagcttactaaagagcaattacaggcgtatgccaaagactattatttacatatcanagcctttcctaaatatttagatgcgattcatagtcgttgcgatgatttagaggcgcgtaagttattgttagataacttgatggatgaagagaacggttaccctaatcatattgatttgtggaagcagtttgtgtttgctctaggagttactccagaagagttagaggctcatgagcctagtgaagcagcaaaagcgaaagtagctactttcatgcggtggtgtacaggagattctttagctgcaggagtggctgctttgtattcttatgagagtcaaattccacgtatcgctagagagaaaattcgtggattgactgagtactttggattttccaatcctgaagactatgcatatttcacagaacatgaagaagcggatggncggcatgctagagaagaaaaagcgctcattgagatgcttctcaaagatgacgctgataaagtgttagaggcatcgcaagaagtaacgcaatctttgtatggctttttagattcttttttggatccacgaacttgttgtagttgtcatcaatcttattaaaatgatctgacagcttctgtcagcccagaacaacttctcttgttctgggctttttatttccattttatttctagttcaagggatgtaaagcagctttacatatccgattagatagtatgtcgagaattctctgtgcgtgttgttgttaaaacagagcataggtgtttgcgttggtgcgcaggggggatattcagttgcgaacgatatttggctactgtgcgtcgtgcgcaggggatgcccttctcaataattttttggctaatagctgcatcagatagaggatgtttttctgtagaaatccactggtggatccaatgcaaaatagttgctttagattgatcggggcaggatccaaccgcttgtggaaatagcgatcgcatagggagtaatccaacaggggttgctaacgttttattatcaatggcacgacaaacggtagcttcatgaagagagagttcgcgagctatttgttttacagaaaaagctttaggagaggtgcgttttttaagaaggaactcttcttggtaggggatgagaactcgaaggatagccaataacgtttcttctcgtttttttacattgcgaagcaattgttttgctgctcggatttgttgcgataggtggtctttctcttcacgaggaagagaaggatagatatctagtacggtgtcgttgagtctaatagaggggagacaatctttattaatagagacatcccaagaagagtttcgcgagaaggaaaggtaggcatcaggaagcgctggagcaggggggtgcagtgtctcggaaaagcctgctgctggacaccaagggatggaagcaaaagcgtgtctaagaaatgtaagaatctctgttgtggttgcatgcattttcctagcgatagtagtgaaatcacaacgagctaatctagggaaatggttgcgaataatagctaaagcctccttatggggagatgtctgtagtagcgatacccagtaggactgtagggaaggcgctccgactcctaaaggatgtaattgttggatacgttgccataccttgtggaaaaggtgttcggagacgtttaaatctgcagccacaagactaggattttctaaaaagagtccttctggggagaggttgcctacaatatactgagctatagtacgttcctgagaagaggcaaaattggtatcaatttgccgaagaaggtatgcggatagagtttctgtaaaaggatgctgttcgctaatagggaaaaacgaaaaagattctggaggagaatctaagctatcgagatcaaaacagggattgatagtgatttgctgggacacaaatgttgcgagttcagcaactggcatctgtagcatatccagtccctgttgaagatgtaaagcaggacaaagagctacagatgctgtttgatgctgatgcaacataggttaaacaaattttaaaagagccctcggaagctcgctaataaatctgctggggaccatggtgcgttccgttccccaaaggaatcgggtttttgctcgagataaatagagatactcttgtgctcgggtaattcccacgtaacacaatctccgttcctcttcaatattttcatgcatacctttcgagttggcatgaggaagaaggttttcttcaagacctaccagaaagactacaggaaactctaaccctttactgttatggatcgtcatgagcttgaggcgatcatgggaacttgctgtttcatctgcggaactttttagagctagatcttctaggaaaccaggcaagttttcactgcttttaccccatatttgcgtttctgctaataattgctctaagttgttttttctatcttcataggtttcaggatcttctttgaggatggagaggtaatccgtgatgcggatcgtttcattgatgaattcatgaagatcgcagtttccgtatagctgctccatttgatggaaatgagtcaaataagagaaaagcccttgctgttgttttttagttaaacggatagattttttctctaatacgtcccaacaagcctgcaatataggtaggtctgttattttggcatagttcataagagcggctaatgtggtagctccaataccgcattttttcaggctaatggttcgctcaaaggctgccatgtcgtagttattagaaaataagcgaaggaaagcaagaatatcttggatttctctacgcttgtagaaggaaatgccacctataatttcatagggataacctcgcttaagaagcgccgcttcgaacgattgagactgaaagttcgttcgatataaaatacaaatgtcagagagagggatatctttataggaatgaagattagagatttcttctaagacttgctctgcctcatcgcggtcatttttccctgtaaaacagaaaattttatctccaggcccttttacactacgcaatgttttttctaagcgtgcagaattattttgaatcagagcattagcggcttctaggatggtcccacaagaacgatagttttcttctaagcgaacaactaaagcctgcgaataatcttgctcaaagtttaagatattagagatgttggcgcctctccaagaatatatagattggtcgggatctccaacgacaaagatattgttatgagctgcagcaagacgtttggcaatgagatattgcgcgtggttggtgtcttgatactcatctatcaacaaggctttccaatgattagcgtattcttgctggacttcaggtatgcgcagcagtttttctgttaggaataacagatcatcgaaatctagagcgttcgcagcacgtaactgttcttggtattcagcataaacggtgcgagtagggtctggatattctttggaatcgagatcttcaggactctgcaagcgattttttgcttgagagatagtaaattgcattgcattgcaaagctttttatcgaggttcagcttgcgtaanattgcttaattaattttncagaatcactctgatcataaataacaaaattcgactgtctatctaacaaatgaatagagcgtcgcaggatataaacgctaagactatggaatgtgcttaccataggtacgtctgaatatcctagctcacgacattgcgattggatacgttcttttagttcgttagctgctttgttcgtgaacgtaatagctaaaatttgtttaggatcgagccgggattcttctattaaatgaaggattcgatgagtgactactcgagttttcccagctccagctccagctaagaccaggactggttgtagtggcgccgtgacggcggtaacttgtgctgcatttaattcggatgtaagcatatgtatgtaatatatattttcgggttcgaagaaaattttcgagaatgcatatactctatgcattagattaaggagagtgtatgcacgaggcttttactatagagcaactccccccgtcttggcaagaacagcttaaagatgaatggtctcagccttattggtcccagttgcttgcttttttaaaaagtgaatacgcacaagcaaagatctaccctaaaaaagaaaatatttttgctgctttgcggagtactcctttcgatcaagtgcgggtagtgattcttggacaagatccgtatcatggagaagggcaggcgcatggtttgagttttagtgttcctagagggcaggcattacctccatctttgcgtaatatttttcaggaactccataccgatttagggattcgtaatgaatctgggtgtttgcaagcctgggcagatcaaggtgttcttcttttgaacaccgtgcttacggttcgcgcaggggaagccttctctcatgcaggacgaggatgggaacgttttaccgatgctattgtaactaaattgattcaaaatagaacgcacgtaatctttgttttatgggggaatgctgcgcggcaaaaatgtaatctgcttttccagactaagcatcaacatgcggttcttgcttgcccgcatccgtctccattggctgcacatagagggttctttgggtgttgccacttttcaaaaattaattatctgcttaaaaaacagggaaagacgatgattaattggaagatagaatgatcgacgggattcagacgtgttctttcagccctacgcatcgcttaactgcgaaatccgcagtgagtatagagatgcctttagcaacacaaaatcttcaagagggagctttggtcaatgcaaagctcgaagcggatttcgcgagagcggagcagattcttacagagatgcaagaaatccgttctagtttagagaggtctttagagactctctttccccgcgagtaagtgatttgcgagaaccgtttccacatagggctgtaatttgactaatgcttttgctctgtgagaaacttggtttttaattgcctctggtaattcggcataagtttgcttgtagtcatgttttacaaacaaaggatcatatccaaaccctgaggaaccgcgttcctcaaacgcaatagttccttcgcaagaggcgtgagctttgaagatctttccaaaaggagaaattaaagcgacgcagcattcaaaataagccgatcgatcgattgtattttctaaaagacgcatgttctcaagaagttttttgcgatgatctttatcgtttgcctgttctccagcaaaagaagcggataattttcctgggagtccacctaaagctggaatgataagcatagaatcatcagcaatagtccaacaacgaaaggtttgagctgcaaataagcctttctgaatagcattttcttctggggtttcgccagtttccttagggggttggtaggatgggtagtctacaagcgagaagatatcaaactctcctagtttttttagaaaagctttggtttcgcgcaccttatatccatgagaactggctataagaattttcataaaatccctttggatgacaaaaaaagaaacagcacctctgtatagagagtatgggcaggatgatagcggcgataagaattttctttcactaagcttttttattttaagaagtttccaacagggttgctgtagatcaaaaaaacaaaaatcaggaagataaggtttcccttgtcaaagagagatccaaaggagattatgaaaacaatctgtaagctagtgatccttgcgctactatttcctaatgtgagctatgctcttgtacaggtaggcttggaacgcctgtttcaagaagaaaaatatcttgagaaaatacgtggcaagcgggttgcattgatttctcatagtgcagccattaatcgacaaggggaacattcgctttgtgtttttaacaagcataaaggggtttgtaagctcagtgctttatgcacactagaacatgggtattttggggcatccattgctgagacaccaggatatgatcctatcttagaagatatcccagtcatttctctatttgcttctaaagagattcctgctgaagtcattgaggcctgcgatgtttttgtgtacgatgtacaagatattggtgtgcggtcctattcattcatttctgcattgttgcaagtcgtaaaagcatctgcgagcagcaagaaggaattaattgttctggatcgtcccaatcctatgggagggaatcttgtcgatggccctctccctgataaagaggctttccctgcgatcccctattgctatgggatgacaccaggtgaactagctttattgtatcgagctcgatatgcacccaaagcctcggtgacagttgtccctatgcgagggtggaagcgctccatgatttttgctgatacaggattgatttgggttcctacaagtcctcagattccagatgcgcagtctgcatatttttacgctacaacaggtattataggagctttatctgtcacaaacatagggataggctatacgcttccctttaaagttttaggggctccctggatggatgggtgtaaggtcgctcaggagttaaataaagcgcggctaccaggcgtccattttcttccttttatgtatgagccgttttttgggaaatttaaaatggaaatgtgttctggagttttggtcgtacttcaagatcctaaacaatttcttcctatggaaacacaaagtgtgattttgggagttttgaaaactttataccctaaagaggtagagcaagccttcttattattagatcggttagtgcctcgacgtaaggcaattcaaaatttattagggcattcggaatttttgaatgtctgtttacacaaaaagtatatcacatggccgttacgaactatgtgtgcggaaggtagaaaacaatttatagaacagcgacaacccttccttctcccagaatatgcttgatagatatccaaagatggttgtttgacaagaataaatcgcctttctatatccaagactgcagctgatagaggaatagggtttgtctaatagttttcgagaccaagaacaaggtttacaggcagtcttacgcgccgcgcgtgtaatatctcatatgttttctcagacaatcggtccttatgggtttagcacgattgttcacaatgtccaggatacgcggacaacgcaagatagtcagagtatgctgaaggatattctgtttccggatgtctttgaaaatataggtatgaaactcatccgagatactgccttgggaactcgtatgcgattcggagatggggcaaaaaccacagctttactaatagaagcgttattagcggagggcatgacaggtatccagaaaggtttggatcctcatgaaatccatcggggaatgcttcttgcagaaaagaaaatccaagaggttttttatagagaaacatttcctctaagcgatctggaacatacagtgtatgtatccagtatcgcgcgacgttttaatagcgaaatcgcttctgttttatctagcgcagtgggttatggagggaagaacggttactatatcgtagaagaacatgaagaatctgaaacatactggcatgccgaagagcatgctgtgtgggattttggatatgcttctccttactttattacgcatgcggaaacaggaacggtagaatatagccaggtttatattttagtgagtgaacatccgctgcattattcgaacccatcttttttaacatttcttcaatcagttgttcaggcagggaaaacaccgcttgtgattgtagcagaagcttttgataaagaattattagctatgctggaaatgaatcaaatagagagggttttccctgtctgtgctgtgaaagtatctgggaagcacgcccgggaatctttagaggacattgcggtattaaccggagctacattgctcccagaaatggatttcgaagacagcgaggaagagagaatcgcaaatcgattaggctttgtagcaggaatttgtgtttcttctaccagtctttgtgtccctagagaaacagacaataagcagagagtggcagaacactgtgcttttttacaggataaattgagttttcacaggaagaagagtagcgctaggttgagaaggagattggcaaggctttcgacaggcgaagtatgtattcatattgctgcagactgtattcctcaggaggagataggttatatcacctcttctatacgagccatgacagaatctttacgatcaggatgcttgcctggaggtgggtgcgcattcattcgagcggcaagagaaatttctgttccgcttgctctttctcctagtgagcgttttggttttcttgctgtgcttagtgccgcagagaagccttttcgtgccatcgttacccgtagcggaagagtggaggaagaagtattctctgaagtcttctctcaagcggactggcgagtaggatttaacggagtttctggatttgtggaagatattgtttcgcaagggatttgtgatggagcctcttgtattcagcatgctttaagtcatgcagtggggacgactggtctgttgttaacatctgcgctctttatagcttcacaggagccgatgttgagagaggaaaattctgaagaataacaatagttttctgttaaaacattctttaatggaaggttttttcttttctgaggagaatttcttgatcatttagcgaaagcacggtatccttctgccctatagttttctatgcaccagtagctcagtggatagagtacctggctacgaaccaggtggtcagaggttcaaatcctctctggtgcgttgtttctttctaggaggagtactatgggatcattagttggaagacaggctccggatttttctggtaaagccgttgtttgtggagaagagaaagaaatctctctagcagactttcgtggtaagtatgtagtgctcttcttttatcctaaagattttacctatgtttgtcctacagaattacatgcttttcaagatagattggtagattttgaagagcatggtgcagtcgtccttggttgctccgttgacgacattgagacacattctcgttggctcactgtagcgagagatgcaggagggatagagggaacagaatatcctctgttagcagacccctcttttaaaatatcagaagcttttggtgttttgaatcctgaaggatcgctcgctttaagagctactttccttatcgataaacatggggttattcgtcatgcggttatcaatgatcttcctttagggcgttccattgacgaggaattgcgtattttagattcattgatcttctttgagaaccacggaatggtttgtccagctaactggcgttctggagagcgtggaatggtgccttctgaagagggattaaaagaatacttccagacgatggattaagcatctttgaaagtaagaaagtcgtacagatcttgatctgaaaagagaagaaggctttttaattttctgcagagagccagcgaggcttcaataatgttgaagtctccgacaccaggcaatgctaaggcgacgatattagttagtgaagtctgagtattaaggaaatgaaggccaaagaaatagctatcaataaagaagccttcttccttgactctaaagaatagtatgtcgtatccctgcataatagcttgcacagcaagcgaaatacctgagggcgagtctcgtccatgaccaaggttgttatgtagatctgttagtgaagagcagaggtatgcggactcaaagcttccctcctctgcttcgccaaacactgcaacagtaaatttcatcccacatgctagttagttccttaattggggatcctacagcagactttgtttattatctagaaaagagcagctatttctttttcggaaggcgaattctttgatctgtaaaaatagtatccgaatttagtttattaagtttttttaattctacgacggggatgttatatttactcgcgatcttgctcagggtctctccttgtttaacaatatgaatatgttccggggtttcaccagctagaaaatcaatataattttctggagaagagccatcaacgagagcttgtaaagagttacgaagcgctcgcaaattttgtgctaattttttttgttcttgttggatttcttgtaatttattttgtacagaagaccgaatatcttggacggattgcgaaagaatcgccagtgtttttgccaaagctttttggtccgtttctagtcgctgaacttgtcgaggtaggttgtgatcctgtgttgacgaaagctgttgtagtttcgtgtcttgctcatcgaggcgttcagagatcatagcaagctcattgtgatgagcgtgtagacgagaggaggttcttcgacttcggctagaatagcctgcaaagacggcgctttacctgcgccgtaaacagacgaacttaaccctaaaagggttataaagaataagcgattagcgagcatggatcttaaattcagtacgacgattttgttgccaagctaattcattatggcctggatgaacaggatgttcttttccgtaagaaatagtgaataagcggtctgcagcgattccttgtttgatgaggtattgttttacagcattcgcacgacgagctcctaaagctaggttataagctgcagctccacgttcatctgtatggccctctatatatagcgtagctttaggagatttatgcaaatgacgaactaagcttgcaagaatcgtgaggttatcctctcctttaatagaataactatctgtagcgaaagtgatatttcggaaagaggtactctgtgcgctcgttttgtacagctgctcttctttggaatcaaaatcttcaacaaaagcttgttgaatttcttcatcggagtagaaaggtacgaatccaaaagaggatttacgaggtcttgcggagtcgcaaccatggcattcccaatctctgcaaggataagagcatgaagaaaggaaaagaagggagaataataaattaaacgctttaaaaatagtctttctcatgaggttttctttatatgttgtgaaggaaatgctccccagcatgggaaacgtttctctccagatcctataacaattttcctactttttttggtaattaggctcagcaggaatagttcggatgtattggaagatccggcactataaacaaggtggttactatccgcagcccaagaagggctttctttatgttcagtagatgtagttaattgctcatctcttcctgaagccagatcatacacacaaatctgacggacacctttaatgactgagcagaaggctatttttttaccatccggagaccatgttgggcaactgctatttcgatatttttttgttagtaagcgaggagaatgttgttcgggagagatttgcatctgataaatacgaggcgttccgtctttgttagaaacaaaaactaaacgggtgccgtcaggctaaaggaagggtttccttgtgttccaaaagcttcatttaggagtttttttggtgtgccaattgctccggtagctagtgagaatgattgtacaaaaagatcaggattgccgtctctatcagaaataaaggcgaggagtttagttttaggagagaaagtcggcataaactgattcccttgcatagcaaggattttttccctgcaggctggttcagagtattcagaaagatttttgggacccctaatttgtaggaaacatacatataagcgggaatgtgactgatatgcatccaggttggagttacagataaggaatgttcattggtaagtgggtaaagatgttgtccatcgtaatcaacggaccagagttccccttgttttaattctgtggaagagtttgtagcacatagggaaaaaataatttttcctgagctaattccaggaacgcgtgtaagaagaaaatggatgcgatctgcagcctcatgaatcgcttgatgatctttagaaggatctccagagagctctagagagaaaattttttgagatcctttaccctctttttttaaagaaaaaatcagttctggataggacgcttctataaagatcgtttgcggagccagctcttttgtaggcgccaacaggtctcctaaagccaaatcgcgagcaaataagtctcggagggatgcaagataggaagcttgacgagagtcttttggtgatgagagcaaagagactgcgattggaaggagagagctttctgatcgtacatgaatttccaaatcttcacagtggagagtggaagggagaagacaaagtagacagagaagagaacggagaaacacaacggagcctttcatcaagcagaatttccctgcagtctaatatgaaaaacgatatttttcgaggttttgtatgcgctaaagaaagattgaaaaggaattttctgaatttggttcaggatatgttgtttatcagcatggctaatagtagataagattgagcaatggagaagagcgccttctctagaaaattctagttttaggcgaacctctccagggaaaggaagactcacgtactgctgaaataaagcacagaaggcatcttgctgataggatgtgttttcagtaagaacttgcgcttgagcaggccaagaaaattgtgcgatgtgggattcttgtgtctcagcctcttcggccagctgattagctagttgagctaattttttgagagtagcttgttttttctctagtgtctcattacgcggcgtaggactcgctttgtttggtttttgaggagatttttgagggttagagatcgcgggaggttttgcagcttttttctcgggagctggagcgttttttaccggtttacgaataggttgtggagagggagtctgtaaagtggtagtgattttaggttcagggggtagggcgacgatacgttctttaaaaggggagagacgaggcttctttttttgaggcgcggagaaaaagagcattcctccaagagcaatatggatgattatagaagcgcaaagaaaaggggcatattgaaattttggcatagttagttcttcaaagcaatatgaagttcctgaaatccggcttcttcgatagtcgatttgatctcttgatacagtttgaaagctgtatcaccgtcttgtaagagcagcggaactatattagggtgttgcgcatggatgactgttagttgcgagcgtaactcttggagagacacaggaaggtcattgagagtaatggtatggtttcgaaacactttaatttcagcttgctgagactcttgttttttgaaggcttggtgtgaggaagatcctgtggctaaagagatacgatcaattttaataagaggcatggcgatcatgaacgccatcaaaattacaaagacgatatcgatcagaggagtaagattgacactagggtcttcttctagatcttcgtaaacgaagcgtttcataagctagtttgtcgatatttgacttcaatagagttaagtaaaagaaaagcagtttgctcgatttccagagagacttggaaggcgtgggcgcgtagataattgaaacctactagtgaggggatggcaacaaatagccctacaatagttgttcctaatgctgttgctaagccttccatcatgatcgtcccattggcttgtccggtactaatgtgcgcaaaagctaatagaatcccccaaacggtccctaatagtcctagaaaaggagcgagactaatggtcgttgctggaatgaagttatttttatttaagagagctctatatttcggcatcactgcattaaaaagcgtttccaacgattgaatatcttccacggaaagcaaaggagttcgttctggagccaactgtctattcttatctagtaattccagggttccacgtttgatagtaaaatagaggtctgtaaaaggcgtggattcaggatgaatatctaaagagagaggagaatgacgattttttattaaaaactcttttaaagatttccctgattttagaaatttcttttgaatggagagtttctgatgaaggactgtccatgtacatatcgaaagagcgaacagcgaaaagaaaatgacctttccaaaaagatcggcttcttgaaaggactgaatgatgggattatttacgagttggaacataaggacgtagacctaaccaacgagttcctagacgatcctaacaaatttcttgtatagaaccaagatcctttttggtgtgtaatgaattgcaaaaacaaaaacaactcttctgttgtttgatgatttgctaaaccggagagagtgttgtgtttatgattcggcaatggtatggattttttctttgcttgctgttcagctatacgtcttgttttggtgtagaagaaaatagtggaagagctacgcctacagtagaacttgttagtgaaagcgaacaagctgttgaaggagaagtgcttcgtatcggagtattgattgctattccagaaggagagcatatctactggaaaaatccagggaagcttggaatgcctttgcgcatttcttgggatttgccatcaggatgtaggttgctggaggaacattggccgactccagagattttcgaagaggatggggttgtttattttggttataaacattctacaatggtggttgcggatattcgcgtttctaaagagatagaaacgcgtccattggagataaaagcgcaagttgaatggttgtcttgcggtgcatcttgtctcccaggttcttcgtcaagggttcttgtgattcctatagatcaggggccgttaattcctaatagtaaagagacattcactttttcccgtgcgttagcggctcaacctcgacctttggatgctgccataaagatttcttatcagcctgatggcttagatgttcttgtgccagcaggggaaagcggatcgggcaacccaggcatggttcattgctgaaaacacgcgagattttgcttatgctcaagaggttcctcttgagcaagcgactacgtacatatggaagttgaaacatcctgaaggaaatatgcctaagggtgttgggttgtcacggattcttatattcaaggatgatgcagggaaagtagtcgcttcgtatcaagtagaanagaatcaagtcgaacaactttcggcattgagctgggggtttctctctattcttcttatggctttcattggtggaatcttattaaacatcatgccctgtgtattgcctctgattactttgaaagtatttagtttaattaaatcggcggcagatcaccattcttcctctgtgattggagggatttggtttactttaggagctattgtaagcttttggggactcgctttttgtgcgtttttgttaaaggttttagggcaaaatattggatggggattccagcttcaagaacccatgtttgttgccgttttaattattgtcttcttcttatttgctctgagttcgttaggcgtttttgagatgggaatgatttgtctgagcctaggggaaaaattgcaagaagagggaggggcatcggtaaggaagaatcagatctggggagcttttttcaatgggatgttgactaccctggttacaactccttgcactgggccttttcttggctctgtatttggattagttatggcagtgtcttttgttaagcagctggcaatttttactgctataggattaggaatggcaagtccctatctattatttgcttcttttccgaagatgctagccattttacctaaacctggtccttggatgagtacgtttaaacagttgactgggtttatgttgcttgctactgcaacttggcttatctggatttttggggtagagacgagtgcaaccgctgtaactattcttcttgtaggattgtggttggctgctgtaggtgcatggattctagggagatggggaacccttgtatctccgcgtaatcagcggcttcttgcttccgttgtattcattttctgtattttaagttccttagtgattacctctataggtgtccgttattttgatgagaacgtccctcctgcacatagctttgattggcaatctttttctcccgaaaagctagctgatttacgcgaaaaagggattccagtttttgtaaatttcactgcaaagtggtgtttaacgtgtcaactcaataagcctcttcttcatgccaatatgcaagcttttgctgctaagggcgtagttactttagaagcagattggacgaaaaaagatccaaaaattacagaagaactcgctcgtttaggccgagccagtgtaccttcttatgtgtattaccctgcggggaacaaagctccgcttattcttccagaaagattatcgcaatctgctttggaagagatggttttttctcagtagaacgattcaagtagaaacattttccgctaaaagggcttcttccttcatgatctttgattgagaaagattgattatgagggaagtatggagatagtcgacgcacatgtacatctttcatccgaagagtttatagaggattttggagatgtcgttttacgaggcaaaaccgcaggagtgactagggtagttaatgtaacgactacaaaagctgagttgttacggtcttttgcttatgcagaagcctatcctgattggatgttttatcatgttgctgggactcctccccaggatgcgcaggatgatatagaggaagattttcaagaattttgtcgtgctgcagaagatgggaaactcgctgctattggagaagttggattagattatttatttgctgtgcaagcctctgaacaagagcgacaaaaagaagttctttgtcgttatttacaactagctttgcagcacgaactccctctcgttgtgcattgccgaggagctttcgaagattttttccatatcctagatcatgtatatcgagtggatcagcgagctaaacctggtatgttgcattgttttacagggacttatgaagaggcgacagagttattagcgcgtgattggtatatttctattagtggcattgtgacttttaaaaatgctaaaagcttgcaggatcttgtagagaagattcctttagagagattattagtggaaacagacgctccttacctagctcctacacctttacgaggtaagagaaacgaaccagcaaatattgtgcataccttagcgcgtattgctgagataaaaggcatttctgtttatgaattgcaagacgctgttagtacaaatgtgcaacgttggttacgaggttcctagaattagggatggaagcctttcagttgagggatatagctgctgtttgttaacgtcgcgattaagtgcgctgttcatcatgatgtttgaggagggctctttatggaagggcaggaaccatgagggacggcgaataaggaggcgttcatatgaggagggagatagtacaaaaatcttcctacattcgtttcattatacgatgtattcattccgtatcgggatgtgtgtttactttatttttgtgtgaacatctccttacaaatatcttagcctcttctttcttagctaaaagccaagggttcattaccttagtgatctgtttcacaaaattcctggtctagaaggtaattgagattacctgtttagctcttccgcttggtattcattccatcatcggatttagctatcttcttcgagggagagagaattttttctcttcagatggaagaacacctacgttacgggaggaatctggcatatactctacagagaatgacggcatggattttattagccgggctggcttttcatgtaatccagtttcgatttgtcttgtatcctattcaggttacaatccaaggaaagactttttatgctgtttcttttgatgcggctcgatatccctctgttgtacagggaacaacaggcttcttcattatgaatgttccatttgctgagggaggacctcaaattacggagcagtttttacaagaaaaagaccgagctttatttgcatcacacaagtcgtacatttttactccagaagcaaggaaagcttttctctatgcagtaagaaatgctctaggatctttatggatggcaattttctatacgctttttgttatagctgctgttttccatgggtttaatggagtatggacgtttgtctcgcgatggggaatcattatctcttcccgctatctccgattatgtcagatcttatgttacgtagggatgtgtgttgtgatggctatgggtatcagcgtaatttggaatatgtatttgttatgatgaatcagcgttgtcgagtcattatcattggagggggacttgctgggctatctgccgctatgcaacttgcagatcgtggtattttagtagagctgttctctttaactaaggtcaagcgatcgcattctgtatgtgcacagggaggaattaatgcagccttgaatctcaaaggagaaaatgattccccatacattcatgcttacgatacgataaaaggaggggattttttagcagatcagcctcctgtattggaaatgtgtttaaccgcttcacgcattattcatatgctggataggttcgggtgtccatttaaccgtgatgcagatggaaacctcgatgtgcggcgtttcggagggactctctatcatcgcacagtcttttgtggagcgtccacagggcagcagttgatgtacaccatggatgagcaggtacgtcgtcgtgaatggcaagggaagatcattaaaagagaaaatcatgaatttgttcgattgattaccaatacggaaggaagagcttgtggcgttgtcgtcatgaatttattcaatcaccgtttagaggttatacaaggtgatgcggtgattattgcaacgggtggtttgggtgtcatttttcaaatgtctaccaactcgactatctgtacaggagctgcaaatggtcgattattcatgcaaggcatgcactatgcgaatcctgaatttattcaaattcatccgacagcaattcctggactagataagttgcgtttgatttctgaatcggttcgtggtgaaggaggaagagtttgggtgcctaggtgttcatccaaaacgattattttccctgatggttcgcgacgcccttgcggagagacaggcaagccttggtattttctagaagagatgtatcctgcttacggcaatttagtgagtcgagatgtcggagcgcgagctattttacaggtatgtgaggcaggtctgggtattgatggtcgtcacgaagtgtttttagatgtaacccatctacctgtagagactctgaataagctagaggctgttttagatatctatcataaatttacaggtgaagatcctaaaaaagtccctatgcgcatttttctgcggtgcactattctatgggaggcgcctgggtagattggcctgccagtgacgatagggatcgcgatagtcgctatcgacatatgacgaatatcccaggttgttttaattgtggcgagtcagattttcaatatcatggagccaatcgtttaggagctaattctttgttagcgtgtttatacgctgggttagtcgcaggagatgaagcggcacgatttgtggaatcgttcggaagttgtatctattcccaacaagatcttaatcaagctttgcaacaagagcaagagatctctcgagagattctctctcgtcaaggaggagaaaatgcatttgctttgcatgaagagatcgcgcgagtcatggtcagtaatgtgaccgtgaaaagggagaacaaggctcttgaagaaactctacacaagttaaaggagtttagagaaagaataaaaaaagtttcggtacacgattcttctcgatttgcgaataaaacgtttcattttgttcgacaaatggaacctatgttagagcttgcactagctatcacgacaggagctttattaagaaacgaatttcgagggtctcattacaaaccagaattttcgaaacgagatgatgtgaattggttaaaaactacgatcgctacatattctgtagatgagccagaaatttcatataagaaagtagatacccgccatgtgaatccagaattacgagattacactcgacagggagcaaaagatgtcgtgctagagaatattccagcgaatattcatttcccgatataggaggctaatttgaaagagacatttattttgaatatttatagaggcgttcctgggaaataatattgggaaagttttgagttggaactacacccaggggagaatgtgatcagtgctctcatggaaattgaaaagaatcctgtaaatattcatggagagcgtgtggatcctgttgtttgggaacaggcttgtctagaagaggtttgtggctcttgtgcagttttagtgaatggtattccaagacaagcttgcactgcattaattcatgagcatatggatgctaaaagagagatcaagttagcccctctttctaagttccctttagtgcgagatttgattgtagatcgctctgttatgttcaaaaatttagaagagattcaaggatggatttctgcagagaaatgtggggaaggcgcaggccctaaaatctctcaagaagagcaaactttaatgtactctttgtcgatgtgtatgacttgtggctgttgcacggaagcctgcccacaagtaaatgaaaaaagtgattttatggggccagccgctattggcaagcgcgttattttaacgcttatcctggagagaaacgtcgagagagtcggttacgagcattgatgggtacccgaggaatagaaggatctgggcaggcccataattgtgtgcgagtatgtcctaaaaagttgcctttaacagaaagcatttcagctatgggatgtgaggtttcccgtttttctttgcgagcattattttcctcgttattcaagaaaaaaacagaggaataacagagagttttttggagatggggactcttaagtttcgaagattgcatcgcaattttattccatggtaaagggagagaaaaaactcctttcttcgtcatgtctcgtttggatgtttctgtatttgattccttagctaataaagaaaaagcttccttactggaggaggttttgtgtggtgagaacctgcaagatttcacaacgtatagcaaagttgctttagcaaaaaaaaatcttgctattgcaaggaagttagccagttatatcctgaatgaagaaggagatttggaacttagtcgagttgttgaaagtattcagctgttgacgaaatgtttatatcccttaggaccgtatcgccagggagaagggccgattcgtgagcatgtattaaagatgctggagtttttacgggatgatcaagaaattaaaaatcgttttcgaaggttttttgtaccttcttacgctagagttcaagatttaattcggaatacgttagcgctgcccgctagtgagacagtaaccgtacggcatgtacgtgaagccgctttagtcgcattatttacctatttgcgacaagatgtcggatcttgtttcgcaacagcattagcaattcttatccatcgggagtatccattattatttattcgtgatttggaagatttattatcttccgggaaaatatcccgtatcgttggtgatcgagagatttccgttccgatcaatcttctaccgtgtgtaggagatttatttaagcctatttgtgtaatggatttatatcccaatcctgtggctactcttgctgcttcgtcagatttacaagcagcattcgtagcttctggcatatttccaacaacaggggatatcgcaggtgaggtgcaaacgctactagctaatgagtttatctatcaaaaagttcaggatattcatgggaagataacagctcatgatgtcattcaggatagtttgttacatcactatcagctttctctttctacagtgcaagcttccgttttgcaggaaggtttccgtaaagagcgaggggatggtacggttttattgtctacgaatagtcaacgtgtacttagctatttagaatcttacgagcaagcaaaactgggatttattcgtgatacacagaatgtattattgaaatcgtgggaatatacgttagcaacgttagcagatgcgagtcaaacaacaaccaccaagcatttacaaattgctttaggttggaccagtgatgatgaggatggtttacgtgaaattatacgtagatttttagcagaagaagtagctacgacacaagcctttgcaggacaatgtgaagagacatatcaagaagcaaaagcgcagttagaatatgtggaaagtcggatgcgtaatccgatcaataaacaagatagccaaattctggctatggatcatgtgcgttttcgacaagaattgaatcaagctttacaagattggaatgctgcgcaagagaagctgaaaaaaatgatcatgctaccagactttctcttgtctttttattcacgagaaatccctaactatttccgtagcgtatacgatgcttttattagagagttttctgggaattatcaagatgttcctgcgggctttcgtatattatttacctatgggaggagtcatcctaacacgtgggagccgatttattctatcgaagaatttattcatgctttgacggagttttttacttctatagaaggagatctcctagcgaagcataatgtttctggattagaaaaagaaacttctattcttttgcatcgtattgtatcggctttacatgagcctcgttttcaggaggctgcaatggaaaggatcttgaaagcttataattgtcctattccacaggggattttccagcatttagatcaagttacgcataccccttgggtttatgtttctggaggaacagtaacgactttagtaggcgattattttgaaaattcgaaaccactcgtcaaactagaaaaattgcctgcggatccgcatgagttggcagcattttttgctgatgcattgaaagatcttcctgaggctgtgaaagattatgtagaaaatggggatcattctttattagcagcagccccttcgcatgtgttttctgttacggcaggagctccgttatttagagatgcatggactaatgattggtatagctatacttggctgagagatgtgtggctttctaagcatcaggattttttgaagcgtactcttttcgataaatcggcaatatatgcgtttattacacgtttctgtacacggtactatctccaagaacttacccaagatctcttatatttttgtgatgatctctcgttatctattcctgaattctatgaaaagagctcgcgtttctttcagtcgactgttcatgatgagaaagtagtagctactttacagaaatatttagcgagccagttcgtacatgaagcgccttatgtttctgaacagcagttaccccagattatcagtgatctttcttcttatttagggatttcttctcggatatcctatgatcaactcgctaccctactagaagagaatgtagggaagcattcgctattatcttcctcggatctcagacatctgtataaaggtttattaatggctgggtatcagcgtgtttatcatgaagaagatctttctatgaggctgattgctgctatgcgtcactatgggttagcctatccagctccgcttctttttggtgatacgaattgggcttaccggtattttggttttattntgcatcctggaacccaagagatggatttgtgggaatttaattatttaggattggtgggacgtccttcagaaaataaagaacgatggtttgctgttcgagatccttgggcgttgtatcccgaatcccatagattacggaatggcccctccaccaggctatcgaagtggattgccgaaaggtttttttagttagagagagactgttagataaaggataaaaagcctacagctccatcgatctgcgtttgatttttacttctcagcatcgttgttaacatctctgcaaagtttttagaattgagtggagcgagaggatcttttagtaatgcttctatagggagtgttttcaagtactgaatgatgtggggccctccagtaaggcaaacaagaatatctccggtctcaatacgttgttgttctgacatcgtgaggagatgttcttgtcgttttatgaatagagttggaggattagcaccttctgttagaacagacaatgacttggaagaaaggtcgtattcaagacaagctatagaaacagaagcttcattgcctacagttgtttcatcaaagcttcgcatcgttttatggcaaatagaaggtaatgagtagcctaaacttgcatacgttaggaataaactgcgggcagagagtgcgtagagataagaaggcagtccgatatctccagctattccaatcactccgaagaggcgatctttttcaggagtggcaacccaaccataaaaatatccggtttgttgttctccttgtaaataatgcaaagagaaagttcctcctgggagagaattcgaacgttgacagagaagggtatcttttaaggaagagagaagagcaagctctttttgtaataaatttccggaaatatattctatttcagctttttctttgacgttcagcagaagaagtaaagtacagttaaaaatattccccagttcattgatttcatagccataaggttgcggctcatagcggacattatggttgcctttccacgcggattccatactgacagaaagctcttgtaagggacgatttaatcgtttgctagtgcaagagagcacccatcccatcaaagaaaaagcgaggatatagaataagattacgttgatgggaagccgtaagcttgtgtaatgcaagtggatagagggatcagcgcaagagaatgggtatgtggtataggctgccaaggagataaataggctaagaaagttttcccgtgtattggaaacttttaacagttctttagctttaaataattcaggagaaggttctaaaggataagaagctttttctgaagagagagcgggatatccttccatggagagagaaaaagctccattttgaaaaggagatgagtctgaaaagagaagttctcccttatggttgagatagcaaagaagatcttgataggattgtttgttatggaagagatagttgcgtagtttttgcatcgaatagaaagcaattacccagccggctaatgaggggtcttcgtagataggaagtggttctgcaaaaacaaggtaatgatcttcggtgtctgggcgttcagaaatagagataaggctagcattcccaggattttggataagcttatcacgtatttctggatgagcttttatataacgaacaaaaggatcccgaggattctttgtacggatgctatcgttagcggaagaaagtaggcagagggataaatcggtatctccgagagcaatcatctcactataagcttcagtgaaaaaatcatgtgaggttgtgagggtttttaatgctaacgtttccgctaaacgtttcagaaaaatattttgaatggcgattttcttttcgagttctaaattaaagttcattgtgcgggtatgcagatcctgaatgatcgttgttttaacagccgcgaaggaaaagaaagaaaggacaacgagattgagaaggagaggagcaggaatcactaggaaaagaaaaagaaggattcttttggtgaatgtctgtctcattccgcacctaaaacatatattttagagaagataactgaaaaaagcttcttaacggcacgataaagaagtagaaaggaaaaaatctacaaggattcgttagggaagtttttaagatatgcgaagactaataagcggaaggttccttaggtattttcaaaacgagtaaagtgatatcgtcatgttgtgggcaatctttcacaaaagacttaatagagaacatgatagattggatggcttcttcggcactttgtttcgtcaacgaagccactaatgcttttaagcgttcttctccaaacatctctccatgcttattgcttgcttcagtcaccccatcggtatagagcactaaaagagactcctcttcaagaacgagagtgtaagcagggtgaggaggaacttcaggtaaaaatcctaaggccataccaggatgcgacaggaaagagatatctccattaggagctcggagacacgctgggttgtggccacaagaatagtattctagttctcgtgttgcgtaatgataacaataaatgcatagtgttacaaacatcccagattcagctgtctgttgatagaagagagcagctgtttgttgaacggcttcttgaatagaggagagctcactcaaaaaggtatgtaacatgtttttcaggaataaggagtaggcgcacgcattgactcctttcccggaagcatcagcaacgattagaaagagtttagcttggggaccttcgcctataacaaagatatcaaagaaatctcctcctaccgtaactgcaggaatataggctttagcgatttctgtagttgcggaatcaggcagctggttaggaagcaggcgttgttgagcttcttctcctagtcgtaatgcattttgtgcatgctgtttgatctcgaaatttttttctgctaaagattgctgttgcgaaaggctttgcaccatggagttaaagatttctcctagatgattaatttcaaagcccagagaatcgggttcatatggatggtgttgattgcgacgagtttccatcatggccgtagccagcttccggataggcttggataggcgttttgcaactaaaaaagctgtaatgcttcctaaaagtacgcaacaaaaataagcaaagtacagtaaggttcgtcgccataaagaagcaaaaattatagatttttcttcataagtcaatatgcggaaatccatctcaggtagagagtggatatatccccacatttctgtgttcccaatgcaaaatgaaacgaaattctcgccataaggaagaggatcgagatttaaaggggggcgtagtaagagatgaggggggcagatatcatcgcgaaggaaaacatcacaaaattgctctttagaaaccgttttgtgtattgatacaagatctaaagaggaatctgttgcttgaagaatgatgccatttttagagagaattgcagtttttacggagagaggatctttagctgcaagtaatccatttaataaatagttggtatccgaaagggtatagagtacgccaaggacttcttgagagctgatatcaaaaatattcgtttgtaagacagccagaacctgagaatcggaaccggaatgtcgcaaagtagcgagaaatggttgagaatctgataggaaaatctcttggttatagtttttaccaagttgttcgatgcggctagaagcaacgactctaaagttcccatcagcctctttttttactagagaaatctctttataagtggagtgaaagatcttctccatttctttacttagagcaagatccggttcagcagggactcctctgtctagatcaaaaatttctgaaaagagagccaggatatcaatatttaaaggaatagtttgttgtaaagtgtgagctttaaataaagcattttctcgcagatcggaagtgatagaggagagtgttttcttgtattgctgaaggttcaattgcaagatattgatccctaaggggaacataatagcggccacacagataagccataaacgaaaacctatcgtgcgtgtgaaggagatcatggaatatttattctcatgaatagggatggtcatttctctttttttccccagaggagcttaataaagttgtacatactctcccagagaaaaatcctcaagcaaagggggggggaagggatcttataagcaatcccttcccagctattttttcgaagtttccctatgctttagaaaagggatttgaatcttggaatagagcttctggacccatctcttcttcaattgccattagacggttatacttagcgatacgctcagaacgggaaagagaccctgttttaatctgacctgtattaaaagcgacagcaaggtctgctatggtagtatcttctgtttctcctgatctatgcgaaagaatggtagcgtagccttgtatagttgctaaacgaatagcttctgcagtttctgtaagtgttccaatttggtttggtttgatgagaacggcattggcaagtccttgagcgattccttcagcaatcaatgcagaattcgtcacaaataggtcgtctccaactagttgcacacgatctcctaaagtctcggataggagtttccagccctcaaaatcttcttcggctagcccatcttcgatagaatctataggatagtgctcacagagttctgcaagtatacccacttgatctgcatacgatttcccatcataggttttatcttgggtattatagaaagaagaagcagcgcagtcgagagctaaagaaatatcttctctaggtgtgaatcctgcagtttcgattgctgttaagagtagatccagagcttcggcattagaggcaagattaggagcaaatccgccttcatcaccaacacctgtagccagctgtcgattctgtaagattttttttaaggcgttgaagacttctgctcccatccgcacagcctcttttagagaaggagcgctaattggacgaatcataaattcttggaattggagaccatttgtagcatgcataccgccattgatgagattcatcatagggcaaggaagcacatgcgagaaagatccaccaagataccgatataaaaggtctctgtaaagtatttgcaagcagcttttgctaaatgctagggagactccaagaatcgcattagctcctaacttttctttgttcggagttccatcagcatcaatcataatcgcatcagctgtaatttggtcaaatacgctgaatccttgtaaagcgggcaccagcactttttcgacattagaaatggcttgtaagacccctttcccttggtaacgtttaggatctttgtcacgcagttccaaagcttccttgatgcctgtagatgctccagaaggaacgcacgcttcaccaaaggttcctgtattagtgatgactttaacacataatgtgggatagcctcgagaatctaaaatttctctcgcttctatatcggagatgacgacatcaaacataacaagatccttgtctagaacggttaatgaaagcagttcgctcgttttatctaatttcctccgatgagcatgtatgaccgcaatacaaagagaaggctcggagggagattcccttagtagaaaaggatcatagcgagggattcaattctgtggtatccttttcagtccccattttcttcttctcctttttgaaagaggagctgtttttttgctgcattcatcaaatcacggtacttcgcagcttcatcgaattggaactcctgagctgcttgatacatggcttcctcataggtttttatagaggcttccaactctttcgaagattgcatttttaaacgagtttcttcttgaccagcttctttagtaatcggattagctaagaacggtttaataataggttgcggagtgattttatgttgttgattgtaatcgagctgtatttttctgcgtcgttctgtttctttgagcatatgatccatagatggagtgatgcggtctgcatagcaaatcactttcccatgaatattacgagctgcgcgtccacaaaattgaataagagaggcgctactacgtaaaaacccttctttatctgcatcaagaatcgctaccaatgaaacttctggtagatcaatcccttcacgaagaagattgacaccaatcaatacatcgatattccctaatcgcaaatcagtaaggatctgcgttctttctgctgtttcaattcctgagtgcagatatgcagcagcaatacctagctctgcgaggaaggcagcgatatcttcagctaatttttttgttacggagataacaaggattttttcttgatctttacggagccgttgacggatttcttctaagagatcatcgatttgtcctttagctgggcgaatctctggtaagagatcaggaattcctgtagggcgaatgatttgttcgatgatatgtccacgactttcttgaatttccagatctccaggagttgcggatacataaattacacgatgaaaataacgacgagcttcttcataggtgagcggtctgttatcgaaagccgacgggagtcggaatccatattctactagcgactgtttgcgagactgatctcctcgatacatagcacgtaattgtggaagagtttggtgagattcatcgataattaaaagaaaatcatctgggaaatagtctaggaggcaggttggcggctctccaggagcggcccctgtaaaatgccgggaataattctcgattcctttgcaaaatccaatttctttaatcatttcgatatcatgcgtggtacgttgaaagaggcgttcttgttctacaggacgtccttcaaaaaaaagcatgcgttgctcgagttcttctcggattgtgcggatcgcttgttctcgaacagcttccggagttacatagtgcgaccctggatagagagtgatggacgaggtggtatgggaggggatcatagttaatggatccacatactctatcgaaataagcgtatcgttcatgaattcgagtcgtacagcaagatcgctttcataggccaagaagatatcaatgacacttccgcgttcacgaaaggcactccgttgtggtgtagaggaggcctgatagtgcatgcgtacgagttgagaagagagttgcgatcgagggtattctttaccaacttctaatgtgagagccatagaagagtagttatcaggagatcctattccatagatgcaagaaatagaggaaacgataagagtatctcggcgttctaagatagaacgtgttgctgaaaggcggagcttatcaatttcatcattgataagaaggcttttttcaatgtacgtatcactacgagcgatataggcttcaggctggtagtaatcatagtaggaaataaaatattcgactgcattttctggaaagaaggctttaaattcttggtacagctgggcagcgagagttttattatgagcaagtaccagagtgggaacattcacgttagcaataacatttgccatggtgaaagtctttccggatccagtggttcctaagagaacttgtgcagggactccatctgtaatcccttgggatagtctgcgaattgcttcgggctgatctccacaagggaggaaaggagcatgtaatacaaattgctgtttcagaactcctcctcccacacaatggatagttgttaagattttttatttagaagaggctagaatagtccgccatttccggcttaatcctagatggtcatgcacctcttccatggtttctcgagctacggtacgcattttttccgttccttgttgcaaggcttcctcgagaaatttaggctgagcaactaattcactacgtttttctcggaaaggatttaagaaaagattgatttcttctgctaaacgagcttttacttctacatctttaatgcatccttgacgatagcgagtcttaaactcttctacttcttccttatgaggattaaaaagatcgtggtagataaataaagggttcccttccactcttcctggggttgtcgcgtgaatccgattaggatccgtgtatagttttcgtattttttcttgtactgtctttgcgtcatccgaaagataaatggcgttattcgcggatttactcattttcccttgaccattggttcctacaagggctgtcagttctccttgcagaatatcgggttctggaaacacttccccatagagccgattgaatgttttggcaatatcacgagtcagctctacatgagcctcattatctttcccaacaggaacaagatgtgctttagcaagtagaatatctgcactttgtaatacagggtatcctataagtccatgcgataggctttcttcatttagagaagcattgctggccatttctttgatgctaggaatacccataatgtgattcaacggggtaagcatggaaaaaatgagatttaattcataaatctcagggatagccgattgcaggtagattgcggatttttcaggattaattcctacgctaagccagtcggcaagaacgtcataaatatgattatctatttgaaggacttcttctttgcgcgttttagtagttagcgtgtgcaaatctgctataatgaagaaacaatcatagcgagagtcattttgtagctggagacgattcataatggagccgatccaatgccctaggtgaagtttcccagtagggcgatctccggtaagaacgcgtttttttttcatagttgactcacgaggcgaaaaaacctcgctccttgctttttctttaattcttaatttatcgatgcaagacatctctggatttttacgaaaaataagcccctaaagccctgctttttaaaaatagtctgattcaggggctgtgtaacatcatctttagaaagatgattgttaggaatagattacacagatttcgttaattcttcaaagtgagcgcgtaaagaatcgagatcttcttggatttcttggagatttttttctccgataggatttttttgcgcttcaagcagacgagacagtaagtggcggatgagatggcaggtattttgtacatccgtcatgagtagaaattcctgcccatcaactcgagagagtcggtttaaaaatacgcagcgttcctgttgagctagcatatcggaagtaatgaaattgatgaattcaccgcgctcatggatatccttcgcaacacgaatcggcatcataaattgtacaattagactttgtgcagattgtttctgtcctgcaggtagctcttgcaacaacttcccattgatcaacatctcaaataaaaaatttgcaagctcctgttgtccttgtgcgcagttaaacactacattttgaaattctctaaacgttgtatacccaataggcgtggcaaaaattctttttaaattgccttccaaaagcaggaacgtgttgttatcgatttctagagttttgggtttcgtcgtcattacgggataccttagtgttagaaagaaggttagttgtaactttttgtaactttttaatcaatttttccagggagaggagctcttcttgagaaatgtctgtacatcgctgtaataattttgttccttttgcaaaaaaagaaaaggcttgttgggcaagggatgattgacgtcgatcggtaggaagtagcggaaattctctacggataatttctaggagttctccacgagtttcaccttgatagttacggataatttcctcttttttctcttgcgagccttctcgagaagctagtgtatacactgcttgtcgaggcagtctttctaactcgagtttaagagtgtctggaagagctgagaatagctcgtaataaacaagaaaattataaggtgtctgccgattcccataggtgagtaagagccaagctgaaaaagctccttctcgataggtttttaataattcacgaactttcttgattcgctcaccatggagaaggacagcttgatgatgaatctgtttaacctgagcagataagtgacacagttgttggagatcgttatgggagatttccttggaaaaggagtactcttctagtaattgacggaatctagcttcctcttgcgaacagagtttaggagtagtaaacccatttanaanaggagaaagctctccttctaaacgctttttancgagggattccattttancgggtgtaggtttcttaaagcgaatctctaaaagggttttaatatttcccataacgttacatgtcacttaacaaaaatagcagttcttcagttaattttagatagtcttccgaggctcgcgctgaaggggctgtggagaaaacaggtttcccatggatagcggcttctgagatagtaatatctctgcgtatgcgcgtgttaagaagtttcccagggaacgttttttgaattagctctgtgaaggctgcgttatttttccctctgtaattccaaaaagatagcgtgactcctaaaatattgagagggtgtcgcgatgagatcccttgaataaaggtggcaagcctttctaagcctttaacactatagaattctggtgtagcgcagatgagtgcatgctgagcagcgattagagctgattctgtgagccaacataaagaaggaggtgtgtcgataatgacatagtcgtatcgatgttctatcttagaaagaataatctttaatcgttcatgagaataacgatcagcagctaaagatccagagacttccacacgttccaaccaagtatcggcagggatgagatctaatcctgaggaatcaataggacggatgacctcttctatgtttttttctccttgtagaacaacggcaaggctatcataacaatcaggatctaggcctaatcctgccgtaagattcgcttgtgcatcgaaatcgatgagtagaacgcgtgctttatgatattgcgctaatgcggctcctaaatggagggttgtagaggtttttgctgtgccgcctttgaaactattaacagcgattgttttcatgtttatcacgaggtgaagcccttgtagggggaggaagcctcgctcctttttagttgctttaattcctttatattgatttgtccataagcatggacgaatgaggttaaaggagatgaataaagtaagaaagctctccagatacctcttttctatattattgggtacagtatcctccggtagaaaagtctatttttagggataagtcttttgtaaacggaacaggattactgtagcaactaccatgggaagaaaaatcgtatagttaactcgatgagattttagagccctgggcctgcttgttttattcttatttagaattttttgctacagcgaacatgttataaaggtttcggctatttgaaatccatgatcgtttgtaaggagattggcgaggatgtgtgaaaagaaataatgggcttgcataggcagaatctatgcaagcccggccttctataaggaaggagtcaaggataaagagcgaagctcttcaagaataacatgagagaactgttcgacagcgatatcgttcaacacacgattgtctcgtgtgcgcactgctagtaagtgggtctctaattccttatctccaatggtgatcatgtaattcacttgcatgttttgcgcattgcgaattttcttactgacagactcattagatgaatcaacagagacaatgattcccatttggctgaaatgttttgccaattcttgggcacgagcctcgtggcgatctgcgacggtaataatgcgaacatgctctggacttagccacaaagggaaccgtcctttgaaatgttcgattaaaatgcctaagaatcgctcaatagatccaaacaaagctctatggagcataataggtgtacttttctctccttgtgcatttgtgtacttcaggtcgaatcgttccggcaggaacatatctaactgaatcgttccacattgccaagtcctgttgatcgcatcttttacatggatatcgatttttggaccgtaaaaggctccttctcctgggcttatgataaaaggtttttgcgatttaacgagagctcttttcaaagcctctgttgcaagttcccaaagatcatcgcttccaatggttccttgttcaggacgagtggaaagttctaagtgatactcgagtccaaaagttccatagagttcggaaacaaggtttaggatattgagtgtttcctcttcaacttgctcaggtgttaaaaatacgtgtgcgtcatcttgatggaaagtacgcactcgcatcaagcctgatagagctccagaaagctcgtgtctatgtacgtggccgatttctgcaatccgtaaggggaattctcggtagctgtgtagctgggttttatagtacagcatgcagccaggacaattcatgggtttaattgcataatcttcttcatctacggtgagggtatacatgttttctttgtaattttcccaatggccagagatctcccataactctctattcatgagttggggagtttggatttgctgatagccagcacgctgatgaaggcgtttccagtagtcaactaaagcgttccaaacaaccataccccgaggatggaaaaaaggcattccagcagaacaagtttgttgagagaacagatctaactttgttccaagaactcgatggtcgcgtttttttgcttcttctagctgatgaagatgttctttcagttccttggtcgtagggaaagagactccatatattcgaatcagcgattctctagaagggtcacctttccaataagcagaagatgtgcgtaatagcttgaaagctttaacaggagctgtcgaaggaaggtgcgggcctcgacataaatccaagaattctccttgcgtatacgcggaaatttctacttcttcaggaagctcagcaatgagctctgctttaaagggattttgagaaaaataggcaagagcagcttctttgtctgggaaaacctgacgcgagatagggaatttttcttctgcgatcgttttggccatagcttctatagccgggaaatcttcttcgctgatggaaagattggcaaaatcatagtagaacccttgatcgatgactggaccaatcgttggctgtgccgaaggccataagcgtagaacggcttgagctagaatatgtgctgaagtgtgtaaaaagatttctctacctttaggatcatcccaagtgaggaatagaacggtatcaccgtcttgtaaggtggtggaaagatccttttcttgatcattaataagggcccctacaaagcaatgagattgtttcatcttatttgcaagatccatcgccgaggcgccttctggtagttcgaaagcttcttgattgcaagttacatggatcattccttctccataaataaaaaatttactgcaaaccgctgcaaagaatcgtctctttttacgcggagtgtttgccattgtagcgtttcacggaactaagcaaaagggttttataaaggataaaatgagaatctgagttcggaggagcttcttttaggagattgtatagagatccataacaaaacttttttcaacctgggtttttttcaagagatgccctacaatagatccttatttttttagtgcacagctagcaacaagcttggttgttctatagaacggatcgtagatccgtgcgacacggttcatggtggcggtcaaggcgttgttattcgcttgtactctacgaacctgtgtgtttaaaccctgttgtgacatggctattttcttaattttcctgaatgctttcatctggtcctcttcgtttgctttaagcaagtcggcaatggaagctgcagctcctttatttgtgacagggagtcgaatggtattggccggagtagttctttttgggctgctattatgtaaacgcgagtctcttcgtctgccgcgtccagcgatcatgcctatagtattgctctccgttatcggtttctatttaactaatgtattggaatttattggattgcagaggctttcatcctcaacagcttgctttatttatggattttcacctttcacagccgctttttgttcttacgtccagcttagagaggttgttacttggaaaaagcttgggggattaagtttagggttagtcagttaccttgtgtacctgctgtttggaggtagcgaagatgtagctgagtggggatggcagttaggattaccggaactcttattgatagcagctacctgtctttcttcttatggttggactttgctcagaaaattagggcgaagatgtgagtcgctatccatgaccgcgattaatgcgtatgctatggtcatcgcaggggtgttgtcgttaatacattctgctgtcaccgaagtttggaaccctgtgcctgtggaaaaccctttactatttctacaggcgataggtgctttggtgattttttcgaatttgatttgctataacttgtttgctaagttattgcgttctttttcttcaaccttcctgtccttctgcaatttagtgatgcctctatttgctagcttttttggttggttgcttcttggagaaagtttccctcctgggctattgtttgctgtaggttttatggtgttgggttgtcggcttatttaccatgaggaatttcgccaaggatatgtgctgacttcagagtaaagaaaaaccgtagggcccttttaggatgcctacggttctgaagctgagttgcaaataagagcgagaaagaaagtcgattagttaaacatagaggctgtcgtttgcagagcagagtccgagatgctttgtaaagtttgcagtgcggaattaaaactctgttgagattgctcttggagttgttgggcttgcgaagcatactgggcttgaactgagttaagagatttgagctcctctgcgcgagcctctgccataccagccattctttgttcttgggctacctgcgctccgatcacccctccgacgatcccatcgatcccagccgtgagaccgtgcaccatttgtgagatgttcatagcagaagacaaggctcgccctgcaaatttagttgcgcgtgttccttgcgttttcacaacgttcattccacgagacactttttcagaccagctaggagtgttcaatgcctgaccgaataatcctcctgcactcttactagctgtttgagagagggttttcgaggcgctttctgccatgttttgcgtaagttttgtagctgcggatgaagctgcagaagctgctccagaagtggctttagctccaactgcagtagctgtaccagctacatcatccagtgcgctagtggctgtttttgctaaggaactggtcgcagaggttgccgcgcttgcagtttcattagtgaaggctgcagattttaaccctcccaaactcttcgaggcggataaaatccctcctcctacagagaccgcgaatcctactatgttcgtaatccctgaaatcaaactctgctgagcttgtaattccgtagctttggcttggtggcctgcttgtgtccgaatagcatttccgatctctggagccatagctacctggttctggatagcttggttttgttgttggaaggacgaagaccaggatttagcacttgctgcgcgagtaggtcataatcagtcccatgagcgctaaagttcccattcctttccgtagaacaaccccattgacttctgttccggtaggggaaggaagggtggcggatccatcgctattaaatccagaatcgcgtgcaccgtgaacggcttgtgcagttgctgtttggctagcctgagctacggatgttgtggttgatgttccgctacttgcctgtgctttttcactctttctactttttgatgtttgattggcagtagcctttttacttcccccagttccttgagcgtcttgcagtaagtcttcaaaactggcgtcaacgttttcttgtttagcgccggctacctgaccgttttttcctgttgaagctgcggatgctgagttagcattttgggtgagctgagctaacaatgagggatctggagcattatctccacgtactcctgttgtcataacacacgatctccatcaaaaaattaatagttaagctgcggcggctaaggcgccacttattgcggacaaantttcgctatctgagctccggttttggccgcctgctgttgcgtttcactagggctttctgtttgtttagctgcaattttacttgcttgttgccagaacaatgtgaaagctttcatcatttcagattgagctgtgagagctccgacttctttttgaatttgggccagttctttctgcatgtctgacagctgcagactagtaatcccggatacgagttgaggaactgctgtaagagctcctactcctaaggttacccatttacttcccaaagtgttgataactttggagagtttagggaacgatttgctaacagcatttttccctgcgctgaaaattttacccacgtttttagcaagggttttcacagacgccttaacagcttgcttaatggcttgtttgatcccttgtttaatcccttgtttaatagcttggacgatagcccgtttaacagcttgaataatagcttgtttaaccacttgcacgactgcttgcatagtcacttgtgtagcgactgttgtagttacagaagttgctgtcgttgctgctgctgtagctccagccgtggctgctgtggctcctgcagcagcagttccgatcaagccaagaccgcaagtgaataatgcggatactacagagatcacagtaatagccacggtaaccccaatcatcactttgttaacggtatccatggtagagttggttccagacttttgctggatctcttgcatttttttgaactcttcacgctctttatcaattttaaggccttgagattctagagacattttgttcatgttcgcagattgcgactgcgtactttggaagttctccaatgctgcttgcgttgactctccaagagcggtaattgcttttgctaatgcaaggctaatttccattacttcttgacgaggtgtcgttgaaggtttgggtaggcctggagtttctaagttcgtcaaggaaagctcgttagtagcacccatagcagaggatacgatgctttgaatttcttgtagatgcgtggcatctacagatgacaacgaacttaaagaagatagctctaaagatttgctagtatcttctatgcattgttgcgagctagctcctttagatgcgctttgggttagggatgtcgcatcggcagatgcagtttctttccctgcagctaatccttgctgctctataagttcttgtccttctatttgagaagcagaagctgcgcgatcttttccagcagttccggcaacagcgacatcgctctccatgcttaggtcatcgcgattttgtctcgtctgttgaacttgcttaacctgattgtcggttaatttatctgcattaggaacgccttgaggagtcgaagctatgacttgcgacaagacattcttaaggttgctactatcggaagacgaagaagatgaaagggacatataacctctctaaaaactctttgtaagacgagacgattatttctcatcagcaatatgtttatttacggtttccgtaaggtgttttaagccgaggaatatactagaaatttcttgagataactgggcttcctctttaggattgtcaaacaccccttttgtcaaggtttcgacaggaagagagtctaacattccgctgagtgctgccatcattttggctaattgtttctcatcttgtatttctgagaacatctgcgctaaaggcaagtcttgagaaaaagaaatcatcgcattttgcaattcttgcaaagcaggagattcttttttcgaaacatacgcaggttntactttgggtttggaagaagtgtgtgcttgcttgtgcttatgttttttactcatggtttagtccctgcttttactttgcttttttcttgttagaagcagcttttttagcttttgnntttttaggagacggaggcttgtgtttcagagccttttgcagatttctcttttttcagcacggcatctaaagattgcttcataatgctgcagcgatctttaagaactttatattccggcttgttcttacacatatcgatcgtaatatcgaggaagtcttgagattcttcgggttggtttagcttcatcaagctatcggcgatgtagtaaggagggatggggttttcgggttgagcatcgaaagctaggaagaaaccaaaagcggcttcatcatacatttttagctggtgatagcaagagctaagacctaagatgtatttgtagcattgaggtttggaggctgttaagatttggaaaagaccgatagcttcccgatatttcccttgggagtagaaggtatatgctacggtgtagatctcttcaaggaggacgtcggagagacctaaaatttgctgaagagttaatccgttgcttaacccctgtaggatgtccatgagaacttgttttgtctcctcttccgtaggaacaggatatttttgttccaaatcctcagcttttgcttttttttgtgcagcaatctcggccaagcggctacgtgattttttattaaaagaggccgaaggttttttagaattattagaagatggagtgctcatcgcgataattcctaaaaaaataaaataacaaattactactaacaatattaaattctaacgatctgatttaacaagttgattaataaaaacgtttttaatattttgcttttaataaaacataactaattctttttgcgtaagtnaacatcgtgcagcagcgtgtgtcgttgccttgcaatttttccgttacctcctgcgcgaaaggcttggacttcacgctttctctcgtgctgtctctcgctgaatagtaaagtcttaaaatcatagcggagatgctttgtgtcgttatcgccttctcggattcgtttattagatagtgtaacggttaaccagatctctgctggtgaggtcatagaaaatgcagcttctgtagttaaggagctgattgagaattcattagatgcaggcgcggatgaaattcatatcgaaactctaggtgggggtagaggccagattgttgtgcgagacaatggagtggggatggatccagaagaggtgccggtggcgcttcaacgtcatgccacttcaaagatcgctcattttgctgatatcttttctctcgctagttatgggtttaggggagaagctctgccctcgatagcctcgatttccaaaatggagatccatacggctcgtgcaggaggattggggtctaagacgttgattgaaaaaggcgagcctgtttgctgcgagcctgctcctagacagcagggaacgactattgcggtccactcccttttttacaatgttcccatgcgacaatctttccaaaaatctccgcagatggatcggttggccattcgtcgtttgttggaaaatagtgttctttcttcagaaggcattgggtggacgtggattagtgagcgtcgtcaagaactccatgtggctaagaaacaaggcttcatagagcgtgtagcgctagtcttgggagagtcttttgttcaagaagcattctttattgataagcagcaaggggatcttcgggtgctaggatttttaggctctcctaaccagcatcgttctactaggcagggacagcggctttttattaataatcgtgctgtagagtcgtctttcatatctaaaaaggtagcggaagcttatgcttggatgatcccagcacaacgctaccctatatttgtattgaagttattcttgccgcctatgtggtgcgacttcaatgtgcatcctcaaaaaacagaggtgcggttactacaagaagggcagattagtaatttgcttgttgaggcaatttcagaggcgttgttgcgtcgatcatcctctttggaagagattgtgttgaaagtccctacagaaaaaatccctatagaaaatgaggggatcagcgttccatctattcgtcctgcgattgtctctgccccgctttcttgtcctactttctcgcagcaaccctatttgaaaacagagatggctacgattgtgtctagagactctgcctcgagttctctttctgttgttgagaaagtacgctttcttacatccctaggtaaagttcttttagtcgaagattctgaaggggtccatgttgtatttgtacagctgcgcgtaaacatttgttttatgtttctttattatccgagcgtttagagtcgaggttagcctgtcaaacgtttttacttcctccatctgtacagatgactaagttggaagcagactttttacagatgcggtttggaagctttgactgctttaggaatcgaattatcgcgtattagcccagacagttttgcaatagaaagtgcgccgccttttattcaagaagaagaactgaaagaatggattgttgcgctagctcaagaaggagctctgcatgtaggggagtcttttgaacaactcgttgaaaatactgttcaaaagttggttttctctagaaatgcaagagcattcgattatgcttggcttgatattttgtggaagcttggcaagcctgaaaaaagcgtttgacggagagatgatacgtcggttagttttggatgacgattttatgtaggagataggatatgaatcaaaatccgatcaaacgactgcaagattctctagtggagcgcgcacttgatgcttttttgatagagaaagacgaggatattagctactttttacaagatcaggctcgatcaggagttttattgatcactcgtgatgaagcagtattgtttgtgtctccattagataaagatctctatgctcgtatccaggacgtggtgcttgtttcttattctaaaagtgtggatcaggaactcggcagttatatcgaaaatacagggttaaaaacgataggctttgacagcgagtatactccttacgggatagcacaaaaacgaatgaacagcgggtatgcattttctccgcaaagtttagttgcggagaagttacgttgtgtgaaaagcacggaagaaatccaaaaaatgactcgagctgcggaaataggttctgcaggatatgattttgttctggctgcattacgcccagggattacagaaaaagaactggttcggatgcttcacgtcttttgggctaaccttggtatagaaaaggtctcttttcctcccattattgcatttggtgagaatgcggctttcccccatgcaattccaacgaatcgatctttgaaaaagggggatgtggtgttgatcgacattggcgtttgctatgaaggatattgttcagatatgactcgaacggtggcatttggagcggctccagaacagcagctattggatggatacgttgcggttgctgaggctcagcgtgcagccatagagttctgtcgggcaggagtgccttgtcgggatgttcataaggaagctgtgcgtattttacgtgcacatggaatggagaaagcgttcattcatgggctagggcatggcgtgggaagagaggtccatgaataccctaggttatcgcctttttcggatgccacgctacaattgaatatggctgtgactgtagagccgggggtatatttccctggtgtaggtgggatccggattgaagatacgatcgtgataggtgtgaatgaaaatttaaatttaacaaaccgaaaggtctcttccgagataattatcatttaatttcatataaaagccgatttttttgtttttttaacaaaaaaacggcttttcttattttcttttgtaaaaattgattttttttctcaaatcagttactttatacaattcttttttgtttctctgttgttatgcgccaacttcatttctttttttatcaatggataagaggcgccgccttgataggcgcgatcgccggggtatgctctcctcttacagcagaggagaagcagcctgcgtgttcaggggcttgggcgctacaagacttttctatcgaggaagaactcccggatttacggaatcagtttgtgttccttggctgtaataagcgtccggatgcgcgaagtggtaaattttttttagagcttgcgaccactaatgcgattcaagaagtttctttaggggaaaaggtttttcttcgacaagggccggacgaagaaacactcgtttttagtgctgagcctacccctctatggttggagtgtcggccttcttcggacgggcgttctttggatgttgttgttcgtatgaaaggcgctttaggaggggctgtctcttctcctaaggagcgcgcgcatttttctttatccatggcacctagatgttcgcagacatgggaaattgggggaatgcgagtggagcctagtatcgctgtaaagcagcgtatccgctgtgtgggaggggataagtttcttcttatgcatggaggggcagattatgtcatacaggctgccaaagaacgagtagatttcgagtctttatctggggaagcgtatagccaatatttggctgttggagatgtgcttttatgggatcaggatcgatgggttccttataagactttccaaggagatggtactagagtccctcttctcgaagtcaagcgtttggatgatcggatgatggtgattgagctgtggagcatcgatgggttgatgagccagcagatcacgctggtgaaacaagtttcttctcctattgaaatcgcagagttggtgaaggagttttcgtttgtgggtatgcgaacatggtctcgccctattattacagcagggaaagatcgtttggttctttctgcagatgattgggtcatccatacaggggagcgctgggagagggtaacttcaaaaagacaattagaagattacctatcaggtaagcttcggagccctcttttagtttttgaaagaattgataaggaagacggggaatttgttttcaaaggacatgtatttaatactcagcgcacagttgttgagacgatctctttaccgcttaagcaggttctagagactgttgcacagagtcatttaggtcaggagagcgggacgaaaaattctcgtatagggggaggatcttaggtgaaaaatattttgggctatgggtttctagggactttttgtttgggaagtttgacggttcctagtttttccatcacgattacagaaaaattggcttctctagaaggaaaaacggaatcgctagcccctttttcgcatatttcatcttttaatgctgaattgaaagaggcaaatgatgttctcaaatctttatacgaagaagctttgtctctccgttctcgaggagagacttcgcaggcggtatgggacgagttgcgaaccgattgatcggcgctaaacaacggatacgttcattggaagatttatggtcagtagaggttgcagaaagggggggggatcccgaagactatgccctttggaatcatccagaaactacgatttataatctggtcagtgattacggagatgaacagagtatctatgtgattcctcaaaatgttggggcgatgcgtatcacagccatgtctaagctagtggtccctaaagaaggatttgaggaatgtttgtctttgcttttaatgcggctgggtattgggatcagacaggttagtccttggattaaggagctgtatttaactaatagggaagagtctggtgttttaggtatctttggatctagacaagagctagatagcttgcctatgacggcacatattgcttttgtactttcttctaaaaatttagatgcacgagcggatgtacaagctttgcgcaagttcgcaaatagcgataccatgttaattgattttataggggggaaagtttggttatttggagctgtcagcgagattaccgaactccttaaaatctatgaattcttacaatcacacaacatacgagaagagcatngcattgtttctttatcaaaaatagaaccctcagaaatgcttnttattttgaaagcagctttccgagaagatttagctaaagagggagaagattcttctggagtgggattaaaagtggtccctttacaaaaccatggacgctcgcttttcttaagtggagctcttcccatcgttcagaaggcaatagatcttattcgggaactagaagaggggatagagagccctaccgataaaacggtattttggtatcatgtcaaacactcagatcctcaggagcttgcagcgcttctttctcaagtacatgatattttctcaaatggtgcttctggggcatctagtagttgtgatactggcgtagtctcaagtaaagcgggatcctcttcgaatggattaggggtacatatagatacgtcgctgaggagctccgtaaaagaaggttctgcgaaatatgggagttttattgcagattccaagaccggaaccttgattatggttattgagaaagaagctttacccaagatcaagatgttgttgaagaaactggatgtgcccaaaaaaatggtgcgtatagaggttctgctttttgaaagaaaactatccaatcaacgtaaatctggattgaacctattgcgtttaggagaagaggtttgtaagcagggaacgcaagccgtttcgtgggcaagtgggggcattctggagttcctgttcaaaggtggagcaaaagggattgttcctagttatgactttgcttatcagtttctcatggcgcaagaggatgtccgtattaatgcaagtccttccgtcgtgactatgaaccaaaccccggcgaggattgcgattgtggaagaaatgtcaattgtagtttcttctgataaggataaagcccaatacaatcgagctcaatacgggattatgattaagattcttcccgttattaatatcggagaagaggatgggaagagctttattactttagagaccgacatcacgtttgattcgactgggagaaatcatgcggatcgtcccgatgttacacgcagaaatattacgaacaaggttcggattcaagatggcgaaacggtcattattggggggcttcgttgtaatcaaactatggattctcgtgacgggattccatttttaggagagttgccaggaataggaaaattatttggtatggattctgcttcggactcacaaacagagatgtttatgtttatcactccgaagattttggataatcctagtgagacagaagaaaaattagaatgtgctttcctggctgctcgccccggggagaacgatgatttcctcagagctttagtagcaggacagcaggctgctaaacaggctatagaaagaaaagagtctaccgtatggggagaagaatcctccggctctcgaggaagggtggagtatgatggacgggaataaaggcactatgcaagatctgttagatcggcttccctactcttttttaaagaaaaattatttgctgcctgtagaggatttaggcgacaagatcgtttttgcaaggcatttgaaaaaaactcctttagaggctttggatgaggtgcggttgatcacgcaaaaacctctttcattggtttctaaggaagaagcagaaattattcatggattgcaaaagctatatagcgataaggacgggaaagcttccgagatgctacagtctatgcaggaagctgtagtgcctgaatcggaaagtgataccacagaacttcttgagaatcaagagaacagtgctcctgtagtgcggttactcaatctgattcttaaggaagctattgaagagcgagcctcggatattcattttgaccctgtggaagatcttttacgtattcgttaccgcatagacggtgttctacacgatcgccacgctcccccgaaccatttacgagccgctcttattactcgtattaaagtgcttaccaaactcgatatcgccgaacaccgactgcctcaagatggtcgcattaagttgcaactaggaggacaagagatcgatatgcgtgtcagtacggtccctgtcattcatggagagcgggtggtgttgcgcatactggataagcgcaatgtaattttagatatacgcggcttgtgtatgcctcctaaaatggagacctcctttagaaaagcgataggagttccggaagggattctattagtaacaggtccgacaggaagtgggaagacgaccactttatatagtgtcatacaacacctttcaggtccttttactaatatcatgaccatagaagatcctccagagtataaactccctggtgtcgctcaaattgctgtgaaacctaaaataggactaaccttttctaaaggacttcgccatttgttaagacaagatccagacgttttgatggtaggagaaatccgggatcaagagactgcggagattgctattcaagcggcattgacggggcacttggtagtgtctactcttcatacgaatgatgctgtttctgcaatcccgcgtcttttagacatgggagtagagccttatttattatccgcaacaatgatagggctgtcgctcaacgactcgtccgtagaatttgtacgcattgcaaagaattctgtgtggccgatgtgcaagaacaggctttattaagagctctagggaaggatcctttcgctcctttatgtaaaggacgtggatgttcacagtgcttccgttccggatacaaaggaagacaagggatctatgagtttgtcgatgtaaccacaacactccgttctgaaattgctttagggagaccttaccacattttacgaggtgttgcggagcgagaagggtattgccctctgctagagcatggagtagaactggctcttgctggggagacaaccctttccgaagttttgcgtgtggcaaaacggtcagaatagcaggaggggatatggctaggtttctttgcacatatcttgatcagtccgagaaaaaacgacgttcttttgtagaggctttccatcagcgagaggcaagagagcttcttgctgctcaaggagctcgcattctggacattcgaaaggtgcgagagagaaactaccgtgtcacaactacagagctggttatttttactaagcaattagcgttattattacgatcggggatctccttatacgatgctttgacttcattgcgagatcagtatcagggacatgcgctggctggggttctcacttctttgatggaagctctacgttccggtggggtcttttcagaagctctagcgaggctcccgcatatttttgattctttttatcagaatagtgtgcgttctggagagagtattgggaatctagaaggcgctttaatgaatattattaaagtgttggaagagaaggaaaaactatccaaaagtcttgctgcagcattgagttatccagcgatcttattggtattttcttgtgctgttgtggtgttctttctaataggggtcattcctacattgaaagaaacttttgaagatatggagatgacaaggctcacaaaagctgttttctcgtgcagtacatggttttgtaggtacaagtttcttgttttgctgggaggaataggtggagcgatatccctacgcatagtctggaaaaaacggatagggaaaaggactctagaggcaattatcaagaagatccctattttgcgtagtctggtgattaaaataggattttgtcgattttgttccgtcacatctgctgttttgcaaggaggcgggaatttgatcgaagctctgacattaggatgcgaggccgtatcacaagactttttgcgcgaagagctacaagaagtgatccaagcagttgttcgtggaggatctttgagtcgtgagctatctcatcgtacatggacgccaaaactggtgattgggatggttgctctaggagaagaatccggggatcttgcggtggtattcgcgcatgtcgcgcaaatttatagataggatattcaaagggtattgacttgggtaactgcctggtgtcagcccatagttcttgtgttgctaggcggttttattggattgattatgttatcaatccttcttccgttaacaagcggtattcaaacgttttaactacaggagggaaactgtgaagaaaacaaaaaaaagaaaacaatccattacgttagtggaaatgatggttgtcattaccctcattggtattattggtggagccttggcttttaatatgcgagggagtttgcaaaaagggaaaatcttccaaacagagcaaaattgcgctcgcgtgtatgacgtccttatgatggaatatgcttccggaaatttgtctctaaaagaggtcatcgcaaataaggaagcgattttagaagattctgcgtggtgcaaggaaatcaagaaacttcttaaagatgcttggggagaagatcttcttgttaaaatgaatgacaagggtgacgatattgttgtgttctctaagaaagtaaggaatgaacagcgagggtaaggggacggaaatggccttcaaacgaaaacgttgttttttactagtagaggtgcttctttctctctccnttctttgcacagtgttaattcctagtgtggtgttttatacacggatcactcgttcgtttgaggaagacatttttcgcttacagcttcctgcatgcatcgattactgtttttttgcggtggaggacgccatatttcagcaaatggatagagaagctctctccctgaaaggggaaggagagcttgttggggtgtatgtgtatacgagcaggggagaagctatcaagatcccttatagctatacactatccctcctaagagaaaaacgtaacgcagacggcaggcttttatgttcggtcgacgctacggtggacttattccctggccagaaaaggggagccgctgcacagaggtgtttatgtttagaaagataaaaaagaaacgagcatttttactttcagaacttctcatcgcttgcgtgcttatcagtttgctgctcggttctttagggtattggacacggaggatatggatatctcataaagagaaagagcacgtgtatagaatctttctcaatgagagcaagacgtatcgatttttaagaggtacctttttatccactattgccatggaagctcaggaagagttagttttttctttcgatcggggagtgtatgtcgatcctcacttagcaggtgttgtgcaagggacgttacactatgaccccatcactcaggaaatttctctaatagtagcgagtgaaagagaggaggcccgtcaggagaaaatttccttatggacgcatgttctttctatggaatggaaagttcttagatatcaaggtctaggagagggaccagatagagtgtacttaacactagtaaggaaggttggggccttgccaccaagaactctttcctatatttttgctgtgggtagatagagcctatgcattttattttcacactactatgtttaacctcgttggtgaccgtggtatctttggatgctgccggaactcgtaagagaatttcctatgcaaaacttcaagaaaaggaagaagtagctttttctgcgcaacaatctgctatttctgaagtgatcnanagagataaaacgaacgattgtcttcccaggcgaaaaaagcagagcctcgtacgcaagataaggagcgtgatagtgtcgttgttcggcagaagcgctatcgactgttagaaatccctttttctcggccgccaaataattctaggttcaatctttattctttgctgaaagagtctccggagaattatggagatccttcttcagcatatgctatttttgctaggttgctacaaggactgtatgtgcagtcagagctcattcctcaaggtgcggagtaccgggtaaaaaagccttgcctgcccaaaaagaagaaaataattccccaaccccaaaacctgggtccgaatggcctgaaaacggaagcccccccgaaaaagaaacccggtgggtggaaaaaaagccaaaaagcaacaagacaacgcgttctttattgcattttctcaactatgaagagaaaaataccaatcagggtaggttgaatttattgttcacagatcccgttattcttcaagcatttatcaataattctaaagcttattctgaattagaacgtgtacggcaagaggtttgggagagcgcgcgacagcaggagttggctattaaagcttatgggcaagctgctgcattagaaatttttaaaactagaacggatttccgcacagagttgcaagacaaaacgcaggtaattctccatcgatatgatcttctttctttactgaataagaaggtttttgattacacattagggactgctggggattatatttttgtggtagacccagaaaatgaaggggttaacagaagtcgttgcgtttcaagaagaaaaactaattaaatggttttttatgtttatatttaaattatcttttgataattgtttagtacgagattaatttgataaaaagaaaaaatcaggtatggcttatggcggacgagatgcaaaaagagagctcctcacaagaaccatcggcctctaagtttggttctctaaaacaaaaagtgcgtgatttgcacacaaatccaaaggtcggggggatgaagaggtttttatctcgacatgcttgcgaagccatcggtggtgctttgattgtttttgggattatagcgaactgcgtatcttgggtcggagggttatttgttgcctccgggatagtcttagggttttatcctgagatattagctgtgctacaaaatctgcagagctattacgctaaaaacgggcctattaaaaatgctttggtatgcggggttgcgctcttttggttaatcaaagctccttcgtttgttctgtcttttatcgtgctttgtattattgtaattttacttgctcaagggcagcataaagacacgacttctcgtcatgagtaaggccatatagcaacaaagactacacttacgtggtgtgaagaactccctcttttttggagggagttctttttttttgtatcacaaaactttaggaggatgagctccgaagagcatagtagggatttctttgaaccatgccagagtgaaataatcaatttgtttcacaatgaaccaccaagccagtgttaggaataacaatcccataaaggctttcagtgcagaaagtaggtagatgacttgtacctgaggagccattcggttgatgatccctaggaataaatctgacataagcatagccaccgctgctggagcgctcaactgtatggtcataatcaagcacaattggcacatttttaatatcgcgatccacataggagctcgtagcgacatcatgctctcagggaaaacagcatgaagagggatgatctcaagcgattgtaaaagaacagaaaggataatgcgatgtcctcctgcaagccagaaaacgatagtcacaaaataatgataaaagatcccgtgaggagaagtttgttctatagatacgagagaggtagcaccttctaatccttgtatcccttgctggttggtaataaaggatcctgcagactgggcagcatagaagggaaaagagaacagaaagccgatgagtacgccaatcaaaatctccttaataagaaggatatagaaaatatctaggtcttggtagtggacgatcgtagagtcttgtatcacctgaggtagcagcaatcccatccaagagagcgctatcccaattttaattggtgacgggaatagtttagctcctaagaacgggatgatcgacagcatagataatatgcgtgccgctagcaaaagaaagacagtccaaacgtaatcggctggcttttggaatatataatcgatataggaagagccgagccctgaaagaacctcgggaagcgtagccatggcaatctacttccatttgtaaaaattttggaaaatctgcgcagcaaaccgtaaaatcatgctacacagccagcctccagtaatcattaacgttccgaaaatgacaacgagcttaatagcaaaagcgaaagtttgctcctgaatttgtgttgctgcttggaaaatagccaccataatcccaacgacagaagccaaaataataggaggagctgaaatgatcagaattaataagagggcttcatatgaatattcaaacaaaatcgatttgaaacttgttgcaagcatcagcataggaaagtctcttatttaaagctaatcatcaacccttctagtagcaaggtccatccgtctaccatcactacaaggagcagtttaagagggagagagatggatagaggggaaagcatcatcatttgcatagcaactaggacgtttgccgtgaccaaatcgatgacaaagaaagggaggtaaatcaagactccgatctcaaaagcatttttaatctgtcccatgatgaaagcaggaatgatgatcatgaagtcagaaggcgttaattgttggcgcagttctggagggaaagtcttttgtgaaattttgtaaaagctttggatctgaggtttaggtgtatttttaataaggaaggatcgcagaggttctttcgatttgttcaaagcaacaaatactgtttcagctccttctgcagaaaaaagatctcgagggacagcactcgactcgataccttttttagcatcgtgatacatagccactcctgtagggaacataacgtagatcgatagaatgagagcaatcccattgaggacttggctaggaggtgtttgttgtactcccaaagcatttctaagaagaactagtgtaataatgatttttaaataggaggtcaggagcataaccaggaaaggagataacgcaagaaatagaaggataacggcttgcgtagtcaaatctggatacgtttctgaaaaggctccggaggaaagatcttcttgaggaggtagcaggtgttgagcttctaccgttggtcgataagatggacaacgaaaaggcttttcagttttttctggagatgctggaagttcttgctgaggagcggtcgcgcacggaaggcaagaagaggcgccttgtgctgcggaacaagtactggcgaagctatagggagcgctaagaatgcagagaaagaagaaaattcgaacaatcaatcgcataaaatccaatacctagtctttcttgctttgaggctgatctgttgtagaagcgtccgcaggttttttatgttttaggatggcagagaaagcttgttccagggcagcgagttgcacatcaagctgagcatttacaattccggtctctgtttcaatgatacaacctccaggggatacactggctttgggagagagtaaaagcacatctgcatattccacgagtttttttaactcaggacgatgttgttcgacaatagcgagatcctgaggattgatgtggatgacaatccgtttattctgcgtgaggtcttttaaagactctgaaatgatagaaaccacagtttctggtttagtttctaattccttgccgatgatctttttgacgctagcaatcgctaaaggcacgagggaggctttaatctgttctcgcatcgcttgtgtttctgtaataagaaaggcgagctgtttgctccaagctttgcttccttcctggaagccttgattcttagcctcttcccttagctttgcgcattcttcatgagtattctgtgtataagcttcacaatcttcttgtgttttctccagaagttcttgggcagttaacaccgcagtataggcgtctggggagagaacttttttattagggacgacctcttggtctttatatattaaactgaaaaatttcatccttctgacgaggtagggatcctttggcaaagccaacaggcagggaacctcgctcctttgctcgttactttattcccaacgcgatgaggcatgtcatttactagggatagccagacaaggatcgcattcttttttacacagagatcgaggttttcctgaccctcgatcgctctcgtttttaacatagccatcggagaaaaaatctacaatgctatttggtgcttcttttttttgtatatatgggagtgtaatagcagtgagaagatctctctgatttattgcacaagaatactgatacagtgttctaagcgctctcgaaaatactcattatggggactatctatcgaactctgcaatgctttttcgaaaatatagcctcttccgacatcaagtctgcgaataaaataccaaaggaaagagctatcttcttttgctagagcgcgagctaagaagcgcaaaccttgaacatggatgaaatgacgtaaagcttgatcttcctcccaagaggctaaaaaggccgtaggttccagatgtttcataggatgtgttttacaataatttagaaacatccgttccgtttcggatagcacacgctgcacgcgatcaatgactacacgatcgactacgtttcgcatttcttgagctaaggtataaagccctagacaattgatcaaggccattttggtagggcctacatagtacagcatagcattgaaaggagaagcggggagaaaaatctcttctgtaatgcctggaggacgtactttcttactgagtaagtcaagtaggtagaaagctccaaagtctaagcagcgttttgtagcaggggtaactccagaatctaaaagagggagtagttcttgcgttagagggagaggtaaccaagctaataattgcgattgcacaacgggagggaattctttcatagcaacactaatccaggaaggatgaatggttgctaaccaacgcatattgaaagataaggactgcagaggaatatcctgatgatgcggagaatctagtagaagatgttccggcagaaactgagctaaatcatcagcttttgcctgcttcatcaggatattaagaatcccaaaggtattcgctgtcacttaagcgtcctcgttattctcttcttgtttttctgcattttctttagggggttgttccgaagcggtttgcgcttctgcaccttctgctgctccaggagtttcttttggagctggcttattctgagtgaaagagagctgtgagtaaggggcaggatcaaagaatccttttgttccacccagagcagaaatcagtgtgtgtgttttccaaatgacccagagtagcccacaggaaagaatgaagagaaggagaattaagaaatagaaaacaaggcggaatttagtaagggaatgcttagctagaatgatcccccatacagaaacataatccatttcatcggagagtccccaagggccattaatagtaatgtcactataagaagctcggtcactgactacggaaacgttctcgggatatagtcctgggacagcactcgcaactaaacgtttaatcttagacaccataatactgttagggttgtctaatacccctctgtgtttgatatatacagaggccgttagcggccgttgatcttcttcaggagaaaaggaaatctgtacgctcgcatcgacgataccgtccatctttctaatggtcgtagccatttgttctgaaagaccttcttggtagcggattttttcttgcatttcagaagggaccagcccttgtttagagaatagatcaagaaggctggttcctttcattcttggaagcccagcttggttcagaatagctagagcctctgtaatttgtgcggcaggaaccgaaatatcccagagttgttctccagatcctcctgttgaggacgctgcttggggaactttctgtgcagcgacccctttactgactagaagcactacgatttcattagcatcacgtcctgacaagccgtgtgtaatcatggaacgactatcacaagccgagcagaagaaaagagccaaaataaaaaataaggatcgagaaagagtataacgaaacataactcacgcacaccttttcactcaccatagcaaatggggagattagtgccaatcgggaacattttttctgcagagaatgcttcaaaatgaacaggttatgtggctaatctttgttcggaagtagcgaagaggttgaggtttcccctggcgcatggcttcaaaaacagaatccgcattaaagctagaacgaacgaatgggccagcataaataaagagtcctaacgactctcctaccgagcgataataatcgaaagtctcgggagacacatagcttttcacaggaatatgtctgcgtgaaggacgaagatactggcctatagttacgatcttaacgccatgatcagcaagatcttttaaggtttgcttgacctcgctttcttgctctcctaatcctaccatgatacctgatttagtcatcaggttagggaggtatttggctgcattctccaacatcataagcgatcttcggtaggtagctttatgacggacaaatggagtgagtcgttctactgtttctacattatgattatagatagcaatgtgcgtatccagtaagtgatgtaaggcagcaatgttaccttcaaaatcagaggctaggacttcaatagttgctgttggtaattctgtgtgcaacgtttcaataatgtggacaagagcgctggctcctccatcctctaaatcatcacgggaaaccatagtgatgacaatgtgcttgagtcccaaagcttttgcggactcagcaattttagctccttcttcaggatctgggggtaagggatttctagtgaagtcaatatcacaaaagccgcagcgacgtgtacaggcatcacctaaggctagataggtagctgtatgtctagaccaacaatgggtgcgattcggacaagaggcttcctcacagactgtaggaagccctttatttttgatagtattatcagtttgagcaaatacccgccctaaagggagtttctggcgtagccacttagggaatctggcgggtatagattttttaggagtaggagattctgagtcggtcattttttagcagggggcatatgtaatggggtatcaacagctaacaacgcactttcagcccaaacttctgctaaggttggatgtgcgtggatagtttcgtaaatacaaggaagagtcagttcattacgaactgctagggtaatttcggaaatcagtgatgaggcatgaggaccaatcacataagctcctaggatctgctgagtagtctcatggctgataatggctgcaaatccatcggcctcgcccattgcgaccgcttttccaatagctcgaaatgggaattttgttactttgacggggattttttgttgttgagctgctgttggggagaggcctactgaagcgacttcagggaaggtaaagatcacagaagggacagcagagtaatcgatttcctctttatggccacctatattccgtgctgcaatgattccttgatgagaagctacatgggcaagttgccattttcctgtgatatctccaatagcataaatgttaggtacgtttgtgcgcattgtggcatcggtagggatgactccgcgttcatcacaaataacaccagctttatccaagccaatattttctgtattcaaacggcgtcctatagatacgagaacgtaatcgtattcttcgacattcccattgatagttaaccgaacgcgatctcctatatcctcaatatttgatacagaggcttctagtacgaaacggagtccttgtcgggtgaatttatcgaacatggtttttgaaatatctggattattcaaagcaaggatttgagagcttgcttcgatcacagaaacttcggagcctaacgtatggaataaggaagcgaattcgcaaccgatcacaccttccgccaataatggccattttttgagggatttctttgaggtttagcacgcctgttgagcataaaatccgaggagattctgcggaaaaaggaatcccggggaaagctcgtggttcagagccggtggctaggataatggagtgcgctttgattacagaagggttttctcctaagatttttacttctgttgaagagatcaaagagcctnttccagagaagacagtgatcttattgctgcgaatgagaccattaagtccatcgcggatgctacggactacggaatccttcctttgtaccatagcgggatagttgatgctgaatccttctacatgaatcccaaactggtcagcatggcgtatttgggtaacgacttcagctcctgctaagagggctttagaaggaatacaccctcggtttaaacaggttccgccagcctctcgcttttcgattagcgcagttttgagtcctgcttgagcggcagtgattgctgcaacatagccccctggccccgctccgataactacacagtcgaaagcttcattcataacatttcctcttcaatgagtgtttaggattgcaacgatccatatgagatgattatctgaaggaagaggattctccttccaagcctttctaggaaaggaaaagagaggtccttcagacaaatacatttcccggattgtacatctgggtggataaaatctcaatgaggagaagtggtagcaggagagaaaaaataggaacgtaagagtgttatttcgaatgctcagggagagagcggtacccacgataagcaagcagaatcccgactagtgcatagatgtatgagcgattctttggccaggagagaacgagtccagagtctgtcgaaaacaagagaatcatgagcgaaaaggtaaggaaaccgcaacccaagaagagagctgcagtcggccaatattgtagccagtcccactgggagggggcaggctcttgaacaggctcctcaaacgtattttggctattgagtacagcttcccaatcttcggaagagacagcaaaaagatcgctgtctccattttttttagaagcttcagaagggaacgtaatgtggcaagaagagaaccccttagatgtcacgggaggatcttgcaggaaagcgctgcaatagggacattgaggcatgcaggccgatacgcttccttcgcatttccaacacgtacgctgtagatctgcttcttttgcgaatggcatgagatcacntctttaacagtctttgggcctttttatggcttccatactgccatctgtatgtcttctcgcaacatccccttgtttgcaagacgataccccctcccgaattatagttcctaggaggaaaaaatcaaggtaatacgtaaaaagaagaataaaaggtcaatcatttctttttttacgaatcacccgagtcttcttgcacctcttcagatagcatatgttcgtctttgtaagagaggatggtaattaagtcttcgcgattcaaaacatgcaagatgttggaatcttgggttgtagttacctggttcagtaagcgcatttttttctctattaagtagtgaatgtgctcttcgagggtatcttccgttactagtttgtaaatgaaaacggtatttttttgcccgattctgtgtacacgatccaaagcttgattttctttagccgggttccaccagcggtcatacatgatcactacatttccagccgttaggttaatccctgttcctgcagcaagtaaggaacctataaagacacgacaattgggatcatttgagaaacggtctatttcttcttttctattttgggatttcccttgtactagagcatattcgatagcatgctcttccagatacaaagcaataatgcggatcatttggatgtactgagagaagacaacgactttgtatcctgaagccagagagtcgttgagtaatttcacaaaagcagcccatttcccagaggaatggtttttgtatgattcaggatctttgaaatacactgcagggtgatcgcagatctgtttcagttggttaagcaaggcaaatacatgcaagtagttaacagaagccggatcctcctctttttcgagttgttggatttggcatttttctttttccaaagtcgaagaatacagttgagattgttctggtgagagtcgacaaggaatcagcgattctactttttcaggcagctctggtagaacgagtttttttgttcttcttagaataaatggccgagtaagcttaagtagtaagtctttagaagaaataatatcttcatctgtttcggatgcatttttatgtgtgaacaatcgtttgaagagggcatccgaagggagataatttggtaaaataatatccaaaagtcctttgaattctatcaagttattctctacaggcgttcctgtgaggcctagcttcatttgcgcatctaaacgacaaagaattttatggatttggctcgatttatttttagctgtatgaatttcatcaaataccgcaactgtaaacgataccttataaaataaagcgtagttttgtcttaaagtcccgtacgaagtgatgagtatatcgcaatcagggagagttttaggtttgtgaggaccatggaaggaaaaaagagaagcttgaggtaagtgcgaagctaatacatgttcccaatgcggcaacacacttgttggacaaacaaccaaaaatttaggattttttgcagtttgcgccacaatatctagtaaagctgtggcttggtgtgttttccctaatcccatttcatcgcacagcagtccagataaccgatggttatacaaaaaccacagccataataagccgctattttgatagggacggagtttgtgatccgtggaaaataagtttacaggaataggaggcagacatgcggatttcaactgggagaaatacgccaaatcttcttccgaagcttgaatattagggtctgttatcataggtgccagagcatctaatttgaagatgtctgtcaccatggtgatgagggtattttcttgaatatcatagcgttgagacgataagaattgtttcaggaaaacaaataaacagttatcgagattcaaaaatcctgctttgctgaataagaagtcttttttccctttcaaagcttgtaatactgtccctaaaggaatagatccaatattggttttaatttctatttttagatgaagaggtgaagacggatggggtctgtgaatagccaggatattcagctcaacacgctctggaagagctaattgaggatcagggaacaccatgcgatcatcttttgaaaattgtaataaaaattcagcgacttgatcggcaggaatctctgtaggaatttgacagagcatttgtaaggctgcagggagcaaactaaagcctacattttcgcgatataaaaattgaccaaacaagcgacaagattcgtgttccaatccttcaaagataggctgtaaatagattccagatccttttttctctttatgcacttcaaagcgaatggatttgagaggtggttgtgcagcaaagaagttggggatagatttaagagctacttcatgtgtaagaataaaatccgcgacttgtggagcttctatcgtcaatccatcttgaagagctaagtctaatcggctgtttaaaaagaatccttgtcgagaataatacgtccatttaccaaaacggagttctatatccgcagcgttcccagtatcataatggaatagaagaactccttgttcagtaacgttataagacagagagcctaccggggattggttagaaaacgtttcgaatccaggttctttgataaaaggcccatactcatccaagaaattttcgatatggtcggagcgtatggtgaacgaagattctggggataataatccagatacagctaatagacccttattaggaatgtagcagaattctggatagataatatgcccctcggacagatctcctggtgtttctagatatgcggaaaatgagagagaggcgtctcttaagaagtgaatagcatagtgaatagggcgttcttcagtttcataacagagttgggagagtaaatgttctctaaaagaacggtctagagcggggataatatgtatggggagggagagtgttttaggaatagaggtgcatttttttgcttcggcgaaatacttaatagggcccagaaccgtctcttgatattctttaatggacttagggagaggcggatattcttttgtaaaatagatcctagcttgttcagggaccacgtggacgttatgaagaagataaggctctccactatataaagaggtttgtgagaattccagtaatgggaacaatgcttttagggtatcaacatctaggacttcaatagatagagctattccttcccactgcaaggagaataaagaagggaatccttgagggttttcttggataactaaagaggctcctttttgagagaacatgaatagttctcgtgcgattcggtataatgcggattgggagaatgtttctttagatattgtttgaggttctggagaggtgtgcacaataggcagccaataagttaaggcttctgcagaaaggcattggagagagactgaaagttgttgggattgtatggtatagactttgtctcccggggcgtgtagaggagccttacttaggaataattgataaaataacccccaccaaaaagaggattcaaatttcacatgaagaagcgctccttctgttgggtcgtaagctgctaaggtagcggtaaggaggtgctcgcagcagtctccatctgggcagctacaagctgcaaacgacaaacgctcctcatcgttgaatgatagagtgctgatccattctccatccggagagtcttcatcaggaatcgtgattttgtaagtgtttttagaaaaagaaacggctatggagtctcgattatcttgtaagaaacgggtagcctgatgacgaaacatggataaggaatttagaatcataagaatcaatctctgttacgttccccatgcttgcgcatgacctaggcagaaaggaacgagtgtttaggagtagataggtgtcttctaaaggcgttttttgggttgctttccggacaaaagaacatcccttacttattcagtaagggatggcttcaaacattgcgactaagtctattaaacggacagcttatagagtatcgtaagtgcaaaaacaagataaaataaagttttcacatggcggaaatcccaaagcttcttcgcaataacaccgcaagttaatgctatgagtgcaggatagctcatttccaaaatggggatgagaatcttgctaatattctcaaaactaagaatcgatactaggtatgtaggaaccaaagtaacgattaaagcattggagtaactcattttttgagaagaaacgactctcgcgataaaatccgcgaaaatccctgttactgcaattgcagtggttaggcaagcaagaaagacgctcagccctgttaaaaagctattggggccaactacaagagccgaaattcttcctagaatttgccctctttgaacatctatcagagctcccgcatgacgggcagcacagaaggcaaagcctagatatacaaggctaagtagcgcggctgctaaaagaaaactcatagcaagtttgtatttctcagtcttcccaatatggtgaaactctaaaggtttttcttcagaagactcatgcttctgctgcaccataagttgctgaattgatacaaggactatggagcagaagaagaaggctcctaataaatccatagtgttaaaaccttccgaaagtcctgtaacaaaggcttgttgcttcgaaaaggttacgctttctgagggaagtgcatgagcaggcagtaggagtcctttgataatcagccaggctaaagttcctaacatgacagggaaaaaaacggaccccagccattgaatcagcttgctgagcttgcaaacgaagaggtaaacaagtacgcaaaagaagacactaaaccaaggtagggaaggaagtaatgtaggatgtttgtctcccaacgaggctagcgtatcgtaagacacagcaatagttctaggaattcccccgaaagggccaataatgcatagaattgcaaccatcaacaccataccaggcattcttccaatagaagcaaagaatgaacggtaatttccagagtacagcatcatcgcaaacagacctaataaaggcgtaagtacggctgtcagaatcatacccaaacaagcgtaagaaatatgataatagaagtggtgtcctaaggctaaagggaataccacattgcctgctccaaagaacatagcaaagatcgatcctccaatagaccaaatggaaagtcctttatgagaatgtgattgtgttttcttatgcatgataaaaaatgataatttttacttatacgagggtatatcatccttcccaagtcacagaagttctttggaaagaataaaggatgaattagaagaaacgtccgttagccctcgtcctatagtacctgcactgatggtttaagatcaagattctagagcgagcgagatcggataaaatgcgacgagaaaaaagcatccccttgtcgggaaactagcggaattttcacttctttcacgcatttccatccttgggaggccatccaagaggtatgtttttcattctcttctttcataagcgaacaggtgatgtataccaagcgtccgcgtggagcgacataagctaaggcttcttttaaaatcttttcttgagcaatcgaattgttatggaggagttgtttggagaagagaagctttttttctggatgtcggcggaagacgccacttccagtgcaaggagcgtcaaccacgactagagagaaactgtgttttttcagaggttgagatggaatagtaaaatttttaattcctgatcgcggggatcggtgacgagcctcctctaaggcttgcggacggctatcatgtaaggtcacgtggcgagcgcgttgtgcaaagatcaagcttttccctccagccccagcacagaaatctaaaacagtatcggaatctttaattagaatggcatttgtgatgatttgagaggattcatcttgaatttcaaagagccctctgcggaatgctcgtgtgtgttgcagaggatagcgtttttcaaaacgcaatgaagaaggagccgcgcctctttgacaagggaaaggcagaaccttttggagtttatctacagagattcgtcgagtatttacacgaatggagcaaggagcttcttctaaaaatattttggctagacggatagcttcttcctcgccgtaatccgttgttaagcactctgctagatcgtcgatatggagtagcgaacaggccaaggcaggtgttgaaattgctcaatattttcggtgactccctcttccaccttttcaactaatgtttgtgcagagatttctttcccctctgctaagaccaaagcttctaacaaacggcggtgacgtaagatggtaaaaatacgagtattgatccattgacggtccttcgagccaagagagggatgctctttaaagtacgcagctacacggttgctttctcctattggggaagagaataaactatcgagcaaaatgtagagatgatggaagcgaaaaggaatcataggtctcctggtttgggagcgagtatatcggtaagttcagaaacctgttgctcggataataggaaatgaattcttttttctatttatttgcgaaaggatttcttcataacggcgagaacctacttcttgattggcaaactgctcgaattgcatgagaataaggagaagattttgtaaatcattccatatttcgggacgtttgagagcatgacttacatgttttaagaaatggtagtagcgctcttttttattatgagaggtttctggaaggaaacgtttgaatagttgccgcaatgagagctttttcgtaacagatgggtgtgcggagatgggcgcagcagagaagagcccggttggggtaagactaaagagcaggcacaagtgaacaaaagattttatgaacataggagtccttttacgcaatctgaacaaaagctcttgagaaagaacgggacaggaaaaaagactttctctaacaaccggaaatcttagaaaaaagcagaaaaaaagtccgctaaagatttcttagatagagagttaagagaaaaaagggttagaaaaagtttttgtcgcacgaggttgctttttcctacgatagatccaaacaaagagtaggataagaacgtaagttctataagtggtaagtatacgaagactcattaaaagaattcgttgctttaaagtagggaggatatcgctctctgctaggaatgggatagaatgttgattctctccagtaggggtggataaaatccaatggcctagaagatctcctttccgaatggggaaagagatcttattgggttctagggaaagggttaagaggggatctccttcagaaggataaaagtcgtaataaatgccttgtgctaccggagctgtcacagtgccaaatcgagttggtacaggatagtgacttgcgggagggattaaaaagcatcgtaatagctgttcattaaatagatcttcgcacagagctatagcatcttggtatagttgagcagcagggccaaaatatcctgctgctacaacaataattgagcgattgttcttttctgcagcgaaaatgatatttttccctgcactttttgtagttcctgttttccctcctaaacaaggtggataaaagtaagtcgaagaggaagaaagaagtttgttcgtggaagacagaactctttctggacttaagttggtggcctccatggtataggacgctgtgtgaatgacttggcggaaaagaggctcttttaaagcttctttcatgatgagtgatagatctctagccgtcgtgtagtgatcaggatgatggagtccatgaggagaattaaaatgagtattttggcaaccgagttccctcaaaaactcattaagttggcgcatgaaagcagagacgctttggcagcaggcatctgctaaaacattggcagcatcatttgcagagctaataagtagagcgtgaaaaaggtcccatccagacacctcttccttcacttttagttgaatagtcataccatcagtttctagccaatggggagggcttcggtatccggattgttgtttagcctgaggagtgatagaagtcagtggctctctgcgagtagtgatgaaacgagttaacacatcaggatactgccttaaaatgagtaaagcggttgcaatcttggtcatgcttgcaggaaaaatcttgtgatccagatttttttctttcagaattgctccggaatctgcatgaacgactgcggctgcgattccttttgtaagaacagtatggggatctgcgtacaaaggaaacgagagaaaaaagggagccaagcagataaagaaccgacacaacaagaaaaaagtacgcatggaacctgctgatggtctgctttctaagaatttcgacttatgaatatcaaaaaagctcttgacggtgccttcaataacaaattacccttgagaaaggagaaacggcagtgagtttagattttttagaggattttttccgtcgctcaattaccaatcacaacacagcttttccagaaggctttctggatatatctgatgtcttagctcgttcggctttagattttaaggctgaggaacttgctgacagtgctgttaatgacttcatcgtatcagaatcttcagataaactcactttatttaacacaaattttgctgtgtggttggtacctacattagttgatggtgaggcaattactcgcggctacatcgctttaaaccagggtgaagagttctctcctgaattaacttttgaagcatcaggaaagtataataattcgagtttaatcttagaggcgttgcgaagatatttgtgtgatatccaggatacagaaaaagaattacgggccttacgcccgccttcaatagatggatagattagactatgagttgtgaggttttgtgtatagagtgagagtgacaacatttgtgtcgttaactctctcataatcaaaaacatccaccgagtattttgctagaaatatccctagtccaccaattcttctttgctcaataggtagatccaggcgcatgatgtctggcgaagcggttatgggattaaaggctgggccatgatctgtgatccgaactaaaagagcatctggagtttctgtgcaaagaatacggatccatcctgtggaaggaagccctttataggcatgggtgataatatttaagagaagttcttcacaagcaagctctagcttcgatagttttttctgagtacagttacagtggacgcctgctcgtttgacaaaatcgagcataggataaagatcttgtaatgttgctgggaaaacttgctctccttcagaaaaggtcatagtatacctgttgtacaatagtctctgctaattgcgaatacaatatacgagaagcgctttttattgcttcattatgcatttcaaattgtccgagagctagctgatgagcattcgcggttccgaggtcaggttgaaaatcaaaagtaaccgattttctcagacatttctccactaatatttcttgtgtgcggtttttgattagttggacttttgctgataacgctaagcgcccttcattagagacaatgaagtgttttacaggtttttcatcaggtttttggggagtgtatgcgaatccaatattttcataagtctcattgaaaagagagactttgagtacataaccagaagaggttccttgagatcgtgtgtggagtcctcgcttttctaattcgtaagaaagagaggatacgagatctcctaatgaatctccttcgatagggcagacatagatgccttcggaaagcgagaatttcttttctacatagtggggggagagcactgtatagccgcaggctgattaagtagtaacgagaagaaaacgaggctatttcaaccaaaacattttcagcatgcaagaagtttccctttggttcgcttaactcatttgtttagagagccgttctaatcgtttattgcatttagcgacataggaggtatcagggaagttttctagagctattgagtaataaatttttgcagaagaggcttttcgctttttctcataaaagcgtccggttgaatataagcaagaagcgtaanttcgcacatgtgatgaatatagttctctacttctgtattgctaggatgattagggtgttgtttacgtaaagctgctgcttcatccgagcatcttgaagatactgttcattatagggctcttgcaaagcttgtaagcaatggatttttgcaataagggtaaaagactctggagaaagagagtgtgaaggaaactgaagagaaactttttttagagttttgatcgcttccgaatattcttttcggtcgaacaaaagagcaccttttgcgtagagagcagaagctttgaggtctgcgtcggaagatgctgtcacaatttcttcaaaaatacgcagagcatctgtatctgctttcaacaacttaggaaacccttccaaaggaacgatatttttacgctttccgttagcgaaactttgtgcgatagaatacttaatggcgaataattgttcagaatattctgtatcggcgagctcttgatattgagttagcgctttatccgctaagtcaggatggcccatttcaagatagcagagccctacaagaaactgtgctttaggatgaagagcatgttctgggaaatgatgtgttatcattccaaaacaaagaagagcttgcttaaattttttagcctgaaagtatttatctcccatctcgaaatagagttctggggaatgtttaggaatgtaccggtttggggcgatagcgcctcggaaaggttcaaaagagggcactcgcgcataacatccgcagggcaacacaagaaacaagcaaagcgctcttaaaatgactttcatagctagacgcagggacaataataacaaagcgtcatcataaaaaagaaaaagagaatttgtcaaatctcttatagcttttgtttagcaaaaacaaaaaaatttatttggcatcgctgtttttatttattaaaataaataaaaaggttgggttatgaagaaagttgtttttattgcggctatttttagttctattgtgttttgggataagatcccttattcacatagaatcaaacaatttgctatggattacggaatcgaactcgttgaaaaaagttctcaattagttcgtaagatttcaggtaatgagcgcttatgcgtatttgaaagacgtgtatcggaagaacaggtcttagccatgtttgccaaagacaaagcgtctgcagaattgttatttgttcctcatgtccttatgcgtgtacgtttttcgggggaagaagataaacgtgctggaagtcacgaaggagctatgctttggagtttgtctaatggagagatggtgttgaatactggatcttggacatactctaaaggatttagagaatgcctcatgttaaaagcagggaaacaagatgtgcagcttatgcaggttttagctggtatgggaggatctgcatcgagagaagttctttcacaagcattgtctatgcgtaatgttcgtgccgatcgtgtgattcgtgcatgtcagaagaagaaattaatatttactcatgataatttgatttacagtcatttccagcagcctcagccaattaagggatgcatgactgtattcaattcatctcctgtttggttagcaaaaccgaaaggatctacggtatgttccgtggtatatccagaggatcgtattcaaaatcttgtggaaatgatttttggcgataatttctttattttgagttctgaacagattcacgttccggtatataaggtttctattgcagcttcggatagtagtgttcgtgttgagtatattaatgctattacagggaaacctttcgatttcgctcctacatactgcaaatagcacagacctctttttttctttttccttccgcgcatagcttttttcatagatctctcttgaaatgaaggtggagtagctccgccttcgtttgctagagagcctcaaaattttttagtcgggtataggatttaggagaccattgtctggatcgccacgacaaagtgcggtaaaggcaagagacttatgtagagatcttaccaaagaggggagcatctcacttttaaatagttatactgtagtggctagaacgcgagcagggatattggttgcttcaatttcttgaagaagagaagagatatcatctgttacgaaaaaatctgcatctggagagatagaggcgaaccgctgattatcttttgtgaatacaagagagagtgcttgagatccagaatatttgcgtatcagccctttgagaataaataagtggctatggcgtaatttatttaaatctaaagagatggttacgggagagatctctctagtttctactttctttatcattgctgaggactgggctccggttgattttttcgttgaagagtatactttctgacttttcagtcgatcatagacttcgtcgcattccgcaattactgaatcattaacggtagataagtctcgcatccaccgacaagatagacgcaaggaatcactacgtcgatctatagccaaaatggcataaataagacgatcttcttccaatagatcatggtattcggcgtacatatcggcccagattggaagttcatatgaatcgacttcatcgctgacttgtaaaagtgcaaattttttctgctctgcagaggaaattttagtagtgactttatcgattagaaagactgtacgaataatggttccatgagggagtccttcaaaatctcgagctgggactacagataagaaagggagcatgtgttcaacagcatccataggatgggcagtcaaatatacnccaagtaattctttttctcttttcaacaactccttaggagagcgttggataacattttcagganagacagtaattttaacaggatctctanccatgctatctagtgaaaaaaaggttaggactcctgtagcagcttcttttttttctctaaaaaacgtgtcgtaaaggtcattaaggatagccagcgcaagatctttattaggttcgaagcagtcaaaggttcctgcatccaccaaattttcaagctgtttcttagtgacttttttaaaatctgcgcgttgaacgaaatcctgcagacttttataggggccgtttttttctctctcttcaacaatactatccacaatgctcattccaacgcctttgacagctcctagagaaaagcgaatcccttcctgagtggcttcaaaatcttgtccagactcattaatatcaggaggcagaacgagaatgttcatgctgtgagcttcttgaattagcttcccgactttctcaatatcgtcataatcgcaagtgagaagggcggcaagccattctttggggtagttggctttaagatatgctgttgtgtaggttataagaccgtaagctgcggcatgggacttattaaatccataggaagcaaacttttccatcttatcgaagatagtcgttgctatggaagggtcgatgccattcgctgcggctcttgaacaaaatttctctcgttccttgaccatctgttcatggtcttttttccccatagcgcggcgtaaaacatccccttctcccaaagagtattttgctaatgaaccggcaatctgcatgacttgttcttggtaaaccataattccaaaagtttcttttagaataggttccatgagaggatggtcgtnttcaatattctctttaccatgcttcctattgataaatgatgggatcatatccatagggccagggcgatagagggctccgatcgctataatttcttcaaacgcatctgggcgtaagtttttagcaaggtcttgcatgccacgagattccatttggaagatccccatggttttaccttgatgaagaagagagaaagtattctggtcatctagaggaatcgtggcagcccggagtagaatgcctgtttttttatagatcgcctgtgtggcgatgtgaatgccggttagggtttttagacccaaaaaatccactttaagcatgccaacgctttctactggcttcattgagtactgagtagaaatcatggatgagtctttagggacacaaatcgggatatggttagtgagaggatctccacagataatcactcccgcagcatgcactccagtattgcggatagatccctctagttttttagccatatcaataacttctgcagcttcagcgtcatctacatatagttgctttaattctggatcagcctctaatgccgaagtaatggtagcattaagatcaggaatatgtttcgcgatgaagttcactttagctaagggggtatctaaagttctacccacatccttaatanccattttggctttcatggtgccaaatgtaataatttgggctacattatctttaccatgacgttctatagcatagttaataacgcgctctctgccaatcatacagatatcgatatcgatatcgggatacgatatccgttccgggttgatgaaacgttcgaagaaaaggtcgaagcgaatcggttctatttcagtaatccccagaaggaaaagcatgacagagcccgctccagagcctcgaccggggccaacaggaatcccatgatcttttgcccagttaataatatcccagacaatgagcaagtaatcgcacatccctttggagataataatagaggattccaatttgagacgttctttaaccagcgtaagagggtcttccccagggaatttctttgcaatgtgtcctagaagctcgggtgtgtatttgctggttaatccttgctcgcaaagttcttctaagaaggctgaggatgctttgtagcgctcctcttctgtgtaggatccttttttttgtaaagcttctgggacgtagataggatagtgtttggtttcaaaatcaagctctaggtggcagcgctcggcaacgatacacgtattggtaatagtctctggatgtgctgcaaatagctctgccatctcttgaggggatttaaaataaaattccctactaggataggttttgcgtttaggattgggaatgtaagtattttgtttagctgtccgaataggctctctagactgaacattgagtaaaacttcatgagcgagccaatcgtccggattcaaatagtgaatatcatttgtagcaactgaaggaataccaaggcgtttagaagtagctaaaacagcttcatttactttgagttgtttctcaatgaattgatagtagttttgttttaaccaagcttcttcaaatagagcaactttttcttctgaggatttgtggagttgtacttcactgaaaaagtcttcttgaaacagatcttgataccataaaagatctttttctaaatcttcttcagattccaatgcagcttgagcaaccgatccggataaacaggctgataagcagataagtcctttggagtgttggctcaaaagatctctatctatgcgaggcacatagtaaaaaccttctgtgtaagcaagagaggagagcaaacaaaggttgcgatacccttcttcatctttacaaagaaggatgagatggttggcaactcggctttttcgttctttttttttatcgaaacgagaagagggtgcgacgtatagctcacacccgatgataggtttaatcgcgttttgtttacaggtcttataaaattcgaccgcgccaaacaaattcccgtgatcggtaagagcgagcgcgggaatttgatattccactgctttggcaacaaacttcttgattgagcatgttgcatccaagatggaatactgagagtggcaatgtaatggaatccaggtcaaaacagctcttcacttagtgactatgttttctcaaactctgttcggatgcattccatgttggcaagaaaaggatcagcgcaatcaaagcacaagctaagagcgcaacaaagaatccgtgccagccccaatcctgagccaccttccctaaaggatatccggcgaaagctgctccgaagtaggcgaaccatcctgtaaagccgctagccgttccagctgcttttttatgagacaattctgcagctgccaatccaatcatcatttgtggtccaaaaaggaaaaaaccaatgataaataggaatgttccatctatccaccaaacgaagtaatcacgagtaccccataatcccaagatggaaactaataatcctagcgagaagactacgttcattggtccacgttttcctttggaaatcgtgtcggatagccagcccgctaatagcataccaaataatccgccaatttcaaacaaagatacgcagagatttgcttttactgtggaataatcttttgtttcgattagatagagagcgctccaatcatttactgccatgcgaaccacataaataaagaaggaggcaaaagacagaaaccatagccatttattagatagtacgtaagtaaacaagatttcttttgtagagagctctctttctgcctcttcctctaagatatctgcagttgtttcttcatgtggatgcgcatcctcttcttttctaaatttttctatagcggggagcccgagtgattgcggagtgtctcgcaaacgatcgattaagataaatcccatgataatacaaataatccctgggataaacataacgccgcgccaccccgtgtagtcaatagcaactccggtaagaacagggatcaacgctccccctatattatgagaagtgctccaaacgctccaccaggttcctctctctgatttggaataccagtgagttaacaatcgtgcgcatggaggccacccccatccttggaaccaaccgttaattccccagaacaatacaaacagagggattgtagaagagagaccaaagaagatgttagagataccagtaataatcaatccaatagccatgaaatagcgaggattggactggtcagacatgacaccgcttacaaatttactaatgccgtaagtgatatagagagtactaccgataatccctagctgagctttatcaaacccgagatcagcgatcaaggttggcatggcaaaagnanagcttttccttgtaaagtagaagaacaantaccctaagaacatgctgtagaagatacgcactctccagtacttgtactgctttttaaccaactccgggccactgatttctttaatgtggcaaggaggctgaaaaattttggtccatagattcataggtgttagctcgattcaagtgtgtttgctctagaagcttaagaaaaatacaaatgcatactgagacgaaagtatcagcttctaagacctcgttttttgctatcagtctaggctagaccagcccgggcatcatattggacaattgtagtaatgtcgtcaacacttctttcatttagcttaatagcttttagaagacaatacatttgctgtgtaaagagagggagtaggggtgaggatgcggcatattgtggatggataagcggagagtaaggtgtgtcaaataaaagaaataatagagagaaaaggagcaggttttcgagtagtcctgaaaactcttttggtgtaacatagtggtctcgttctttgcgcaaaaaaagaactttaaaaaggtgagatcacgaaacatttttcgtgagaatagtccggttatacacaatgagtaatgcattgccaaaaggcgtttttgatatttttccctatgtaacaagcccaaaaaatctttggagaaattttctctatggaaacgtgttgagcatgcagcccatcgtatttgtaatttatatggatttgatgagatccgaactccagtttttgaaaagacagagacttttttacgcgtcggagaacacagtgatattgtaaaaaaggaagtttataccttnttagataaaaaaggacgttctttgactttgcgtccagaagggactgcagcagttgttcgtgcattgttggatcattctgctgatatgcgcaaagataataagttttattatattttgcccatgtttcgttacgagcggcnacaatctggacgttaccgtcagcatcatcagttcggtctagaagctatcggtgtgcggcaccccttacgagatgcggaggtgctctctctgttatgggatttttatgcagcggtcgggcttcagcatatgcaaatccatgtgaattttttaggagggcaaaagactcgggctcgttatgacgaagctttgcgggagttcttccgtaaagatctagaccggttatcgcctctgagtcaagaaagatatcatgcgaacttattgcgtatattagattctaaggagccagaagaccaggaattcattgaaaaagctccctcaattttggattacatagatgatcgggatttaagctattttgatgcagtattagcccaattaaaggctttagggattccttttgcaatcaatccaaggctagttcgagggttggattattatacggatcttgtatttgaagcggtgactgttgtgggagagcgctcctatgcattgggaggcggcgggcgttatgatgaattggttgcgcagtctggaggcccttctatgccagcttttggttttggagtgggattggaaagagtaatccaaacgctattagagcaaggaaactctttatcgacctctacgcgacggttgcgattaattcctatggatgagcaggcagatgcattttgtttttcatgggcaaatcgtttacgtaacctaggcattgcaacagaagtagattggagccataagaagcctaaattgtctcttaaagatgctgccgatcaacaagtcagttttgtttgtctcttaggcgaacaagaattagcaacgaaacaatttatagttaaagatatgtctttgcatcaaagcttctcaggggctcaacaagatgtagaacaaaggttggtttatgaagtacagaacgcataaatgtaatgagttgtcccttgatcatgtgggggaacatgttcgtttgtctgggtgggtgcatcgttaccgtaaccatgggggagttgttttcattgatttgcgagatcgctttgggattactcagatagtgtgtcggcaagaggaaaacccagaacttcatcagcttatggatcaagtccgttcagagtgggtgctttgtgtggaaggacttgtttgtgctcggttagaggggatggagaacccgaatttggttacaggttctattgaggtagaggtttcttccttggaagtgttgtctcgggcacagaatcttcctttttccatttctgatgaacacattaatgtaaacgaagaactgcggttaacttatcgctatttagatatgcgccgtggcgatattttggacagattaatgtgccgacataaagttatgttagcttgcagacagtatttggatgaacaaggttttacagaggtagttacgcctatcttaggaaaatctactccggaaggagcaagagactacttagtcccttcccgtatctatccagggaatttttatgctcttccacagtctccacagttgtttaaacaaattttgatggttggaggtttggatcggtatttccaaatagcgacctgtttccgtgatgaagatttgcgtgcggaccgtcaacctgagtttacacagatcgatatggaaatgagctttggtgggccagaggatctctttccagtggtagaagagcttgttacacgtttatttgctgtgaaagggattgaattaaaggcacctttcctgagaatgacgtatcaagaagctaaagactcctatggaacggacaaaccagatttacgtttcgccttgcgcctcaaaaattgttgtgaatatgcacgcaaattcacattctcgattttcttagatcaattagctcacggtgggacagttaaaggattttgtgttccgggcggagcagatatgtctagaaagcagttagatatctatacagatttcgttaagcgctatggatctatggggttagtatggattaaaaaacaagacgggggtgtatcgtctaatgttgccaaattcgcttcggaagacgtattccaagaaatgtttgaagcttttgaggcaaaagaccaagatattttattgttaatagcagctccagaggctgttgctaaccaggcattagatcatttgcgtaggttgattgcgaaagagcgtcaactttatgattcaacgcaatataattttgtatggatcacggacttcccgctttttgctaaagaggaaggcgagttatgtccagagcatcatcctttcacagctccattagacgaggatatctcgcttttagactcagatccttttgctgttcgttcatcgagctatgatttggtgttaaatggttatgaaattgcttctggttctcagcgtatacataatccagatttgcaaaataaaatatttgctttattaaagctgtcgcaagaaagtgtaaaagagaagttcgggttttttattgatgcgttgagttttgggactcctccacatttagggattgctctgggattagatcgtattatgatggttctaacaggagcggaaactattcgagaagtgattgcgttccctaaaacacagaaagcaggagatttgatgatgtcggcaccttcagaaattttgccgattcaattaaaagaactggggttgaaactataatatcgtttttgctctagaggtcgggaaaacgggcttttttttttacagcatgtgataagggtggatgtctttcacctaggaaacggttttcaaaaaagcacatctgagaaaatcaggtgcaactgaggaagaaacgaatgaagaatatattaagttggatgcttatgtttgcagtcgctctgcctatcgtaggatgtgataacggaggcggttcgcaaacatcggctacggagaaaagcatggtagaagactctgcattgacagacaatcaaaagttatcaagaacttttgggcatttattggctcgtcagttgagccgaacggaagatttttcgttagatcttgttgaagtgattaaagggatgcaatctgaaatagatggacagagtgctcctttaacagatacagaatatgaaaaacaaatggcagaagtacaaaaagctagtttcgaagcaaaatgctcggaaaatttagcttctgcagaagaattcttaaaagaaaataaagagaaggctggggttattgagttagagcctaataagttacagtaccgtgttgtgaaagagggtacaggacgggctctttctgggaagcctacagctttgcttcactatacagggagcttcatcgatgggaaggactttgattcttcagagaagaataaagcagccattttactgcctttgaccaaagtaattcctggattttcccaaggtatgcaagggatgaaagaaggagaggttcgagttctttacatacatccagatttagcttacggaacagctggacaattacctccaaactctctactcatttttgaagtgaanttaattgaagcaaacgacgataatgtatctgttacagaatagtcgttaggattttttatgcgcatcgttcttcacaatccagatatccctcagaatacagggaatattggtaggacatgtgtggctttaggggctgaacttatattagttcggcccttaggtttttctttagcagataaatttgtgaagagagccggaatggattattgggaacggctttctttatccgtggtagattctttagaagaagctcttttaggggtgcctaaagagcgcattttttgtctaactacaaaaggttcctcctattatggggagagagagttgcctttagatgggacctatatctttggcgcagaatcaaaaggattgtcgcagaccgtcttggatgcttattcgtctcagtgtttatacattcctatgattgaagggactcgatccctgaatttagctacttcagtagggatagttatgtatgaagtcgctcggcaaaactacaaaacattattttgaatcatgttaaggccgagaatttctcggccttttctagagaagagagcatctactgatgcttggaaatgagcttgatcaaagaatctttgtctttgagtccaacgctgcgctccacttcttttccatctttaaagaggatcagcgttgggatagaggaaacactgtattgctctgcaggtctaggggaagaatcaatatccacttttaggatagtgacgtgaggaagttctgctgccaaagcttcgagtactggggtcagcattttacaagggccacnccattcagcaaaaaaatcgataaggactagtcctgaagcaatgctatcagcgaagttttcttgagatacaacttggaccataaaacttgttcctaatttaaaatctatgtaaacccttgctaggaggtttcagggcttccctaagaaccgcaagcaaacggggctagccgtattctgaaaggccagttagccataacctctacgaaaaagtcaagacagatgcccttgtcccgggcgtttgttgaaaagaagtttgcagctaagaaaacttgaacttccatgagcaaaagctcactagaacctgaatctagcgcgtctaccggttccgccatanctgcatgagaggccagtatagagagaaagctgttttaataaaagggttaagctcaacagaatgttcttttggtggctataaaaacatctcctaagttctctttacaaacctaaaggacaaggctatatagaaacaaaaatttttgagcccttagtacgaagggctttagagaaatgatnttcttgctcgacatagaagtttttcatttgaattcaaagtcttattgaaaaacgtaatgagcttgtgccnaacggaaaatcatgatagcatgtagtcgattcaggatgcccctacccctagagcatggggaggttaggcctgttttgctttttgtaaaaatacttttgcaaggaagtgagagtaggtagagaacagggatatgggcggaaaggcttccctttagaaggaggctggtgattaaaagaagaatcagtttgccattaagcaactgaaaaaagtaaggataagtatgaatattnnggaagtatcaaacaaaaacttctccagtttttgaaaaagcaaaaatccccagaattgttagcaacgtacttgttttatnnaagagcagtctttgcgcttgagtccggttgtttttgttcgggataaaatcatttttaaaagcacagaagatgcgattcagttgttagaggcggacaagaagatctggagagaaacagagattcaaatttcttctggtaagccagaggtgaatgagcagacaaagcgtatttacatttgtccgtttactgggaaggtttttgctgataacgtctacgcaaaccctcaggatgctatttatgactggctttcttcttgccctcagaatagagagcgtcagagtggtgtagctgtcaaacgttttttagtatccgatgatcctgaagtgatcagagcctatattgttccgccaaaggaaccaatcattaagactgtctatgcttctgcagtaacagggaagttgttccacagtttaccaactctcttggaggattttaaaacttcttacttacgtcctatgactctcgaagaagtacaaaatcagaataagttccaattagaaagctcatttttgactctattacaaaatgctttagaggaggaaaagatcgctgagtttgtcgaaagccttgcggatgacacagcgtttcataagtacattagccaatgggtagatacagaagagtaactcactcgtgtgaagagactatagacctagctactagggttggtcgggacctaactcctggtatggttgttttattatcaggggactacggctcaggaaagacagagtttgttagagggatcgttcaagggtttttaggggaggcagctgtcgatcaggtggctagcccctctttcgctttgcttcatgtttatgaagcaggtgggcgcagagtttgccattatgatttgtatcgtcttgagacgatggatattaggaacggagcagatcttttccaagacgcagaggaagaagatcttatttgtgtcgaatggccagaagccgtgaatttgcttccacaattccgcaaaagtgtttgtgtgcagatgcgctcgcttacggatgcacaaagagaagtaagtataggagtcacagacggttgtgatttgagcttttttatggagaacgattagcgcgtggtactattgaaggatgttgagttcgtttgtttagattgtgaaacaacgggattggatgtaaaaaaggatcgcgtgattgaatttgctgcaatccggtttacatttgatgaaattattgattcagtagagtttcttattcatccggagcgagctgtttcagcagaatctcaaaagattcataagatttctgatgccatgttaagggataagccaaagtttggtgaggtgttctctagaattaagggtttctttaaggaaagagatcatatcgtcgggcaccatgtaggatttgatctacaagttctttcccaggaaagcgaacgtttaggggaaactctgcttcctaagcatcattatgtgatagatactttgcgtctagcttaaagagtatggagatagtccgaataattctttagaagctttagcaaggcatttcaatgttcctcatcaaggaaatcatcgagctatgaaagatgtggaaatgaatgttaaggtattcaaacacttaactaagcggttccgtacgctgtcgcaggtgacacacattttgtctaagcctattaaaatgaaatacatgccgttagggaagtataaagggtggttgtttacagatattccattagaatatctactgtgggcttcaaaaatggattttgaccaagatctacttttttctatccgtagtgagatcaaatcacggaaaaagggtaccggatttgctcaggcaaacaacccatttttaggattgtaatcctccaaggaatttcttgattttcttctataccgagactactatccattacagagatgactggggagtagaggtgggcctttaactctgagactagtcaagatagaggctattagactcatatagaagggtgatgtgaggaaggataataaagaagataaaaggaaaaaagtttctgccagctgtataaccgatcacatctataaaatattccctaacgacttaaatacgaataacacgatntttggtgggctattgatgagcctgttggatcgattggcattagtggttgccgaacggcattgcgaaagtatttgtgtaactgcttttgtagatgctatgcgtttttatgctcctgcttatatgggcgaaaatttgatttgctgcgcttccgtgaatcggtcttggagaacctctttagaagtgggcgtaaaagtctgggcagaaaatatttataagcaggaacatcgccatatcacctcagcatactttactttcgttgcggtagacaaaaacaattcccctgtggaagttccagagttaatccctgaaagtcaggaagaaatacgccggtttagggaagcagaccagagaagagctttgcgcttaaaactttaagtaacttctaaggggattctttttctctcatcttgaatgtaagctagtaagggagtccctttagtgtttaaacctgtgtcatacatcatcctttcttgggtgctggtctgtttggctcagccggatgtaagtgttgtagcttctgttgttagttgtatttgcggttacagcttactttgggctgggctttttgctttagtagagcaattatcttggaagaaagtttggtgcatcgcttttatttggacttggactgtcgaaggcgctcatttctcttggatgcttgaagatctttatgtagggacaagcatctattttgtttggggtatactgctttcttatctcgccaccctatttgctagtttttcctgttaggttgtgtggtgttgtcgcaagcaatataggggagctcttgtttggcttccaggggtttgggtggcgatagaagcaatacgctattatgggttgctttcaggagtttcttttgattttattggctggcctcttacagcgacagcctatggccggcaattcggcagcttttttggatgggctggacagagctttctagttattgctgccaatatatgctgttttgcagcatgtttattaaaacactctttttccaaaggtttatggttgacgttgtgcgcgttcccttatctgttaggcggagcgcattacgaatacctaaagaagcatttttccgactctgaagtgcttcgagttgccatcgtgcagcctggatatagtcctcatatgcatgcagggaggatggctagtgctatttggagaggtttggtttctttgtgccagactattcaaactcctgtagatgtgatcgttttcccagaagtaagtgttccttttggcttacatagacaagcctatactcttcatgaaaatcagcctgtattagaaagtttgcttcctaacaaatcttggggcgagtttttcacaaatttggattggatccaagcgatagctgaacgttatcaatgcaccgttatcatgggaatggaacgatgggaaaataaagggggaatactgcatttgtataatgctgctgaatgcgtatcgcgagaaggggaaataactagctatgataagcggattcttgttcctggaggtgagtacatccctggagggaaaataggtttttccttgtgtcaaacctttttcccagaatttgctcttccctttcaacgtttgccaggagagttttctggagttgtgaatataacagagcgaataaaagctgggatctctatttgttatgaggagacatttgggtatgcaattcgcccttacaaaaggcaacaagccgatattttagtaaatcttactaatgacggttggtatccgcgttcaaggctgcctctagtacatttttatcatggcatgttacgtaatcaagagttgggtataccttgtattcgcgcctgtcacacaggagtttctgctgcagtggattctttgggtagaattgtcggcatacttccctgggaatcgagaacttgcccagtttctacaggagtactccaagtttccgtccctctttacagttatcatactgtatatgcaaggctgggtgatgctcctctgttactgattgcagtttgttcggttatcggagcgattgcctatttttataggaaaaagaaagagaccccaccacaaacatttttttgagatagcaagtgttttagaactaggtagtaattttttgatatcgcttgcttgctaaaaaaaaaaaaggataatatacgggtctctttgtcagggttttgcatgttaggtcgagctcagagaacgttaaagcgtaaggtatgctattccggggtgggagtgcattttggaaaagctgcgatgcttactntagagcccgcagaggaaaatacaggcgtattttctctcgtcatgcagcttctgaacagtatattcccgctcgattggcgaatgtttgtggaacgggacgtagcaccacattgtctttagatggtagtgttatatctacggtagaacacttgttggcatcgctcctacttcggagtggataatgtgcgtatctattgcagcgaagatgaaatccccataggtgatggtagtgctcaggtgtttatggacctgatagaccaggcagggattcaagagcaggagcagacggtccagatcgcaaggcttgctcatcctgtctattatcagtatcaggatacgattttagcagcatttccctcggatgagtttaaaatttcgtataccctgcactattcgcataactctacgataggcacgcaatatcgttccttggttatttccgaagaatcttttcgtaaggaaatcgctccttgcaggacgtttgctttgtacagcgaactctgcttcctcatggaaaaagggttgataggagggggctgtgtaggtaatgccgtattatctaaagncgatggcgtgattagcttgggtaagctgcgtttccctgatgagcctgttcgccataaaatactagatttaataggagatttgtctttagttggaacgccttttttagcacatgttattgccgtgggatcggggcattcttccaatattgcattggggaacagaattttagaggcgttgcagcatgaacaggagttagtcaaatgaatgaaaagcccgtgttaggtatacaggacatacaaaatttacttccccatcggtatccctttttattggtggataaaattctttcttacgatttaaacactcgttcggtagtggctcagaaaaatgtaacaattaacgaacctttttttgcgggacattttcctggagctcctatcatgcccggagttttaatactggaagctttggctcaagctgctggagtgttgttagggattatattggaaaacgatcgagataaaaagatcgctttgttcttaggtatccagaaagcaaaattccgtcagcctgttaaacctggagacgtattaaccttgaaagccgagttctctttaatctcggctaaaggtgggaaggcttttgcacaagcctttgtaggttctcaggtagtcgctgaaggagagctcagctttgttcttgttaaaaaagagtccatataaagaggaagcgtatgaccaacattcatcctacagcgattgtggaagatggagcgcggattggaaataatgtgacgatagagccctatgctattgtaaaaaagagtgtaacgctttggaatgatgtagtggtcaaatcttacgcatatatcgacgggttcacaaccattggccgangaacaacagtttggccttctgcaatgatcggaaataagccgcaagatctgaaatttaagggcgagaagacttttgttgaaattggtgagcattgcgaaattcgcgagtttgctatgattacctcctctacatttgaggggactacagtttctatagggaataattgtttaattatgccttgggcgcatatcgcacacaactgctctgtagggaataatgttgtatttagtacgcatgtacagcttgccgggcatgtgcaagtaggagattgcgtaactataggtagcatggtgggtgtgcaccagtttgttcgtataggctcttactcaatggtcggagctatgagcggtattcgtcgtgatatcccgcctttcactatagggacaggcaatccctatgctctagggggaattaacaaggttggattgcaacggcggcaggtatcttttgaaacccgtctggcattgattaagacttttaaacgggttttccgctcggacgagtctttccaagcctctttggagagcgtattagaagattttggagaagtccctgaagtgcgccatttcgttgaattttgtcggcagccaagcaaacgaggtatagagagaggcgtggattgcgaagatctttagaagagccgatagataaaaaagaaggagctttcgttgagtcttagagtcgtttatctggggactccccaatttgcggctactgttttaaaaacacttttggatgcacatactcatattgtcggtgttgttacgcgagctgataaaccgcaaaaacgctcgtctaagctgattagttctccagtaaaacagttagccttgtctaaaaatattcctttacttcaacccattaagactacggatcccgcttttcttgctcaattacgagaatggcaggctgatgtttttattgtcgtcgcatacggggtgattttaaagcaggagcttttagatatccctacatacggttgttataatcttcatgctgggttactacccgcatatcgcggagcagctcctattcagcgttgtattatggatggcggagttctgtctggaaacacggtgatccgtatggacgctgggatggatactggggatatagctaatgtgaattatgtagccattggcgaagatatgactgcaggggggttagcggaagctttagccgcctctggtggagagcttttgttaaagactttacaagagattgaggccggaacagtgcgccatgttcctcaaaatgaagcgatgctacgctggctcctaaattaactaaggaagagggagggattcattgggatgctccagcttctcaagtatacgcgcatatccggggagtctcgcctgctccgggcgcttggactcgctatctatcccaagggaaagaggctnccgtctcggcgtgctctctgctagaatggaatctttctctggcaattatggagatccaggtgaagtccttggagtttctggagaggatttgctgatcgcttgccgtcaaggagctttgcgattgcgtatggttcagccagaaggaaaagcttcgatgaaagcaaaagatttttttaacggccaatcaaggttggtttcaaagcttttctaaaaaagatttgatgcctctagatagtcaaaatattttttattctaggtctgagaggcctttctagaagggtttgctgcgttttcctttntcgatttaagtaatagaagtggtataatgtctctctaaattttgtatgtacataattttgaagcaggtaggtgaatatggctgctatatgtggacgtttagggtctggtacagggaatgctctaaaagctttttttacacagcccagcaataaaatggcaagggtagtaaataagacgaagggaatggataagactgttaaggtcgccaagtctgctgccgaattgaccgcaaatattttggaacaagctggaggcgcgggctcttccgcacacattacagcttcccaagtgtccaaaggattaggggatgcgagaactgttctcgctttagggaatgcctttaacggagcgttgccaggaacagttcaaagtgcgcaaagcttcttctcttacatgaaagctgctagtcagaaaccgcaagaaggggatgaggggctcgtagcagatctttgtgtgtctcataagcgcagagcggctgcggctgtctgtagcttcatcggaggaattacctacctcgcgacattcggagctatccgtccgattctgtttgtcaacaaaatctggcgcaaccgtttctttcttcccaaactaaagcaaatatgggatcttctgttagctatattatggcggctaaccatgcagcgtttgtggtgggttctggactcgctatcagtgcggaaagagcagattgcgaagccccctgcgctcgtattgcgagagaagagtcgtcactcgaattgtcgggagaggaaaatgcttgcgagaggagagtcgctggagagaaagccaagacgttcacgcgcatcaagtatgcactcctcactatgcacgagaagtttttggaatgcgttgccgacgttttcaaattggtgccgttgcctattacaatgggtattcgtgcaattgtggctgcgggatgtacgttcactaccgcagttattggattgtggactttctgcaacagagtatnngggattttttaaatttcttaagaaaaaggctgtttctaaaaagaaacagccttttttatctacaaagtgcttagcttttcttattgtaaaaatcgtcttcctttgataatctgtccctttaattttcctggataagcgttataagttttcttccaaggaagctccactagtaaaacctagaacgatttttcaggctttgtttttgcgatttttggtgtgggatttcttagcgtcaagaaaaatctcttgtgtggatgtcgcaggtcatataccattgcccattcgccgcctttgtttgctttaaggagccgcgttttctttatcgtggaaatcgctcttgcagggtggagggcatggcgtttgctaaaaagtgtaattaggcaccgggggcggtctgtgaagcgttgtcaagttgtgtgataaggtaattaaatatgcggtctcagcttagcctaatagggaaaaaggaaggcatgatgcatgtcttcgataagaatggaaatcttgttgcgtgttcagtaattagcgtagatgcaaacgttgttgcccagctgaaaaccgcatcttcagatggttataatgctgttcaaataggagctgatgtagtccaagctccagaaaaaaccattgaaaagcgtttctccaaagcactactcggacattttaagaagtccggaggacgtgcttgtcgtgttttaaaagaagttgtcgtttcagaagaggctgttcagtctgtttctttaggcgatgaatttgggttagaaattttcgacggagtatctaacgttgacatctgtggaatttctaagggtaaaggcttccaaggggtgatgaaaaaatttggtttccgaggaggaccaaaaagccacggttctggatttcatcgtcatgcaggatctattgggatgcgatctactcctggccgatgtttccccggaagtaaacgtccaagtcacatgggatgtgatcgggttacggtcaagaatttagaagtcgtaaaagttgacttggatagaaaggtaatgctcgttaagggagcaattcctggttttaaaggatccgttgttgttgtgaagcgttcttgcggagtagaggggtagaggtcctaatggttctattatcaaaatttgatttttctggaaaagagttggggaagtttgaattgcctgatgccttctttactgaagggagagagcagtcagtaaaagattatctagtggccattcaggccaacaaacgtcagtggagcgcttgcacaagaggacgatcggaagttagccattccactaaaaagccttttagacaaaaagggacggggaatgcccgtcagggttgcttggcagctcctcaattccgaggaggagggattgttttcggtcctaagccaaaatttgatcagcatattcgtatcaacaaaaaagagagaagagcggctattcggttgcttttggctcaaaaaattcaaacaggcaagctgattgttgcagagaactctgtgtttgttagcagcttggatgctcctaagacaaaagaagctttaagattcttaaaagaatgcaacgtagaatgccgtggggtattgttcgttgacagcttagctcatgttggaagcaatgagaatttgagactgagtgtgcgtaatttgtctgctgtaagaggatttacttacggagagaatatcagcggatacgatattgccgctgctagaaatattgtggtttcagaaaaggctttagaattgcttgtcgagagtcttgtctctacaacaaaagattaaaggggaagcgaggatatgaaagatccttatgatgttgtcaaaagacattatgtgaccgagaaggcaaagatgttggaaggcttgagtctcggggacggagaaggtaaaaagaaaggcagtttctgcaaagatcctaagtacacatttattgttgctggggacgccacgaagcctatgattgctgaagccatagaagcaatttattctgctaaaggtgtgaaggttaaaaaagtaaacaccatgtgtgttaaacctcaacctacaagaatattccgaggccgaagaaaaggaagaaccgcagggtttaagaaggctattgtgacttttgttgatggtcactctattggttagtaaagaaggaagagaagaataacatgtttaaaaagtttaagccagtaactcccgggacgagacagttaattctgccttcttttgatgagcttactactcaaggagagttaaagggatctagttctagaagaagtgttcgtccaaataaaaagctttcttttttcaaaaagagctctggagggcgagataatttaggacatatttcctgccgccatcgtggaggaggagtaagacgtcattatagagtgatcgacttcaaacgtaataaagacggtattgaagcgaaggttgcttctgtggagtatgatccaaaccgttctgcttatattgctctattgaattatgtagatggagaaaagcgttatattctagctcctaaaggaattaagcgaggcgatcgtgtgatttctggagaaggaagtcctttcaaaactggatgctgcatgactcttaagagcatccctctgggactttctgttcataacgtggagatgagacctggctccgggggtaaattagtccgttctgcaggactttcagcccagatcatcgctaaaacagctggatacgtcactttgaagatgccttctggcgaatttcgtatgttgaatgaaatgtgccgagctactgtcggagaggtctccaatgcagatcacaatctgtgtgtagacggtaaagctgggcgtcgtcgatggaaaggaattcggccaacagttcgaggaacagctatgaaccctgttgatcacccacacggaggtggtgaagggcgtcataacggatacatttcccagaccccttggggtaaagtcacgaaaggattgaaaactcgtgataagcgtaagagtaataagtggatagttaaggatagaaggaaatagggattatgagtagatcgctaagaaaaggtccttttgttgatcatcaccttctcaaaaaggtccgagatatgaacgctttggagaagaaaactccaatcaaaacgtggtctcgtcgttctatgattacccctgaaatgattgggcacacttttgaggttcataatggccgtaaatttttgacggtctttgtgtcagaaactatggttggacacaagttgggagagttctctccaacaagaatgtttaagagccatcccgttaaaaaagggtatcataaggagacaggttatgtttaaagcgacagcccgatacatacgggttcagccaagaaaggctcgtttagctgcaggattgatgagaaaccgtagtgttgttgaagctcaacagcaactcagcttttctcagatgaaggctggaagatgccttaaaaaagtgttggatagcgctattgcaaatgcagagtccaatgaaaatataaaacgtgaaaatctttgtgttctagaagttcgggttgatgccggcccaatgttcaaaagaatgaagtctaagagtcgtgggggaagagccccaattttgaagcgcacgagtcatctaactgtgattgttggcgagagagggcagtaggagtaaggtatgggtcaaaaaggatgtccagtagggtttnnacagcggttactaagaaatggcgatctttgtggtatgggaataatcaagaattcgcaaaatttctcattgaagatgtgaaaattagagaatttttgaagaagaaaccttcttgtcaaggtgctgcgggattcgttgttaaacgtatgagcggtaaaattgaagttactatccatactgctagacctggattagtaatcgggaagaaaggggctgaagtagactctctgaaagccgagctgaaaaagctaacaggcaaagatgtttgggttgagattgcagaagttaaacgcccagagcttaacgctcagctcgtcgcagacggtattgccaaacagatagaaagacgggtttctttcagaagagcaatgaaaaaggctttgcaatctgtaatggatgcaggtgctttgggagtaaaagttcaggtttctggtcgtttagctggagctgagattgctcggtcggaatggtataagaacggtcgtgtgcctcttcatacgctcagagcagatattgattatgctacagcgtctgcagagactacttatggaattatcggcataaaagtttggattaatcttggtgaaaagaaggccgttcctgcggctaatcatgcaggtgctgcttcaacagctgctgcgtagtgcagacaggttataagggtgtatgaaccagtacgccaaggccgcgggaaaacgaacaaaatttcgcaagcagcagaaaggtcagtttgctggattgagtaagggagcaacgtttgttgacttcggcgaatttggaatgcagactctggaaagaggatggattaccagccgccaaattgaggcatgcagggttgctatcaacagatatttaaaacgtaaagggaaagtttggattcgagttttcccagataagagtgtaacgaaaaaacctgctgaaactcgaatgggtaaaggtaagggagctcctgatcactgggtagctgttgtccgtcccggacgtattttattcgaagtggcaaacgtttcgaaagaagatgctcaggatgctttgagaagagctgctgcaaagttaggaattagaacacgatttgttaagcgtgtggaaagggtatagtatgggagcaaaaaagaatttattagcggagcttagagagaagagttctgaagagttggatgagtttattcgtgataataaaaaagctctcttcgctttgcgtgcggaagctgctttacagaataaagttgtgaaaactcatcagttttctctgtataagaaaagcattgctcgtgctctaataataaaacaagaaaaaaaggatagagtccatggctagtgatgtgagaggccgtagaaagaccaaaattggtgtagtagtctcatcaaaaatggaaaaaactgttgttgttcgagtcgaaagggtatactcgcaccctcaatatgctaaggtggttagggattctagcaagtattatgcgcataatgagttggatgtgaaagaaggtgatactgttcgaatccaagagacgcgtcctttgtctaaaacgaagagatggcgggttgtcggacgtgtaaattagtagtggtttagcaattatgatccagcaagaaagtcagttaaaagttgccgataatacaggggctaagaaagttaagtgtttcaaggttctaggcggatctcgtcgacgttatgcaacggtcggtgatgtgattgtatgctctgtaagagatattgagcctgatagttccgtaaagaagggggatgttgttaaggctgtaatcgtacggactcgaaacgatatccatcgtaaagatggttctacactaagattcgatacgaatagttgtgtaatcatcgatgataaaggcaatcctaaaggaactagaatttttgggcctgtagcaagggagattcgagacagaggctttgttaagattagctctttggctcccgaggtgatttaaaggtaagatagtatgaagagacgtagtgtttgtgtcggtgacactgtttatgtgcttgctggaaacgacaaaggtaagcaagggaaagttttacgttgtttgaaggataaggttgttgttgaaggaatcaatgtccgagtaaaaaatattaaacgctctcaagagaatcctaaagggaagcgcattaatattgaggctcctctccatatttctaacgtacgtttaagtatcgataatcagcctgctagactgtttgtcaaagttacagagaaaggacgagagctttggaataagcattccgatggaagttcttcattataccgattggtaagagagagaaagggttaatatgagcaggttaaaaaaactatatactgaagagataagaaagactcttcaagataagtttcagtatgaaaatgtaatgcaaatccctgttcttaagaagatcgtaataagcatggggcttgcagaggctgcaaaggataaaaaccttttccaggctcatttagaggaattggcggttatctctggtcaaaaacctttggtaacaagagctaaaaactctatcgcaggcttcaagttacgagagggtcagggcatcggagcaaaagtcactctacgtggaatccgtatgtatgactttatggaccgtttttgcaatattgtctccccaagaattcgagactttagaggattctcttgtaaaggagatggacgaggatgttattcccttggtttagatgatcagcaaatctttcctgaagttgatttagatcgtgttaaacgatctcagggaatgaatattacttgggtaactacagcacaaaccgatgcggagtgccttaccttgttagagtgtatgggcttgcgtttcaagaaggctcaataagggagatgtaggtcggtatgggaatgacgagtgattcaatcgcaaatttattgacacggattcgaaatgctttgatggcagagcatttgtacattgatatcgagcatagtaaaatgcttgaagcaatataagaattctcaagcagcacgggttcgttgctcactttttagtaaaagaagaaaatcgcaaaagactaatgagagtctttttgcggtacggggaagatcgtagacctgtgattcatgctcttaagcgtgtgtctaaaccttctagaagggtttatgtttctgcagcaaaaattccttatgtatttggaaatatgggtattgccgttctttcgactcctcaaggggttttagaaggctctgtagcaagggctaagaatgttggcggcgaattgctttgtttggtttggtagcaaattaaaagattaggacggtaacgaatgtctcgtaaagctcgagaccctattgtgcttcctcaaggcgtagaggtctctattcaaaatgatgaaatctcagtaaaaggtcctaaagggtctttgacgcaggtattggctaaagaagttgagattgccgttaaaggtaatgaggtgtttgttgctcctgcggctcacgttgtagacagacctggtcgtatgcaagggctttattgggccttaatagcaaatatggtcaaaggtgtccatactggatttgagaagcgtttagaaatgatcggagtcggcttcagagctgcagtacaagggtccttgttagatctgtcaataggggtttctcaccctacaaaaatgcctattcctacgggattagaagtctctgttgagaaaaacacattgatctccattaaaggtatcaataagcagttagttggagaatttgcggcttgtgttcgtgcaaaacgccctccagaaccatacaaaggtaaaggaattcgttacgaaaacgaatatgttcgtcgtaaggctgggaaagcagcgaaaactggtaaaaaatagagggtaaagtagagtcgaactatggaaagctctttatataagaaaacttcggggaaagctcgtagagctttaagagtgcggaaagccttaaagggatgttctttaaagcccagattatccgttgtaaagacaaataagcatgtttatgtgcagctgattgatgatgttgaagggaaaactttagcatttatttcaactttggctaaggttgcaaaaacttctggattaactagaaaaaatcaggataatgccaaagctttgggaataaaaattgctgaattagggaaaggccttcaagtagatcgagttgttttcgatcgaggagctcataagtatcatggtgtagtagctatggttcctgatggagccagagagggtggattacagttttaatgaaggtttagataannacgctatcaagaaattctcataaggaagatcagctggaagagaaggttctcgtcgtcaaccgttgttgtaaggttgttaaaggaggccgtaagtttagtttttctgcgcttattttagttggcgatagaaaagggcgtttaggcttcggatttgcgaaagctaacgagctaactgatgccatccgtaaaggtggggatgctgctcgaaaaaatcttgtctctatcaattctcttgagggaggatctattcctcatgaggttcttgtcaatcatgatggagcagagcttctgttaaaacctgctaagccaggaaccggaatcgttgcaggatctcgtattcggttgattttagagatggccggggtaaaggacattgtagcaaagagtttaggatccaataatcctatgaatcaggttaaagcggcttttnnagctctcctgacactctcttgtaaagatgatattatgaaaaggagagccgttatcaatgattaagttagagtgtttacaagatccttcgcctcgtaagcgaagaacgaaactcttgggccgaggaccttctactggtcacgggaaaacaagtggtcgaggacacaaaggggacggtagccgttctggatacaagagacgtttcggatatgaagggggaggcgtacctttatacagaagagttcctacacgaggattttctcataaacgctttgataaatgtgttgaagaaatcacaacacaacgtttgaatgagatttttgacaatggcgcagaagtatctttggaagctttaaaagaaagaaaagttatccatagagagacttctcgtgttaaagtaatccttaaaggagctctggataagaaattagtctggaaagatgctgcaatagtgctgtcagaaggagtaaaaagtcttatcgaggctgtttaactagaacttttaggtaaagtttatggctacattgcgacaagtgttttcgatttccgaactgcgacaaaaaatatttttcacattttccttgcttgcattatgtaaaatcggggtgtttatccctgtgcctggaattaacggagaccgcgccgtagcctactttaaccaattgctggggtctagccaaaatttgtttcagttagctgacattttttctgggggagcttttgctcaaatgacggtaatagctcttggagttgttccgtacatctcggcttcaatcattgtacagcttcttgtcgtctttatgccgactctgcaaagagaaatgcgagagtcgccggatcaagggaagcgtaaattaggacgaatgacacggctttttactcttgttctagcctgtgtacagtctttgctttttgcaaaatttgctctgcgaatgaatcttgttgttccagggattgttttgccagcaatgttgtccttaaagctgtttggggtgccttgggtattttatttgacaactgttgtggttatgacaacagggactcttttacttatgtgggttggagagcaaatatctgacaaagggattggtaatggaatcagtttgatcattactctcgggatattagcctcttttccttccgttttagggtctatatttaacaagttaaatttgggatctcaggatccttctgaatttggaatcgtttcgcttttaattctttgcgcggtttttgtctttgttcttatagcaactgtgctcattattgaaggtgtaagaaagattcctgttcagcatgcacgtagaattattggaaggagagaggttgtaggagggggatcgtatcttcctttgaaagtgaattatgctggagtaatcccggttatttttgcttcctctttactcatgttcccagctacgattgggcagtttctttcctcggaatcttcttggttgaaacgcattgcgactatgctgtccccaggtagtgtggcgtattccattttttatgtgttgcttattatatttttcacttatttttggacagctacgcagttccgaccagagcaaatagcttctgaaatgaagaaaaatggagcgtttattcctggcattagacaagggaaaccaacccagacctatcttgaatacacaatgaatagggtaactttgctaggagctgtatttttagctgttgtagctatattaccttccgttttgggaaggattttgagagttgacgcgaacgttagctactttttgggtggaacagccatgctgatcgtagtcggagtcatcttggacacgatgaagcaaattgatgctttccttttagtccggcgttatgacggagttttaaagaaagaccgccccaaaggaagaccttgaaaaataacaatttttgacctaagatgcttatactactttaagggaggcccttcgtatgccgcgcatcattggaatagatattcctgcgaaaaagaaattaaaaataagtcttacatatatttatggaatagggccagctctttctaaagagattattgctagattgcagttgaatcccgaagctagagctgcagagttgactgaggaagaggttggtcgactaaacgctcttttacagtcggattacgttgttgaaggggatttgcgccgtcgtgtgcaatctgatatcaaacgtctgattactatccatgcttatcgtggacaaagacatagactttctttgcctgttcgtggtcagagaacaaaaacaaattctcgcacgcgtaagggtaaacgtaaaactattgcaggtaagaagaaataataatttttaggagagagtgttttggttaaaaatcaagcgcaaaaaagaggcgtaaaaagaaaacaagtaaaaaacattccttcgggcgttgtccatgttaaggctacttttaataatacaattgtaaccataacagaccctgctggtaatgtgatttcatgggcttctgctgggaaagttggttattctggttctcgtaaatcttcagcatttgctgcgacggttgccgctcaagatgctgctaaggctgctatgagttctggattaaaagaagttgaagtaggcttaaaaggaactggtgcagggcgggaatctgctgtgcgagcgctaatttcttctgggcttatcgtttccgttatccgagatgaaactcccgtccctcataacgggtgtcgaccaagaaaacgacgaagagtgtagttatagctaaggagtttgggatgtcggatagttcacacaatttactttataacaaatttgagttgcctgaatcggtgaagatgtctcctgtggaaggggctgttggcggcattgataaagtagctcgatttgttgcagatcccttggaaaaagggatggggcacaccttgggaagcgccttgcgacgtgctctgttaatcggcttggaagctcctgctattgtctctttctctatgacaggagttttgcacgaatatatggcggtagaggggatcattgaagatgttaccaatatcgttttgaatttgaaaggttcgttgcttaaaaagtatcctctacaagattgtgaaggtggaagatgctctcaaaagttacgagctacgatttctgttgatgcatccgatttagctgctgctggtgggcagaaggaagttactttaggagatttgctacaagaaggaacttttgaagcggtcaatcctgagcacgtaatttttacggtcacgcgtccaatgcaacttgaggttatgttgccgagttgcttttggtagaggatactctccttctgaaagaatcgttcttgaagaaagaggcatgaatgagatcgttttagatgcggcattctctcctgttgttctggttaactattttgttgaagacacccgcgttggacaagatacagatttcgatcgtttagtgttgcaagtggaaaccgatggtcgtgtggctcctaaagaagctgtagcttttgctacacagattttgagtaagcatttttctgttttcgaaaaaatggacgagaagagaatcgtttttgaagaagcaatctctgtagagaaagaaaacaaagacgatattcttcataaattggttttaggcattaatgagatagaactttctgtacgatctacaaattgtttatctaatgccaatatcgaaacgataggggaattggtaattatgccagagcctcgtctgttacaatttagaaatttcgggaagaagtctctctgcgagattaagaataaactgaaagaaatgaaattagagttaggcatggacctcagccagtttggtgttggtctggataacgttaaagaaaaaatgaagtggtatgccgaaaaaattcggtcgagtaaaaataccaagggataaaaagagatatgcaacacgctagaaaaaaatttagggttggtcgtacttcgtctcataaccgttgcatgttggctaatatgttgaagtctttgattcacaatgaaagaatagagactacattgcctaaagccaaagagttgcgtcggcatgcaagaccaaaatgattactttagttaagaaaaataacttagctgcaagaagattagctgtagggcgtcttatggtcagatataatacgttgactagcaaagaggctcgccaagttaaaactggaagatttgtctgcttataatgttgatagaagagtcattgggaagttatttgatgtgttagcaaccaggttttcttcgagaaatggcgggtatacgcgcattttgaagttgcaaaatagggttggtgataatgctcaaaagtgtatcatagaatttttagcatagtgatgctaatttttcgaaaacactgactacctgggatttagcaatgagaattgtgattaatggttttggacggattgggcgattagttttaagacagattctgaaaaggaattctcccatagaagttgtagctattaatgatttagtcgcaggagatcttttaacatatttatttaaatatgattccacacacggatctttcgctcctcaagcaacattttcggatggatgtttggttatgggagaaagaaagatccgtttcttagcggaaaaagncgttcaaaagcttccttggaaggatttggatgttgatgtcgtcatcgaaagtactggattgtttgtcaatagggatgatgctgcaaagcatttggactctggagcaaagagagtgttgatcacagctcctgcgaaaggcgatgtccctacgtttgttatgggagttaaccatcagcagtttgacccagctgacgtcatcatttctaatgcttcctgtactaccaattgtttagctcctttggccaaagttctattggataattttggtatagaagaagggctaatgacaacagttcacgctgcaacagctacgcagagtgtggttgatggcccttctcgtaaggattggagagggggtagaggagcttttcagaatattatcccggcttcgacaggagctgctaaagctgtagggttgtgtttgcctgagcttaaaggaaaattaacaggaatggcctttagagtgcctgtagcagatgtttctgtagtagatttaactgttaagttgagctcagccacgacgtacgaggctatctgtgaagctgtgaagcatgcagcaaacacgagcatgaagaatattatgtactacacggaagaagctgtagtctcttctgattttattggctgtgagtattcatctatattcgatgctcaagccggggttgctttgaacgatcgatttttcaaattggtagcttggtatgataatgaaataggctatgcaactcgcatagtggatttattagagtacgtacaagaaaactctaaataaaggttcgttcgtgtattttacaagagatccagtcatagagactgttattacatctagagaaggatataagttatccattcgtaattcgaaacacttgtcccaagatccttttgtcgttgaggctatagaggttgtccgtttaggagggactagttttttccgtaattgtgatcatagtaagccgtttttactgccagcatctgattatgaagtgatggaaatccgggatgctaaaatcaaccttaaagctgttggtttagatcgtggagtcaagattgttggtagtcgggaagctttactaaagatgccgaaggtggctccaatagtttctgtatcggaagataatacgattgtttctgaagaagaggtagttgcagactctactgttgcactcccgcttctacacctgtagctccaatgtctaagaaagagagacgaaaagagtttaagaatgagaaatggaaggataagaaaaaacaaggacgtcgtcgaaatagtaaagagattgccgatgctgttggatcttctcaagagatgatcgacaccgtagcagaggaatgtttgcaagagtcctcttctgaggaaggcgatttcagtgagcgacggttttctttgattcctcctcctactcgattgatttctgatggtccagaagaacccgaggaagagtctcagcctgtgacttcagtggatttaaatgagtctctaaacgctttagtcagcgaaagttgcaatgttattgagtctattttagccgatgaggacacggttgtttttactaaagaaaaagatcaaactgctgaagaatctcaagagcagccaagctttcattagaagaaactcctgttcatgacagtatttcttcagaagagtaagaagttcattgcttttttttagaactttaacatacaatccattgtagcttttccagtcgtgcgtgctagaacttcttgtaaagctgtggcgaggactctttagggtcctcgtcgtttttgctcagatggtggaatggtagacactagggacttaaaatcccttgggctttggcccgtgcaagttcgagtcttgttctgagcacatcttttttctctggttcttgagacaataatacctttttgatttatagatgaggagagctatttaacttggggtatctctttgatgtggctttggtctttagttaagctacgtctgttgtctttgttacggtttcgcaaagttcgtgcatttacttctcctgatcaatacgaagaatattctcgttccatgcttcagctgttttgtctttggaaagactctgatattgtggaatgggagaatacttgtcagatgttgtttggtgtttgttcaaaaatgagcgaagtttgcttagaaacaagaagcagatgcaaatccaatctgcgagtaaagaacaatcattagcagaatgggaacaacaggtctgtgagctgaaatctcaattggcatctcaagaaaatgcaaatcagcaagagatttctaaattacaggcagaaaatcattggttgcaaaatcgtttagcagaaaaattacaacaagcgcgtcatcaaaatgatgtgatcgatgagttgaaacgtgatttagttgaaagtgttcagcagatggaagtcagcgaaggccgtaggctatgttatgaacataagattcgagtacttgaagagcaaatagatcgctttttagcgaaagaagaggtttgatagtaaagccttttgggagattcctgattttgttagtaaccctttcctttattgtgtaaaatttgcacaaatatagaaaatgacaagacgcgagtgttaagaaaggcatggctgatttgatcatggggatagatccaggaacgttagtttgtggatacgcgttgattaaggtagaaaatcgatatcacattcacccacatagttttggaaaggttaagctctctcagaagttagctttggctcatcgttataaacagttgtttacagagatttccacaattcttcaacaagagtctcctaaagctgttgttttagagacgcagtacgtccataaaaatccccaaagtaccattaagctgggaatggctagaggtgttttattattagcggcatctttacaggatgtccctgtatttgaatacgctcccaatacggctaaaaaagctgctgtgggtaaaggcaatgcttctaagaagcaggtacagttaatggtgagcaaattattgcgtgttccagatcttttagcagaagataatgaggatatagcggatgcctttgctttagccatgtgccacgcacatctcgctccttatcaggatttaaagaagactcttgtataacagatagaattaggcactcatgtacgagtatattaaaggcactttgactcatattgatgggtcttatgttgtgattgaaagcttcggcataggatatgctattatgctttctgagcgttttttagtagatttgcgcgcatttatgcatcaagaggtgctgatttatgttcatagcgtcattcgtgaaactgagcacgttctatacggttttagctctcgcgctgaaagggagtgttttcgtttattaatttctttttctggtattggccctaaaacaggactatctattttaaatatgttccctttgcaagagttgtgttctattgcgcgcttagaaaatgtgaaagctattgcgtctgttcctgggatagggaaaaaaacagcagaaaagctgatggtggatcttaaacaaaaacttcctactttgatgcccctttacttagaggaacccgtagttccttcctcgacagcgaattcttctttcaaagaaggaatcggagctctaatgaatcttgggttctctcgtcttgcagcagatcgtatgatgaccgaggctgtaaaagaattatctgaagaagcttcagtagccgaactgcttcctatagcattaagaaaaagctagaaatcagggatcctttcgcaggtatttctgaaaatgctgagctaagttatagttttcttacaattgtgttgaaaatcagcctcatttcgtttctacggaagagatgactcgcttgtgcgtgctatggcacaggagaaagagaggcaacaaggagaatacatggaacaaactctatcaattatcaaacctgattctgtaggcaaggctcatataggggaaattattgctatttttgaaaaatctgggctaagaattgcagccatgaaaatggttcatctctcggtaaaagaggcagaaggattttatgttgttcataaagagagaccttttttccaagaactggtagactttatgatctctggtcctgttgtagtaatggtactgcaaggggaaaacctgtcgcccgtaacagagagttgatgggagcaacgaatcctaaagaagctgcggaaggttcgattcgagctttattcggagaatcgataggagtaaatgctgttcatgggtccgatagtctagagaatgccgctattgaggtaagctatttctttgctaagacagaagtagttaactctgtagcgtagtgtttttgagattgtgcaagcccccctctgcaccgtgcagaggggggtgtttttttttataggatttgtgtagcttttcggtgaggaaggctgagcatcggagtgagtgtttgtatagaaccttgttcccacaccatcttacttgctgcagattgctttaactgggataagaaatcttctcttgaatcaaaaagttcatagattgtggttagaaattcatcatgagaacgattttgtcgataagaaggttgaatttcaggagtaggaaggtagcgagcaagctttttaggattcatattccaaaaaaatgttgtgtgatgaacccatcgatatttttggatgtactgcgcattcccgccaatttttttatccaaaaaagtgtaatcattttctgtaattttaaatcctgtagggaagataggagcataaatatcttgagtccattgcaggagatcttttgaagatggagatggagtaggggaatttataatccaggagaccatcaagctatctgcatccaaaaaaacagtccctccgccgctatagcgacggataatagggattccgtcttcttttaaatgttctacgtgaagatctcgttcaggcttgcgggaaatacccaataccacagcttccggaagatgtgtatttaccagacagaaattttgtgaagaggttcgtagaagagcttcttcgagttggagctgtttaaaaataggcagcccttcgcaatgaacaaaaacgcaattaatgagcatctttcttcaaagagaccatgagcacttgaatatctgccacagaaatcccagaaattctagctgcagacccaatagtgcgtggagtaaatttagaaagcttttctctagcttctaagctaagtgctgagatgctgtggtagtcaatatcctcaggaattgaaatattttcggatctctccatactacgaattaacgtttgttgtcgggagatatagccggaatatttgatctccatctccaaagaagcgcctacaataggacctaaatctctaacatctgcaggaaattctgtaagaagctgttgataagaaacttcgggacgacatagaactctggttaatgggactaccgtatcaccatattttcggaaagtcttagataaccgttctttttcttgttctatacaagctttttgttcttggaacatagcatagcgctcgctagacagtagtcctaaggagtgcccatagtgagagagtctcatgcctgcgttatcttgccgcagtaataaacgatgttctgccctactggtgaacatgcgataaggctcgtccagtacttgggtagtgagatcatccaacatgaccccaatataagactcttgacggctcggaacaaatggaggacggcgtaagactttatttacggcattaactccagcaatcaagccttgtgcagccgcttcttcgtatcctgttgtgccattgatttgcccacacaagaagagtccttcgattagtttggattctaaagaaggaaaaataacgttcccatgaacataatcatattctatggcataggcagggcgagtgatgatcgcgttttctaatccagaaaccgagcgaataatatcgtactgcacatcgaaaggcatcgatgtagagagaccgttcacataaacttcttgtgtgttaagtccttcaggctcaataaaaatatggtggcggtctttatctgcaaatttcacgattttatcctcaatagaggggcaatatcgtggcccaactccttcgattcgccctccatacaaagcggaacgatgcagatttttggttataagatcttttgtttgatcagtggtatgagtaatgtgacaagaaacctgtggcaatgtaggaacaaacatctcgtttcgatgaacgaaacaaacgttatgatcacctggttgctcttccattacagaaaaatcaatagatgaggctaacagacgagcaggagttcctgttttcaaacgtcctaatgggaaccctaagcgttttaaatcttcagaaagacctaaagaagctgcatcgcccaatcgtcccccagagaagttctgggttccaatgtgaataagtcctcgcataaaagttccagaagacaaaacaacggttttccctagataggcccaaccttcttttgtagagactcctaaaactttttcgccattgtctaaaagtgcctcagctgttccctgcatgatatgcagcccaggaacctgttctaacaagcgtttcatatgaatatgatacagctgtttgtcaacttgagcgcgaggagcgcgtactgcgggacctttagtttgatttaagattcggaattgaattcctgatagatcagtaatttcagccataatcccaccgagagcatcgatttctcggacgatgtgtcccttaccgatacctcctacagcaggattacaactgagttttgcaatagtatctaaatttgaggtcagaagcaagacagacgctcccatcttagcagcacaatacgcagcttcacaaccagcatgtcctgcgccaatgactatcacatcgtaatcaacaggaaacgtccacatagaacccaaacaatttaactatctatttttatgccgatctcttcgacgtctttttttacgcttatgcttggcgatcttaagtcttcgttttttcttaacagatgacatggttttcttcttaatggtttacgcaaggaataattggtaagtcttttgaaaagactcagctaatgcctaggagaatcgagcaagcacccgatcctcataggtttttttctcaaagtgtatcgccggctttcaccaggcgatgggaagaagtttacaatggctgtcaatttttgggaataaacttgtttatccagggaactcacagccagcataatttcggaatcgagcaaagtctttttcaaaaactaattgtatagatccaatggagccgtggcggtttttagccacaatcaactctgctgttccaggtttatcattaggatcataatattcgcggcgaagtaaaaacataatttggtcagcatcttgttcaatgcttccactttctcttaaatcgctcatcaaaggtctgtgattagctctgtcttctacttctctagataattgagagangcagagaataggaatattgagttctcgagccaaattnttaagcattctggagatntcagaaatttcttggtttcgcgaatcagaattccttaggttcccagagctagagattaattgtaggtagtcaataactagaaattggatatcgtagctttctttcattcttcttgcgcgtgctcgaagatctgtgattttcaaccccgggtagtcatctatcagtagagtatgttcttccatctctcttaccacagagaccacgcgttgaaaatctctaccagaaatatctcccacgctaatttttttagcttctacttcggaacgcgagcagatgatgcgatggattaactggtctacagtcatctctaatgaaaaaattcctacaggaagccggctatcaaaacaaaaattctctacaatgttaagagctaaagcagttttccccatagcaggacgagcagcaagaatgatcaagttagaggggctgaacccactaatcattctatctagatctaagaaatgagtggggaagcctgagagcataggagagcttgagtcatgagcacttgcttggaaagcttcttggcgttcttgtaaagcgagtaagaaggatttgtctttagaagaagcaactcctttgagtttgtctgcaacaaggacatagggggctaagttagttgtttggcttatgcgaaacaataagttttgagcatcatccaaagcggtagtgacgtcacgtggctcttcagcggctttcttttcgatatctttggccgcttgaatcatttttcttagaatagatttggagcggataatttctgcgtattcttcaatataggcagatgtccctgcaaattcagagagagtgattagataagaggggcctccaatgatattgagttgatctcggcgtttgagttcttctcccgtaagatggggatccatggggcggtcagacttgaaagcgtcctgcaacacacgaaaaataatacgatgctctaagaagtagaaatcatcttcctgaagaaggttggcagcaaggttcaaatgattgacactggtcaacatacaccccagcacaatcatttcagattccttagaattaggaagagagaggagttgagtgggttggggtttttttgtctgggtcgccatagttagaggattatttttatggttggtaaaggaagctctctcggccaggttagggtataggggaatatatcctcaagaggaaaggggaggggaagaaaaatatcgttttcttggttagagacggggtttttagacagtcaacttcttttttaggaagcaaggattctgactcttatgcttttcaaaaaaaaaactctcgtgtaaatttatcccttcggagctttttgggccggttgtttcattggaaagatgactgagtggtcgaaggtacgtccctgctaaggacgcgtaccccttaaagggtaccgagggttcgaatccctctctttccgtttctttacattgtgttttctgaaatttttgtttgtttgaatgtttttttgttgataagctgggggaaatggcgggaacatagctaaactctctgcttgcttttggagtgtctatgtttcataatatgtgtcattgcgctggaggctaagaattttcaagacaagcttccgaatcaacgttatgagacaattctgtaatctcctttctttgtccagggtgtggttagcccttcttttctgccaagagagaattataacaaggttgttggttatctttgctgcgatggttagcgatgttctagatggctatctggctagacgctacaatgccacaagtcgcttgggctccattcttgaccctgccacagataaaatattttttttaatctgtgtgggggttctattttgggaaaactctctagggcttacgcacctcgctctgattttttctagagatatttttttagtgttcttcgggttctatctatcctgggttcgaggatggaagggatatgattacagagcattgtcttttggaaagttttttacagttgttcaattctttattttatttggggtgacgatagggatggagataccagttctttggttagctcccttagtgatcctcggggctctctactttttagagagagttttggattataggcggcactgtttggagtaggtgcccaaagaaaagaggaggcggagtgatcaagaacttgaattttagcagcaagtgcggtattctagttccctggatttcataaaaatcttgtaattatgcattgccaagcatccagtaattatcccaaatttcaacagagtgcgaggttcctcgcatcacaaaaatttttcccaaagtcttcaatatttattaaattaggaaggagtgtatgtcttccgaggtaaaatccttttcgaagttcaggggatanctttttccccatatacaggtcagaattctctaaatttatacccttattctttttagctttttttgtaggtgttaactacgctttattaaagaccacgaaagactcccttgttttagtcgggtctagagcaggggcggaagtcatacctttcttgaaagtctgggggattgtccctggggccgttatcgtcaccatgatctatggatggatgagtcgacgttattcaagaggtaccgtgtttatctctttagtcggcggttttttaggcttttttgcgttgttcgccacagtgatttatcccataggagatgcgctgcatctaaataaattggcggcaaaactacagtccatcttacctccagggggaagaggttttgtagtgatggttcaatattggagctatagcctgtattatgtgatgtctgagttatggagttccgtagttttgtctactctgttttggggggtagccaaccatattacgagtgttcgcgaagcagggcggttttacgctcttattaatactggattaaacctctcttctgtttttgctggagaggtttctttgtggctcggtagaagtcctgtaattgccttccctatggccgtagatccttggcatgagatgttgctcaatatcactctacttatcgtgctggccggcggagtaatcctctatctatatcagaagttagatcgcttgatggatgagacgtcaatgttagaagaggggttggcagcagaaatgtcggtcgctcagcttaagaaagagaaaaagcggtcgaaggcaaaagcaaaaagtctcttcgctcttctcctccgctcccgctatctattaggcatcgccgtcgtcgtactctcttacaatttagtcattcacctttttgaagtcgtttggaaagaccaagtctgtcggatttatgcttctcgagtagaatttaattcttatatgagtaggattacgacgctcacaggaatcgtctcagctttggcagggattttcgctgctggacaaactattcgccgttggggatggactgttggcgccttggtaccccctttaaccatattgattacaggagccttgttctttggcgctatctatgctgtaaaaggggatgctatgatttttggcgggatcttagggatctctccgctagttcttactgcttggttaggaggtgttcagaacgtcttctcgagagcaattaagttcacctatttcgatcaaaccaaggagatggcgtttattcctttggaagatgatgagaagaattacggtaaggcggctattgatggggtgatctccagagtagggaagtcagggggctctttagtttaccaaggactgctgatcatcttctcgtccgttgcagctagcttaaatgcgattacgattgtgttgttgctggctttagggagttggatctttgtgatcgcttggttaggtagagagtacacagccaagaccgagactcttgttagagtcaatgcttctgaagaagatgttttacaggaagagcgagaggcttcttctttagtagatgctgagtctcgagaagaacctgcaacaactttatagtcttgagaagaaaaagacctggagtatagtattccaggtcttttaattttttatttaaaaattctttttataatccccctgttttagtaccgttttgtttctaatgctaaaagcgattaatagatttattagggtttgcatgaagaatttttttcgatttttattaaaaggttttttatccgcctgcggtttgtttttaggtgtgataggagctgccggattcatttttgtcctatcggcctctgttcttggggcgggagacggagttttgtttgtcaatttccccaacgctcaaggagttgttcaagagcttgggaaaactgctcccattattgcagtgattgatattaacgatgctattatcgctagcagtggcgctgcaaagcgtttacaatccgctttacagcctttaaatgaagctccttacaaaggaagagtaaaagggatcttagtcaaaatagattgtcctggtggtgaggtttttgaaattgatcggatgtgcgcaacactctctttctggaagaaacagtggggaatccctgtccacgtctttgtatctggactctgtgcttccggaggatattatgttgcttgtattgccgataaaattggaaccacttcgagttctctgattggttcaataggagtacgttcgggcccatattttaatgttaaagaaggcttacaacgacatggcgtggaaactgctattcttacagcgggagatgacaaagcgccgttaaatcctttttcttcatggacagaggaagagtacgccgagcgccaggggatagtggatgctttctatgaacagtttgtggatcatgttgttaaatatcgttcgaagctgtctaaggaaaaactaacgaaggttttgggagcccgtgtatttattgcgaagcaagctctggaagaagggttggtggatgcgatcaatcaaactcaagaacaagctttagaagaactggctgaagcctgtggtatcaaagacaattatcgagtcattgggttgggttctggccattttttaaaacgtttttctagctatctaagtaatagcccgcttgtaacagggaaactccaagtgacggctttacctgatcagcaacaaaaatctttgtggtacatgggttgaggctggatcggtgcatatgaaaaaactttttgttttagatgtttcaggatttgtttttcgggcatattttgctcttcctgagatgcgaggtccaaatggagaaagtacgcaagcngtattcggtttcattcgctctttagataagttgatcaaagacctctctcccgaatacgtggttgctgtatttgatggtcccaataataagcagagccgtcaagagctttatgccgactataaaagtaaccgtgatcgtcagttagaggatcttccagagcaaattcgtttagtgaagcaatattgtgaattacttggtatctcgtgcctggaagaaaagggtgtagaggctgatgatgtgattgctagtatcactaaaaaagcggttgcagatggttttgaagtgtgtatttgcactgccgataaggacttattgcaactggtgagcagccgtgtctccgtatttaatccttggaaagaacaggaaatccaatataacgaagtactattgcagttcggagtgcctccggagcagattgcagattacttggcgttagtgggagattcttccgataatattcctggcgtttctggttgtggtcccaaaaaggctcaagctctattgaaggagtttcaatcagtagaggagttagttgctaatacggaacgtttatctggcaaaactaaacaaatgatagaagatcagaaagagacgttgcttttgagtaaacgtcttgccacgttacacatggatctcgcgttcccgttgacgactgaggagtttgcgttttctccgcaagctatagattcagcgcagttgaataccttttatttgcagcatggatttaaggctctggtaaagcattcggaaactgctacgagttccattgcggtacagactgtgacagatccggtaactttgaagactgttttagaacagttgaaggggggagaagttgggtattgtgcggcttatactggggagcatctcccttctttgcagctacacggcgtagccttagctggggccaaccaggtattttatatagaggtatctggtgtacaagagattgctttgcttaaagacttttttgcagataaagcgactcaattttttggataccgctctaaacgcgataatcacgctttaagaaattctgggatcgatgttcatgtaacagcagatttggttctagcagagcatttagtgagtggcggagcaaaaatttctttccagactttgttaatggaatccggacatattcaagaagcagtgtttttttctaaggaatggggggccggctcgcttcctgtacagagcctaccgcgtgatcccgcgcaatatttcggaatgtttgcttcaaaattactagcgatcaaaaattatttatttgtgaagttagaagaaaaggggctaaaagatatttttgagacggttgagcaacccttggaagccgtgttattcgccatggaatgcgtgggaatgcccttggatagtcaaggattagctgttttggatagagatctaaccaaagagctcgaagaatgttctcaggaaatttacgatttaactggctgtgaatttaatattaaatctcctaagcagttatcagatattttgtatcagcgtttgggaatagagcctgtggataaagccaaatctacaaaggcagaggttctggaagctctagaagaccgtcacgagattattcccaagattttgatgttccgtgctacagagaaaatgttgtctacatatgttcgagctttgcctaagcagatcaatgcgggaacgcaacgaattcatccaacttttaaccaagtaggaacggtaacaggcagattatcctgtcaggatcctaatcttcaaaatattcctgtgcgttctgaaagagggagatctttgcgagaggcttttcgagttaaaaaagacaatgattattttttagctgctgattattctcagattgagttacggtttcttgcccaccttagtcaggatgagacgttgaagagagcttttaattctggcgaggatattcatgcattcaccgcttcgcaagtgttcaatgttcctttggagcaggttacgaagcaggagcgttatcaggctaaagcagtgaattttggcttagtgtatggacagcaggcgtatggattatcaaaaattttaaagattagcgtaagtgaggctcagggattaatggatgcctattttgcgcgttatcctctagcagcagaatttattacacagacgatagagcaagctagtaagaatcagaaagtaaccacaatgctggggagagagcgtattctgagcgattgggagagctctcctggagctcgtgctgcttctgggagacttgctgtaaatacgcgtatacaagggagtgctgcagagttaattaagttggctatgttgaatatctcagacgaaatgaggtcgaggggattaaaaagtcgtttattattgcaaattcatgacgaattattatttgaagtccctgcagaagaattggaagagatgagaagtctagttcaagagaaaatggagtctgcaatggagctgtctgttcctttagttgtgaatgtcttaattggaaaaaattgggcggaatgctagatttattgaagatttctgttacaggagatccctcttcagggaaaactgaggcgtgtcaggtttttgaagatttgggagcttatgtaattagtgctgataaagtttctcatagtttccttgttccttatacctcagtgggtcaacgtataattgatcttttgggtccagagataatcatagagaatactcttagtagaaaggccattgctgaaaaagtttttggtaaccgggatttattgctgtctttagaagagattttgcatccggaagtgtgtcgttttgttgaggaaaaatatgcgcacgtggttcaggaacaaaagtatcctctgtttattgtggaatttcctctgttgtatgagattcagtatgcggattggtttgatcaggttattttaatttctgcagatacgggtatacgcaaagagcgttttcttaaaaaaactggaggttcggacaccagtttcgatcttcggtgtgcacgcttttcttctttagaagaaaaaatcctgcgagcggatgtggtcatagagaataatggaacgaaagaagaatttcgtcgcaaagtaaaacaatgttttaaggctttaaagggaacaatatgaaagaagagagtccagccgaggtcttacaaaaggtaaaggagcacaagaggcgcgagggccctttatcgttggaaaaagaagttagtgaagacagtgctgttgctacagaagagaaagaaacctcgcaaccagtagcagttacgaagattgctaaactacagcgcatgggcattaatgagctgaatgttttagctcggcaatatggagttaagaatgtaggttctctgacgaaatcgcaggtagtgttcgaaatcgttaaggctaaatctgaacgtcctgatgaattcttgattggagaaggtgtcctggaggttctcccggatggttttggatttcttaggtctcccacttacaactatcttccttccgcagaagatatctatgtttctcctgcgcagatccgtcgtttcgatttgaaaaaaggagataccatcgttgggacgatccgttctcctaaggaaaaagagaaatattttgcgctgttgaaagtggataagattaatggctcaacgcctgataaggcaaaagagcgtgttttattcgagaacctaacgcctcttcatcctaatgaacgattgatcatggagatagggaaagagaatttagcagagcgagtattagatttaacagctccaatcggtaagggacaacgaggattgatcgttgcgcctcctcgctcaggtaagacggtaatcttgcaaagcattgcacatgctattgctgtgaataatcctgacgcagagctgattgttttgctaattgatgagcgtcctgaagaggtgacggatatgattcgtcaggttcgaggggaggtcgtcgcctcgacatttgatgaacaaccggatcgacacattcaggttactgaaatggtgatcgaaaaggcaagacgtttggtcgaacacggtaaggatgttgtgattctattagattcgattacgcgtctagctcgtgcatacaatactgtgcagccgcattcagggaagatcctcactgggggagtagactagcgcgttacataaacctaagcgtttcttcggtgcagctagaaatattgaaggcggaggatcgttaactatcttggccacagcgttgattgatacaggatcaagaatggacgaagtgatctttgaggaattcaaaggaactgggaatatggagttggttcttgaccgccatctttctgatcgcagaatctatccggctatcgatttgattaagagtggaacacgaaaagaagaattgttgtaccaccctggagagcttgagaaagttcggttgttccgacaagctatagctggtttaacagcaatagatgctatgcatttactgctaggccgtttgaaaaagacaaatagcaatacagaattcctgttatccttgaaggattaagaatcgtctttatccgatcagaatttcaggtatgatgatcggggtggcttgataggtttgaatattccgaaaggccaccctctttaattgtagtagagctgtcttcaaaagttccgctacttcatctgagtgaaagctttctttagtttcactgtaaattcctaagaatcttttcccataaaaagaaatgatccgcagaggaggttcaaggtgaagaatctgctcttggataggtatgccaacaaagatgtggaatagcataggcgagtcagaaaagagttcttatctctataaagggtatgggtccgttttttgtcaaaattagataatttttatttttcaaacatctaaaaataaaatcgatttattattcatgcaataattacagttttgtttgtctggcttttttaataatttatttttaaaattattttttatggtggcggggacagatggctggtagacggacgaaagaagagcagatcaatcgaaaacgatcgcatttctatcgagataacgtaggagttattgtcttatgcggaggagaggggaaacgattatctccgttaacttgttggcgttgtaagccaacagtatcttttgggggaagatacaagcttattgatgtgcctatatctcatgcctttgcctcagaattttccaagatttttgttatcgggcaataccttacctatactttacagcaacacttatttaagacgtatttttaccatggagtcatgcaggatcagattcatctcttggtccctgaaagacgagatggaagtcaggtttggtatcagggaacagctgatgcaattcgccaaaatcttctttatctacaagattctcgtgtggagtattttttaatcttgtcaggtgaccaactatacaatatggattttcgctcgatagtagattatgctatcgatgcacaggcggatatggtgatcgcttctcagcctgtatcagataaagatgtttcacgattcggagtgttgaaagtagacgatgagtcgaaactgattgatttctatgagaaacctcaaagtgaagagattttgaaacattttcgtctaagtaacacggcgatgaaaaaatttggtctcgatcctcagcacgggaattttctaggatctatggggatttatcttttccgtaaagattgtctcttccaattgcttctagaagaaactggagatgattttgggaaagagctgattcatagacaaatgcatcgcgggaaaactgttgcatatctgtacgacggttattggacagatatcgggactatagaatcttattacgaagctaatatggctttgactcaacggccttcgcacaatattcgtgggtttaattgttatgatgacggggggataatctatagtaaaaataatcatcttcctggagcaattatttcagattcgagaatttcgagttctttactgtgtgaaggagctatgattgagtctggccaggtctcgaatagtgtcgttggagttcgaggggtaataggccaaggatctgtgtttgaccgttctatcatgatgggaagcgattcgtatggttctgagtctttccctttagggattgggaaaaactgtgaaattcataaaaccattattgatgaaaactgctgtataggaaacggtgtgcgtttacagaatctgcaggggcataaggattatgattctccagatgggaaattagttgttcgagatggtattatcatcgttcctagaggaacgcaaatcccagataattacgtattttagagagtggatttttcttttcgagctgttgacaaaggtaaaagtggttggcaaaataaagagctgattcttctatcaagcaagaggtttcatgcgtatttttgcccttgcagatctacatctatccttaggagtccccgagaaaactatggaggtttttggtgagccttgggtggggtatcaccaaaaaattgaaaagcactggagagatatcgtctcatcggatgatattgtttgtctgcccggagatatttcctgggcaatgcgtttagaagaagctcaggttgattttcgttttttaggagctctccccgggatcaaatacatgatccgtgggaatcatgattattggagttcagcttcttctgcgaaacttgcgaacgttttgccagaaactcttcattatctttcaaaaggatacgtgttgcttaatgctcatcaggcaattgttggggttcgtttatgggattcttctgacatttgcctccattgggaaacgcaacatgatggtcctcagagagttttaactgagcaagatgataaaattttccttcgagaatatggtcgtttagagcgagctctgaaagagttgcccgcttctgtagaagatgttttggttatgacgcactatcctccggttagtaatgacgggacgcctgggcgagtttctaatttgttagagatggatggccgcgtctctcgttgtttgtttgggcatttacataaggtgccgcgacctttccctggatttgggaatatccgaggaattgagtacactctcgtggctgccgattacgttgattttattcctcaggttgtcagttgaaaattctttctggtaaattcaaagggaagtctttaaagactttttctaatccctctgttcgtcctacttgtggtgtggtgaaggaggctgtttttaatatttgtgccaatcatatagttggcgcacggtttttggatttgtttgcaggatctggatctatgggatttgaagctattagtagaggcgcagaatctgctacatttgtagattcctctgttgaagccgtgcgtttaattcgagctaatcttgctttgttagatagcaatttgcctgttcatatcctgaagcaagacgttcgttcagcgttctacgcttaggtaaacagaatcgttcttttgatatcgtttatatagatcctccttatgctttggagaacgcgtttcttcaagaggttttatcgtacgttgtacaacaaagcctattagaaccggatgggattctctttttagagaacgcatctccgcaagagattctagtacagggattagagcttcggaaacgtagaaaatctggggggacttttctttcagaatacattcagcaagagaactcggctcattctacataagcaaagcgtaatcatagtgggtggataaaaatttttctcttgaatatgattcggggatctagtctgatctctgaggttagagtgaaatttaagtatttgcgtccattaagctttttagtcttggttattgtagcgttttgctacggatgttccagagagaaacaagaggttctcgtcggaagggatgctacttggttccctcaacaatttggtatttatacatcaggaattaacgcctttgtgaatgatttagtttctgagattaattacaaggaagggttgaatatctctatagtgaaccaagattgggttcatctttttgagaatttagatgataagaagactagcggagcctttacttcagcctctccttcaatagaaatgttagctcggtaccagttttcagatcccgttttattaaccgggcctgtgcttgttgttttagaaaattctccgtatcattctctccaggatttagaaggaaagttgatcggagtatataaattcgattcatccgttcttattgcacagaatgttcccaatgctgtgatcgattcctatcagcatattcctgtagccttagaagctttgtctactcagcgttatgatgcgttattggtgcctgtaatagaggcaactgctttagtagaaacggcttataaaggacgtttgcgaatcgcttcagaacctcttaatgaggaaggtttgcgtttagttgtgttacgaggaggaggatcggattccctattggaaggatttaatgcaggattggcaaaaattcgtcgatcaggaagatacaaagccattaaaatgcaatcccggcttccttagaacaaggaatttaaagagactgtggtaacatatttactagccaattttggaggtccaaggacttctcaggagattgtcagctttctacaagctctattgacagatcgagatgttacaggaggaatgattccttccgtgttgcataggccattgttttcttatattgctaagcgtcgagctcctcatgtagcgcgacaatacgcttatttaggagggggatctcctatttttcaagatacagagagactagctcaaaacctctctcaagaattgcaagcttcagttattccttttcatacatatttaccagagactcaccgggaaaccttacaggcattacaagaaagccagggaagcatagttgggattccattattcccacattacaccttcgcagtaacagggagtataattcgatttttcttacaacatcttccagaaaaacccatttcttggattacgcagtttggagtgcatcctcagtttgtctcgtgtatgcaacagcatattcgagactgtttagccgctcagcanatcgctgtggaggattgttattttcttttttctgtacacggattacctcaaaggcatattcgtttaggagatccttatgctcagcaatgtcaggcttctttcgaagcattacggaggtgaattagagggggaaattgcttttcaatctaagtttgggattggaaaatggctagatccctctactcaagaggtctgtcagtctttgcgtaccaagaaacgctacattgtgattgtcccttttggatttgtttcggatcatattgagactctatatgaaatagatcatctgtatgtgcctatattgctgcaaaaggagtatcgtgtggttcgtatcccagctatcaatgcttcttctagatgggtatcctctctagcagcaatagtcagaagttccccacaggaaacttctttagagccgcttctaatgccttagacgggatacgcttttgaacttctcaagaaaatgcctgttcagtattgtctctaagaatatagtcttaaagaaatattccttaatagtgctctctccgaaaaagagatggaaagctagttctggggacgcctggcaaattaggagtgcgggatttctatgaaatcacgaaacgctcagtccatattagagtctttatgtaagaaaacgcatcgactcttattgcgctatctgctcaagcagactttattggttgctttagggatgactttaatggtcgcagagctgggaatctttctttacttttttcttttctctgggaaaactcttctaccagccttctgcctggcctgttttgttcttacaatatttatatgtttagtcattcggctctacattctatctaagaaaacggaattctttgataaactccttgcggactttgttcatcaagctcaggtaatttttaaaaagaaaaacatgatggaggaacacccagagatcgctgcagcagttacacagctatctctggtaatgcaaaatcaagagtattttgttttttgtaatttattgaaaatagtgcctccctacgactctatcaaaaaattcagctgtttttgtttttggaaggattatttttctttccgagagatgcttttgcagaaagcaattgatttgtatttactagttgtccaagcaattcctacagacttgggtgcacacgtttccttagcagatgcctacgtatcactatcggggctttatgcagaccccaggaaatacacggaatttgatacgaaatattgggttcctccaggacgttatggagaggatattcaggaaaagttttttgcaacagcgcatagggctacagaagaattcaagattcttaacgaatacgctccagggaatgtttgggtgcatacacagttggcctatagctatcatgatctacaaatgcccaagaaagaaattcgtgaatacgagattgtcttgaaattgaaaccccatgacgcgaatacaataatgaagctggggattctctattttcagcagggaatgaatgctaagggattacaggtttacgaacagttaagaaaggtagacctgaagaaatctaaaaaactcattaagttctacggggtagtagctaaatagcgaagagaagagtgcggcgtttcttgctgtacagggagaagaaagatccctcctatgaggagagcgagtcccacaatcacagaaaaaatagctgtcgccaaagggcgaatagagaaagctgaacaaagggaaagtatagcgggggtagccacagattgtaaaagcactgcgtgaatgctcgcagcccctattaaggtcagaatgagtccaacaatagctaaaaggctccctacttcgtatcgagcgcgaggggatagagaggctcgccaagagacgctaagcctcctatagaagtttgtaggagatgaacaaggactctgtgggacaacagacataaaatccatcctgaaataaaaggatcctctgtagatgggagtaaaataagagatattttaccttggtattttttttttatggaataggagactcatttctctctgtagtcggagaagactattcattagtaaaaaaaactcttaaatataaagaaaggggaataaaaagtttgtatagagtttcttttcgttcgatgtacaaaggatctagggtggtttcttgtttataacgagaaagcaagctttaggaatcgtctttttaaacagagaagatccttcttaaaaaggcctacatccaaaataacaaccattgtacactatctgtatctaaagttcttcttgtgtaaaagaaccaagtcaagatatttatcgagaagataaccaacctatagagacggttttacactggtgtctcagggttttctaatgcattggaactggtgaaggactgtttgcttttatagggtgcgtaagaccatgttcgagattttgcgaaaaaagatttcttcttactcggttgttctcttttgccttgttgttttatctatttttctttcagggaagatagttgttaatgtgaaaacctatcgtgttgagcgtcagaatagcttggtgttgctttcgcggtcagttgaagctgcttattcgcgaggaattttccctccagagacggctatgcctatgcttgaacaagcgtatcgaagaggtggtaaagaggctgtttcgtacgctggatttttagcttcatgttttcatatacacaatgaccctttacgaggagcgtattattcagggcttgcctatcaacatggaacgcatttgcagctaccttctcctcaacatattctattgaaggaaatagctgatgcgcatgcaaccaagcagtatcaagaggttttagataagtctagagaacttctttcgtctatttcctcttcgaaggatttccctatgctacgttttctaacgttattgcgcatgattgaggttaaagaatctttgaatcaggatttttctttagagttaacggaattgaaggctttgccaggatttgaagattacgagcaattatataaagacggggtttggactatatctaaacgttacagcagtctgagggccctttattgatttggaatttttgctatgcatagctcctcccccatttctgaaatctgttctatggaaacagcagagcgagttcttgaagaaaaagagcgtacccctactattatttcaggccagatagtgatttacccagaagatccttttgcaattccctcagttgatccatgcttcgagtcttagcttatcgacaggtttctttttctaagtttcctcacttattcaaatcgtttgtgagccttttgtcctctcttaagcaacactattctttcatgttgcctggagaccctctccctaagaaaaaggcccttatgcttacattcgatcacgcttctgttgatttctacacacatgtctttcctcttcttcagaacttgcagatacctgcagttattggagttgcctggagatatgtggctgatttagaaggagaggatcttcccattgatgtgcgaattgctccctctgattttttagcttttcaggacgaaatattttcgtatcatcagcctttttgttcagtaagagagctgtgtcatatggctgcaagccctttagtgcgatttgcttcttcagggtttgcgattagaaatcttaaatatgctcctccttatctagacacagagattttattatctaaaattttattggagaatgccattcaaagcccagtagaaagctttttctttccattggggaaaagtgatgtagtaagtcagcattttgttcaggagacttatcggtattcttttgtgttggggaatacggctagtttttcctatcccacacaatcattgcatgggattccgcgtatcgatatgcccttagatagtcaaagggttccatccctttatcaactttcttatcgccacttgaaacagtttttagttttgcgctagcaaggatctattctgatcgacaactatccagaaacgatccttttccttgcctatattttctgattttcttaaagtttggccgagcttacacagcttagatccgcttctattcttttctatagcatttttttcgaggagagaaagtaagaagttcggattattcgtgaaatctacctattaaaaggagacgccaatgaaannattacttttactcgcaatgttaacttctgctgccgctgctggttccgtttacgctgatgagactgaagaagaaaaagaagtttcttctttagttgtttccctagcttgcgaaggggaagaaggtggagaagaaactagagatcctattcgatagttttttctaaaagagagttgaattttcaactctctttttttttcttaaaagattctctataccagctccttcctaaatattttttgaaatatttctttcagtaagtcgatcatcttgtttgtaagaggaaaaagcttttcttttgctataattcgctagttactagaattcaaaacccagattgataagagtattctagacctgtcttgagactttttggtgcgttttcaacgaatagaggagacaacgcatgatagataaaattatacgaacagtactggttctgtccttattcctgttgtattggtcttcagatctacttgaaaaagatgtgaaatcgatcaaaagagaactcaaggctttacatgaagatgttcttgagttagtccggatctcgcatcagcaaaaaaattgggtccagtctatagatttttctgtttctccagagatcagtgtattgaaggattgcggagatcctgcgttccctaatttattatgcgaagacccttatgttgaaaaagtggtcccttcgttgttaaaggaaggttttgttccgaaaggtattttgcgtacagctcaagtaggaaggcctgataacctaagtccgtttaatggctttgttaatatcgttcgattttatgaattgtgcgttcctaatttggctgttgaacatgttggtaaatacgaggagtttgcgcctagtttagccttaaagatagaagagcattatgtagaggatgggtctggggataaagaatttcatatttatttgcgtcctaatatgttttgggagccgatagatcctacgctgttccctaaaaatataactttagcagacaccttcttaagaccacatcctgtcaccgctcatgatgtgaagttctattacgatgtagtcatgaatccctatgttgcagaaatgcgtgcagtggctatgagatcttattttgaggatatggtttcggttcgggtagaaaacgatttgaaattaatcgttcgttggagagctcatactgtacgtaatgaacagggagaggaagagaaaaaagtgctttattctgctttcgcgaatacattggcactccaaccgttaccttgtttcgtgtatcagtatttcgcaaatggagagaagatcgttccagaagattctgatcccgatacgtatcgcaaagattcggtatgggcgcaaaacttttcttcacattgggcgtataattacatagtgagctgtggagcattccgatttgcagggatggatgatgagaaaattactttagttcgtaatcctaattatcataatccgtttgcggctcttgtggagaagcgctatatctatatgaaagatagtacagattctctcttccaagatttcaaagctgggaaggtggatattgcgtatttccctcctaaccatgtcgataatctagcgagcttcatgcaaacctctgcttataaggaacaagctgctagaggagaggcaattttagaaaaaaattcatcagaccggtcctattcttacatcggatggaattgtctttctcttttctttaacaatcgttcggtacgacaagccatgaatatgttgatcgatcgggatcgcattattgagcagtgcttggatggtcgtggagtctctgtgagtgggcctttttctctctgctctccatcatacaacagagatgtagagggatggcaatactctccggaagaggccgcacgtaaattagaggaagagggctggatcgatgctgatggagatggtattcgtgagaaagtaatcgatggagttgtagtgcctttccgtttccggttatgctactatgtgaaaagtgtaacagcacgaacgattgccgaatatgtagctacggtatgtaaagaggtgggtatcgagtgttgcttactcgggttagatatggcggattattcacaagccctcgaggagaaaaatttcgatgctattctttccggatggtgtttaggaacccctccagaagatcctcgtgctctatggcattcggaaggagctttggagaaaggatctgccaatgctgttggattttgtaatgaggaagcagaccgtatcatcgaacagctcagttacgagtatgattctaataagcgccaagccttgtatcaccgttttcacgaggtgattcatgaggaatctccttacgcgtttctctattcaagacagtactcccttgtctataaggagtttgtaaaaaatatttttgtgccaacagaacatcaggatttgattcctggagctcaagatgagacagtgaatttatccatgttgtgggtagataaagaggagggtcgatctccgctatatcttaaaacgtctgcttttgattcccttaacgctctttgctatcatctctgtgaattttgtgattctcaatgctgctccaggagacctgcttgaggaacatagtgtggatgcccaaggtgaggctgggagatcggataagattcgtacgtataaagggccggaccgttatttacaatttagagagcattacggattaactctccctattttttttaatactcgaccacagatttctcgatcggaactccgtgctgggattcaagagattattgatgggacgattcacaagaagagtaagacaggaagcataaccaatattaaggtgtattggggagattgtgccaagttcattatgccggcgctgcttgcagaggctgaagattcttcgaaagaggatatttatcgacatgttgcagcagatttattcattcgaggaggtattcgtcaggggattgttgaaccacgtttgctggaggaacagcgcgaatataatcaaaaagtgtctaaaagcaatgcagaactcgtgcgtttattgaatgaagataatatcgaagttaaagttgccgcgttacaagaatgggttgagcaagagggcggaagagggcaattaatgcgaagagatctctggaggatctttttcttagagacgcggtttgctaagtacctttctcgtatcgttagattggattttggaacgttacgcaacgactgtcataagacggtcgtttctgaagtgatcaaacgtttaggttcgtcacttattctatccctgcttcctatgattgtggtttttatattatgccaagtgttcggtatgatcatggctgtgaataaaaaccattggatagatcatcttctcaattttctatttttgattttattttctattcctgtctttgttgctgtcccttggattattgataatttcgttctaaataaaacagttccatttacgtccatttctatgccttacagtggactgtgttcatctccagaaatattcaaagaaatgacttcttttgaaaagctgacggatattgtgttacacagtttcttgcctttttgtgctgtcagttacggagcttttgctgcacagtcacgtttaagtcgtgctgtatttttagaagtcttaggagaagaccatatttcagctcttcgagctcgtggtatttctcagtatgacattttggttcggcatgtggggaaaaactctgcagctacgttaatcacttctttagcctcgtctttaagcgctctacttggaggagctttagtagtggaaacactatttgatatcgatggtttcgggaaatttttctatcaggcgattctaaatcgtgatcacaatgtggtgatgttttccgtaattatgggatcggtgatttctctgatcggttacttaatcggggatatttgttacgttcttcttgatccacgtgtacagctagaagaaaggaaggtgtgagatgaaggaaccccaaacatcttatcaacgattttttcgtgcttataatagacgggcacttccctctatagctttaaagttctttattggacttatgcttattggtatttacgctcctttattcgcttctagtaaaccgattcttgttcgttggcacggggagtggtattcccccttgttccgttatttgcttttcccaggtttttacactaagtctatcgatttattttttaatgtcttaatgctcacactgccgttttttattttaggctttcgttatctcagtggtgtgtggaaaaagctgtttctaggtgtagtgactggaatacatattgcggtattctcttttgctttgagtgggagagttcaagatccttgtcgggatgagctgttaaagcagaaacgggctaagcatctgcaacaggaattgaaaacaactccaaagacagagtttcttccaacaattgctaaaagaacacgcacttgggaaagtgagcgtgcttatatgagtaaatatgagcagctgggaatgcttgtaaaagccaaatatcgcaagatgcagcacgatcatcttgaaaaacaaagggaggcatacgagttgtgtaagcaatctccgatgccgactctgcgttttctagaaatgaagaacgaaacagcaagcctgcgttttttcaaaaataagatcaacaagttaaaagcttcctatccggaaggttttgaaggatggggaactttgctggaagattaccgtccttatttgatggctagagcacgttcagaacatgctctgaatatggcgatatacgagcaacatccccaagaagagttgcgtgcagcgtttgaggctcttgaggaaaaagaggctccttttagagagcagttggcctttgtacgtagtcttttagaagagcgtgaagctttaaataattcgattacgtttatcatggataagcgtaattggatagaaaccgagtctgaacaggtacaaatggttttgaatccattattaagcagctttcactgggaagatgatgccggcggatctcgagagatgaacaagtatgtgcattggtggcagcttacacgcattaatagaaaggatttactcgcttctctgatctttgggattcgtattgcgatcgttgttggtggattgggtgtttctatagctttatttataggcatcattgtgggattgttatctggctactttggtggcaaggtagacatgttattatcacgagtgacagaaatttgggagaccatgcccatgttgtttattcttatgctcgtggtagctattacacaaaaaaaatctctcatattagattcggtattgctgggatgctttggatgggtcagtattagtcgctatgtgcgtatagaaaccttaaagcaaaggaatttagggtatgttctagctgctaccaacttgtgctacagccattaccatattatggtgcatcagatccttcctaacgtgattgttccggttatttctttattgccgttctcgatgatggctatgattagctgtgaagcagggctcacttttttagggttaggagaggagagttcggcatcttggggaaatcttttgcgagaaggagtcacagcatttccatcagagagcgccattctatggcctcccgctattatgttgacattgttgttaatggctattgctgtgattggagatgggattcgggatgcgttagatcctaagatgcaggattaagagagttcttcaaattcggtaagggctttgtaaagcttttccccgcccgggtagtcatgaatggaaagtactcgatggcagggaatcagtagtggtaaggggttttcttggcaggcgatgagcacctcttccgtatgggtttttgtgcgttctgcaatctcttcacaggtatgacgagtgccgaaggggatttggcgtatttcttgtaggattgccaggcgcttctctttgaaagaggatagatcaagaaaagatagtttaggcggcattttattggcgtaggcttcacaccagcggacaagtccttccatagccttatgtgctcctggtccaaggaataaacaggtaaaaacgggagcgggagagagccttgagtgaaaaatagaatctccccggaaatgcacaataatttgaatagggggagttctatttataggaagcccttgagagcaagcctgggccaaacagttcttggacgttggagagacaacaaagaacttttcagccatgacgctcccaaggttgaattatctggcggcactgagtcgttcaaacttgatttgcgagacaggtttgcctttgtaataccattcggatttgcatacccccgccgcatggattttgcggactccatgcaagatgttgtgctgccaagaaatctcttcagcgatattctcttgttcattgtatcggagttcgattccattttttgctccgcgtacaaatgggacttcagcaatcttacaaccatttttaaataagattgtaaggccgtcttgatgtccatatcgccattcttcaatcgtatttggaatcccaccaggaagataggtaaaccgaactccgtgaggtacccattgacataatgagtgacggtttcgggttctcgagtcgagtaaaatgtcgtttttttgaccattacgccatcattaaacgactcttctgtcaacaagatactatccgaagaaaaagtagagcgaactccctcgccgttaaggatttttgaagagtattttccattaaaagaggtgtaatgaccttccaatactcttcccccataagttttttctacaaagcaggggtctgtgattgtgtcagagttgttattgtcaggccaacgtgttagggagaaagacccatcttcgtggtaaactgcttctttagcaggcaaagcatttgggaagaaggtcttcttagaaagaagccttccctgatcataagtttctataacggccagggtagtagagtgaggaaacgttcgtgtgacttccccatgtaaagcaccttgcgcataaacttctaaggttgtagttccatctttgaatactctagtgatggagccatcgcatccacgtttgttccattcttgcttaaacacaatgatcccgtagttattacggaaagtctccttcattaacataggatccttttgaacagctccatatgctagaggagaaagggcgagggcgcagataaaaaataaacgcttcatgagttgccttgtcctatgttggctaatttcttatcaagtaatgcagttaaacgttcgtattcttcttctatttcctgcccggataaggttcgttcgtgatcacggaagaccatccgaagagaaacgtttttactttgagatgcagagtctctcccttgatatacactgacaatatgaacactttcaagccatttagattcgaaacttaaaagttctctgcgtacgagatctgctggaagatctctatctattgtaattgtaatgtctctggaagaggctggatagattggatagggtacgtaatgaggtccggatttcttttttaaagacaaaagcacatttaaagaaagctcagcaaagactacatcgtgtttgatctgagcttttctacatagttgtgggtgcaacgtcccaaagatgcctaatagatgttttttctgatacaaggcagcttgctgataagggtgaaagttcggatgctggctgggttgaagagaaaagtcttctatagaagctcctgactggcataatagtttttccacccatcctttgattgtataaaaagagagaggtgttttcccttgccaggaatcatccattacttggcgagagagtaaaatagcaacacgctcttcctcttggtaacggttctgctccttcgagtacacatttccaatttcaaaagcataaacatagggggcttgcctatggaggttagtagccgcactttttagcatcccaggaagaagggagtcgcgtaatttccaggaagaattctgtacaggaatcaaagagctttcttgcaaagataaggaagatacttctgtatccagcaaggagcaggtaaagaattgttgtagcccaccatttgctaagaaagctgtgagttcacgtttcaaagaatagatcggagtataggtcgggagtattttttgtgttttttgaacgaatggtgtggtgcgacagatctcttcaacaaggtcggtctcttcctgaatgtcatgacggtaagaggggacctcgactcgaacggcctgctcttctactgctgtttgaaatcctaaagaaaagagtttggcaactatttctgcggtcgagagctcaatatccagaagtcttttaatcgttttagggcgaacgcttaaagacaaaggaaaaaagctatcatctccaattttttgaataggagagatttgagcatccggaaatagagattgaatcatatggatagcagcatgtaacgctggtaatacgccttgaggatccactcctcgggtaaatctataggcagcttctgtgtgcagctgtatcgtgcgttgatattttcttacagcctgaggttggaagtaagcggcttccagaatgatttctgttgtattttctgagcaagaagatgcagcacttcccatgaccccagctaatcctaagatattatgctgatcagcaacgactaaagatcctgcggggagggtataggtttcttgatttagaagagtaagtggttgagctgactgtagagtagctgcatggagagacttttgctccaccgcttggctatcgtaagcatgtaggggctgacctaatgacagcatcacataattcgtaatatcaacgatggcgttaagaggtttttgtccaagagctgttaaggctgcttgcagatattctggggatcgtcgacaagatagacccgagattttgacggaatagaatacggggcaagctccagcatcgtgcatatcacaaatagaagtttcttgaggaagcgaggcaaaagaaaattcttccgggatattaagagatacaggggatagaaaggaaatttctcttgctaggcctagtaaggatgcgcaatggcctaaattaggggttaacgagcattctagggaagctccagcaagtagcatgcaggcactttctccaagaggagtatctgcagggaactcaaaaataccacgctgtgctttttgtaaatgagggaaccctaattcgtctgctccacaacacattccttgtgattcgagcccacgaattttagcttttttgattgtagtgatttctcccgaagcattacgtaacttagctcctggtaaggctataggaacaatgatgcctgctcggcagttgggagctccacagatgatttggcgcttacccttcccgtcaaaaacgatggcaacagtaagtctttctgcatcaggatgaggagaggcacttaaaattttccctgttacaacagtattaagggaatccggaaaaacatttgagcattccgcttcgattccaatacgatcacaggcttgtaaaatttcctcaatagagagaggagaagagaagaatttttgtaatagggataaaggaacgagcatgagtaaatgcagcttttttttggtagattttacgaagtggcgtgtatagtagcaagtattttgagggagagggatgtaggagttttatggggatagaaggaagaggatcaggagctatgcaaagtaaaaaaacgattaaatggctcaagcaagctctcgttcttagttctattgtgaatatcctattactgcttttgatttattcgaccgtatttagaaaagatatttataaattaagggtttttccagggaatctcatcgctaaaagttcacgaatagggaagattcctgaagacattttggaaagactagaaaatgcttcgtttgccgatttattagccttgttgcangaagagagaatggttttcggccatccattaaaatcttgggctcaaggggtgagcatccaaaaatattttgtagatatcgctcctatgctgacncatcntttaacttttattaaactcaaaagtcctgaacgtacttggttacttccggatattaatgatcaggagtttacacggatttgtcagtatttgcttacanagaggttcccattctcttcacgaggtttttttcgtattatggtgcgtgattgtgaagcaggggtggtggatgaagatgttctgtatcggttttgtcatcttcctgagtttctctatgtgcgttctctcctttttggtgcggaaatcgaagctgcttcggtcgcttctctggcaagaatgattatccaaggaggggaggacttattcttttccctgtgttgtttagaaaatcgtcaaaccgccgatttctgatcatcagaggcgctgttttctgaaagcttatgtggatagacaggaacctttagcagctcttctcttgttagtacatgacgcggactgggtgttgcatgagttttctgatagcgatttacaatcctttattcaacttttgcctagagaggcacactatactaagaagtttcatgggtgtgtggcacagtcctgtcgtcaggggattctgctagaggggtaggggaactgagatattcttcaacagaagttctagggacgagatcgatacctcctatgcaccaagggccgcatttgagtaagcgcttggcgatgagaaaaaggctttttctgagcggaggtttctttagtgcaacaagagcgtactcagagcatgtagggaaaaagcgacaaggagccccgagaaaaggagaaatcgcccaacggtacaggtgaacaagccctcggaaaaaagagctgatccgggaagtttgcataacctttatatgatgttaaacacgtctttcagtagtgtgaccaacacttctagagcgattaaccagattacggtccattctaaagcggaggagtgttgatggtttagttggtcattaagaatttcaagaacgtcccctaagatagcaagtctatgattcagcacgtttacgcgagcattgacgtctaggcaggttaaaacattgatgtaaaaaggttgagtttctggatgttcccagaagaaatctggttcatcaaggatatcggagtgtaggttcacagaagctttatctagaaacagttccccgattttttttgcaatcgttttacgggatagagaaattttccctttggaagctagttcttggggaagagatttcgagttttcaaccgttttgtaaatcgtttcttcgaaaactgtaagcttgatagactgagctaatccaaaggaaatagcaagttttgtatttaggttcgagttagtcagaaccagcctatcgcgacggatttggagtttctctccgtaatggaaatcgtaactatcgatttctgggttgggaagaggattgactgcagatggggtgatagcacggatcacttgtaattcttcagtttcttcccagccccagaacacgcaaacgccaaaggggaagaaaacagcagctttgtcgctttcatctagttcctctgaggaaatcagcacgtattctcgggatagaactgaggggtagtttacttttagaagatgaaagagcacgtgcaagtgataggatgaagcagtgcaataagctgaacagcgcatggtagaaattacatctatatcgttgaaaggaagagtgtctcatattcagtggtttcttacaataaggggataggcttttgcagagaccttttgcagagactttgtttgagtatgggcagatactgagatagagaggataagagttttctctgataaaccctccaattttttctttaaaatagataggaatttgtaagctgagaggttttttacttgtagtaaagagtccaatcagagtaagctggttcttcatgtcttcttttttgcggaagtggcggaattggtatacgcgctatcttgaggtggtagtggagctttccttaggggttcgagtcccctctttcgcaagatttccttgttatccagatcctctttttgcttttcattttgataatctttttatctttctagtatgctgacngtaggttnttgcttgcatagttcgttgtgcatgcgtagagctttgtttctttcgtgatggagaagagaggcgttattgtgcatatactagtttgtttgttgacaatcttcggaacgttgagtttacccgctttcggcgcgcattttcttgcggaagaagagcagttttatatggatcggtttgttttctctgggcagtatccagatatggaaactatggaaatccatgcagaaagaaaaaaacgtgtacaatttgatgtgacgggaagcttccctaagttggagagcgtggtttataagggatcttttggattgctgcgttcgaaaataaagggagagtgtccagaactgtcttctgtaaatctttcttgtacctcctgcagaatggatttagattttcgaggggagtggaaaaagaatgcgtctatttatattcgtaatgagcaagagccaattacaattatgttacctaaagacattggtgtagttgtctatacgcaggttgatatgaatagtaaagtagttgcagagggatcactaatcaagagaggaagaggtttttggaagaaaacttttcggaattctttggtaggagaatcccctgtgacgctaacttttcatgtagagactcgtaatggaggagttatttttctccgttagagaagcgttttccctttgtaatatagagaagaaggctcggatgtttctgaaaggaaggaggagaatagggcatctatttttgtatcgatgtcgatagggaattctgctagacaaacgagctcttggaatttttttgcttgtacgatcactcttaaaatatggtcttcttcttggctgaaggagatcgtttcttcatgagcatgtttttcacaaaatagagctccttcataacggtaaatagttgaagattctaaggaagttttacataaggtgcaggagcgcgatagatctaggcttccctcatgttgtaagagttttagtaggaacatcgaggaaaaaaaattagggtattgcgtttctggaattcgttgaaggaagttaaaaaaaagagaaaagagatggggagagggcttttcatgccattgcgttttgagaatcgcttgaatcattttccctgcgctttgcaaaagtggatacgaacttttaatcgttgtgaaaggattttggagctccccctgtatgacttttcgcattttgggaggagattgttgaatcgtgaaaaggctaaaagaaatggggaacagagactctcgaaaatcgcaggatagggatgctccattttttgcgaaggcagaaagaagccctgctggcgagaaaatttttacgataacatgttgtttctcagcgggagagtttgttagaacaactccgggaagggtgatttgcatgaaaatgtatggatatagaagttcatcagttgagaatatgaaggaatcccttggtaaaaagcgaatgtttttgtctttggggataaaaaacctgtgagctgagagtttgcgctaattagagatagacagggggccccgataaaatagttatagctaatcaattgactgaaagagagagaggtcactgttttcgctttacattctattaatagtaggggctgaggatggggaaaagaaatagaagcaccttctgaagagacgtaagaggagggagataggataagtacatccgctcttcctcgcatttttttagggagaggcgggagtgatgctggaatacaagatttgattcctttttccacaatgatctgttgttggggataggagagctcttggatgagaaacgagagcaaagcctgtctaacgtgctcctcgggaaagggagggacgggtttacagcgaataggatcgaagagacaatgcgcatctgtaggaggggtgctcataggattaaaaagacttctgtgattagcgagctataacgggtcgcttatactagaataaaaaaattgaaaagaagttttagagaatgcgcaccgaagagggttcgaacctccaaccacctggtccgaagccaggtactctatccagttgagctatcggtgcacaaggaagggcccaaggttaccagaaaagcttctgaaatacaagaaaaactcctgttaagaatcattataagagagcgagcatagaaggagtgatcgcaggatcgttttctagaataacagttcgttcgagtacgttagagagttctcgaacattcccaggccatgaatagtccaaaagatttctttgcgcttctaaagacaatgtttttggaggcttattattcatcttacaaaatttttctaagtagtaatgagctaaagggaggatatcttcttttctatcgcgaaggggagggatgtgtaaagagatcacactcaatcgatagtagagatcttgacggagaactttggtttcaatagcttcctcaaggtcacgattggaagtggctagaaatcgaatgtttacagggagggtttttattcctccaatatgtncgaattcttgttcttgtattgcccgcaaaagtttggcttgcaaatggatcggaatttctgtgatttcatctagtaaaagagtgccttggtgggcgagttcaaatcttcctactttcttcgtggttgctcctgtgaaagctcctttttcgtgcccgaaaaactcagattctaacaaagtatcggggatagcagcacaattgactttaatatagggcttagtagatcgaggggagtgcttgtggataaaaaatgaaagattttcttttccgcatccggattctccgtgtacgaatatattcgcagaactgttagccgctcggcgagctttatcaagtagctgtttcatggaaggactttcggcgatcagaggatgtgagatggaggatccttgtgattgtagaaataggttgtcttgttgtagcgcttggagttcttcggctttagcgattaaagtaaaaagggcatcgggggaaaacggtttggtcagatagttaaaagctccgaatcgcatagcttcaacagcattttgaatagttccgaaagcagtaatgaccaagataggggtttgcggacgatgctgttttgtatactggataatatccaatcctgaaccatcaggcatattcatatcggaaataatcagatcgaaaggacagttagagatctgcttaatagcttgtttgactcctggagcagaagacactgaaaagttccgagcgcccagtatctcagaaagaagagccaggatatggggatcatcgtcaataataagaatgtgttctatcgacatggggtttttcagaggtgagtgttttgcatttgataactgctcttaagcaggagtccataggatggtaaaggtagtacgattatcctgggttgaaacaaccagatctccgccatgcaggcgcatgattttatgagcctctgctaggcctagaccgttcccttgaggtttcgtagtgaagaaaggaataaaaagcttntcttggatattaggaggaagagtgccggtattgataacgnaaaaccctttttcatgtagttctagaaagatttcttcatccgatgcttcgacggcattttttacaaggttacatatcacacatcgcaagcgatcaggatctatagagcgctgtataggagataagatggttcttctaaatgtacaagaaggaaagttaaagagagttctggaatgagagaagaaaagaaatcctgtaggtctatagaacgaaggttcagaggttgaatttttgtatattcaagcatagaagaaacaagagaatttaatgagcgagtaccttctatgatgacattgagcatgcgttggtggcgttctgaagagagctcttctttcagtaaggttgcgaatcctgaaatactagttagaggattacggatttcatgtgctagagttgcagctattttccctaactcggaaatgctgcggtatttttcaatcgcttgttctaattgcctatagtccgaccggtcgcggatgagaaggaagaggaagccgtgagagatatttttcctaacaaaaacttctacctctttttgggagagttcttgagatagggttagtcgaatcgttttaggagggacttctttttctaaagcttcttgtactgagaatccaaaaaaagtatcggggaaaaaatcatggaacctccgtgtgaccagctggatgtccttagggatgcctaaaatagcgcgggcttggggattgcaaatcagaatctctccagattcagaaagtagaaaaatgccatcgggaatcgaagataggatggtttgagcttcgttatacgattgtgttactcgcgtacgaatggccaaaagttcggtattggaaacgcaagaatcacaagtgtcgatttttggcataagttcccagttctctttttcttatacaatagttttttttgtctgtttctagaatgcgctgaataacagatcggatttcttccagttcttcttgcacttcttgaggaagtgctaaagagaaactatcccgaaattttttaatttgatggtcgactttctctatacaagataaaagagtttttttctgccgtaatactttaatgagatcttcgggagacagcgaanttcgacttgagttagatcaaggattgataagaaaaagcctttttttttcttcaataaagggagaagagcggattctttcataaaagagttgcctgttcgcgttctctttcaagaaaagggtcctacgaattattagcaatataaatcatgaaatgtgattaatgccggcgattggactcgaaccaacaccttactgctaagagtagattttgagtctaccgcgtctaccattccgccacgccggcataaccatctaggtctgaaaacagaagaagaaatagagtttcttcccctgacaggaaatatccttaagaggacaaagtataagggagagaaggtttttttgttaaggaaaatacgctcagcagaggtatttactcatgatgaacttcaataaccagcacaggtttaccctttttgaaggtagaggtgatgataaaatcttcattttgaattgtattatgagagagggtgaatgttttagaaggaagcggcaagcctctatacagcttagagagaataggagccagcatttgaggagatactggttgttgagtagagactattgctgctaaacctttgcaatgttgttcggatatggatgtatccgaagttaggagaaacttatagtgcataggacagcaatatccctcttcaatagtaatagggaagtgatgatgaatgtattgtgcaatagtcactaggagtggatgaatagaaaagggtttggctaggtgtttgattccattgcagtcgaagacaagcgtttcttctgtagatagtgatccagacgtgccatggcagtggaaagagtagtttgtaatgaccggggatttaggagtaggccagtggtatgtaggagcggagcgaggctcgatcacggggtaaaggatcagtgagcctgagctttgtgttgtgatgcgggctgcctcgatataagaggtttggcgattgtctgttgagcaccctgataaaaggctcgatagacataacgtaaggaggagtattaggttcataaagtttcccgctgaatggaaaaaggcttatatattcgttagagaaaaagtacaagatctagtactttcatccctgataggagagagaagctatgcgtctagattcttatgaggtatattttttcgacttagatggattattaattgataccgagcctttattttatcaagcctgtttagagacatggcagaagtataaggtctctgtcgaactctcttttagccaatattattctttagcgatgcaagggagggaacgatttcaagaggctttgatacagctgttccctgaaacacgagcctttnncccaagttattttttagatagagatcggtgttaccatgatctcctatcttgtgagcagatacagctgatgcctggtgtggaaacgtttctctccttattggaaggaaaatgtttgggtgttgtaaccaactcttctaaagagtctacgctacgcatccgtaagaacatccggttttagagtgtatgcattttggataactagagaagaatatgcacgtcctaaacctgccccggatagctatcgattagcatggaatcgttttgtaagagaaggagatcacgtaatcggatttgaggatagtgtaaaaggattgcaggcattagccggaatcccagccactatggtagctatcaatgcagaacgatctctagagcaaacacagtccttattccctggaaaggagtattattacttcccttcgctagagttattgtgttcatgcttgcagaaccactgataggggggaggatagcatacgtggtgtaaagatagtccgtacggaggtgctgaaggaggacctttgcggcgatctttggttgctagcatatcgagaagatgttctggaggatatttccctttccctatatcgagaagagctcccacaatattgcgtaccattttgtaaagaaagccatttcctctgcatatgacagtaacgagatgctcttgttctgataaatctagagtatagagagtgcgtatcgtagaagagtactctcttcctagattcgcaaaagaagcaaaatcatgtgtgcctacaaggtattgagctgcttcttgcatacgcgctatgttgagtttataacgaggactaaaacagaataggcgatgatgagggagaggtttaggaagtagagatagcgtatagcgatattctttggctatggcagaaaatctagaatggaaatctccgtcggtcatgacagcatcgcgaatgacaatatcatgaggtaatagggcgttgagcatcttttggatttgtctgggatccgtgaaatgtggatggtctgggcaatggaaatgagcaatctggccctgagcatgcacgccagcatctgtacgtccagaagaaattacagaaatgcgaaagcctgctatttttttaaggattgtttttaagacttcttggatagaaagggcattaggttggtattgccatccagagtaggatgttccttgataagcgatttgtaaaacaattttttttgtcatgggaaggcttatttataggtagaggacttggagagaagagtttctgcgaataagaggtcctcgggataagtgactttgatttgtactctgttgctgaatactaaggtaggttctatgccgagtaattcagcagcttctgtatcatcggatagagagaaatccatagcgcgggcaaggagaagtccttctctcaggacttctgtatctaagcattgaggagtatggataactgctaaagcatctctatctaaggtgcgaacgggtgcacatgatttaatagtatacgttgcaggggaagctaaagctgcagctccagttttgcgtgcagcggagcaaacttcaatgacttcgtccgcgtagacaaagggacgaaccccatcgtgtatacatacccaaggggtaaaaacttgttgtaatccagaaaaaacagaatcttggcgtaaagtcccgggagacgcaaattttacagaataggggagaaatagttcccggtactgctcttcgcagacaacaaccacttcttgaacaaacggtaggcgttggtaggcatgtaaggcatgaagaattagcggctccccacaaagatgtgtgtattgctttggttggagggaattaaaacgctcgcctttccctcctcctaacaatacgagggaacaactaaggttcatagaggcacctcattaaacaaatctctggaggggagcaaaatcgtatacgcttccatcctcctagtcctcggtttacatacaagagcctactctcttcagggaaagagaataatcctcgagctagctctgggttttctaaccccgaaagtttattggttatcgtattggcaaacttaggccagggaagagagatttgagggccatgcgagtgcccggaaaaaacaacatcaccagggtaatcttggagatggtgaatcgtatcgggattatgagaaaggataataccaggtaacgtgggattatagttagtaaaagctttttttggatcgaattgtttggcaaaaaaatcgcctaatcccacgatgttgattgtatcggaaagtgtcgcgctttgattatgcaataattgaaatggagtattgcgtaatatactgactagatgtggattaggaatttgtggattcagagtatctgcaaattcattgcgagaagaggcgaatagactttgataaacagaggtaaaagctctttttaaaggacggctattcattgctgagatggtattaattttcccgtgaatatcacgggatacgtaggtggcgtaatcatgatttcctaggcaagcaaaacagcctaagggcgcatgcagagaacataggaaatgttttaatctttcaggagtttctactttagcgcgacagacaaagtctcctgtaaatacaagaatatctggagaaagagaagagatcttgcgagatactttttttagaaaggcatcaggcgtcgagtggtttaggtgtaaatccgaaatctgtacaatgcgaagcccatgaagatgagcaaattttttaggcagattccaatttaaacgcgttactctcaataggttaggctctaagtgattggcccaaacccatgtcaaaagaggtgctgctaagatagttgttaaagatacagtaatacccacaaaaacgaacaaaaagaatgaactagttcctcatcttaaagacgaggaacacgtgagtcaatttctattttatttaatgatgtgttgagaaaccatttttgtcatttggaacatatcgataggtttttcagttccaaaaactttagccaatttatcatcgggattgatattacgtttgtttgtaggatcttgaagactattctccttaatgtaatcccacattttcttaatgatctctgtgcgaggcataggtcctgcaccaacgatggcagctaaatcagcggatacgttcacaggctgcatgaaagcagagttcttattttgactcatggatgactcctagttaaagaaggtgataagaaaagttgagggctcttccttcgcaactcttttatgccttaactaggtttatcgtcaaaataaaaaacatagccaagtcttcagcaagaagagaggtaaaagcgaattagaaaacgatttattcctcggactattacgcaagaaattgatccctaagagaagatcatgttaccatgagcgtgttttagctgtcaccgccaccgtaatagtggaaataactggcaaggaaaatagctctttgaaaaagaagagtttgaagttggatattttgcgaaaggttagcaagattatgcatgagaattttgacaaacgattggaagttttgcttgaaggtttggctttaactcggaggtctctttgacccggaaggaaaagaaaatgagttaaaggaattggaacagcaggcggtgcaagatggtttttgggacgatgttgctcgtgcagggaaaatatccgaaaggatcgctcgattaaaacaacagttatcagaatttaatgaattaaaaaacaaagtttccacgatacaattctttttagaagatgaagagtcttctaaagatttagaaatgcaaaaagaattagaaaaagaatttgttttttgtgaaaagaaaataacagaatgggaaacactcagacttctttctggtgagttagatcgaaattcctgttttctatccattaatgcaggagcaggggggaccgaatcttgtgactgggtagagatgtgctgcgcatgtatatgcgatgggctagtagtcataagctggagggtagaagtgatcgatcgattggatggggaagtcgctgggattaagcatatcaccctgaagctcgtcggtgaatatgcctacggctatgctaaagcagagagcggagtgcatcgtctggtacgcatatctcctttcgatagcaatgcgaaacggcatactagttttgcatcagtagaagtgtttccagagattgatgataaaatagaagttgagatccatcccggagatattcgtattgatacgtatcgttcttccggagctggaggacaacatgtaaacgtaacagattcagcggtacggattacacaacntctacgggaattgtagtgtcatgtcagaatgagcgtagtcaaattcaaaaccgagaagcttgtatgaatatctgcgcgctaggatttaccagaagttgttacaagaacgtttagagaaacagaatatagatagaaaaaataaaaaagaaatcagctggggatctcagattcgtaattatgtatttcagccttatacgctggtgaaagatgtaaggactggatatgaagtgggcaacatccaagcaatgatggatggggagcttctagatgcttttatcaaagcctacctggttgattatggagaaattacatgaccactatgcgtgatccattattagagattcggtatacggttcctgaagatgcacactatatgcgtctttggttgaatgatccaaaaattcttcgaggatttcctttaaaaacagaagcggaaattcgtgatagtgtgaatttctgggttagtttttatcgctgccgcagtagtttaacggcggtatacaatggcgaagttgctggagtagctacgttgatactcaatccttatgtcaaggtcgcacatcatagcttgttgtcgatcattgtaggagaaaagtttcgcaacaaaggcgttggcacggctcttctgaataacttactgcatctaggaaagacacagttaaagttagaacttgtgtatttagaagtgtatgaagggaatcctgctattcacctatatgaaagatttggatttgtggaagtaggaagacagaagactttctataaggatgagttggggtatttagcaaaaattacgatggagagagtcctctaggttttccatagagctgaaacttgcttttgtgtaagatggttgggttattgaggactttgtttttaaaaaattccgcccttttttggggatcctgtttcagacatagagtgtgtttgcggacagagtggtaaaataatttgtcaggggtttcctgatagtagatgtacgataggtaagaaagcatggcaggacacagtaagtgggccaatactaaacaccgaaaagaacgagcagatcacaagaaagggaagattttttctcgaacgattaaggagttgatctctgcagttaaaatgggggggccggatccgaaatcgaatgctcgtttacgtatgatcattcagaaagccaaggaccagaatattcctaatgagaatattgaacgtaatctaaagaaagcttcttctgcagatcagaagaattatgaagaagtcacttatgaattatatgggttcggaggagttgggatcattgttgaagcaatgaccgacaataagaaccgcacagcctcggatatgcgcgtaccgttaacaaacgaggtggggctttagtggagcccggtagcgttctatataatttttctcgtaaaggggcatgttatgtgcctaaacattccatagacgaagcttccttgttaacacatgtgattgactgtggaggagaggatttagatagcgacgatgaagaattcttcttagttctctgtgaacctacagatttagcttctgttaaggaagctttattagctaagggagtgacctgctctgaagagaggttaatttatgttccgttgcgccttgtcgattgtgatgaggagacagggaagtcgaatctcgctttaattgaatggttagaaaacatcgacgatgtagacgatgtttaccacaatatggcttaggcattcacgagcagaacttatctgttctgctcgtctgttctcctttgctttttatcctacggtatcaatcagtgagcttagcgcttgagttgtttgggttgctgcttggaataaatctcttccaacagaccccttcccgtcgtcattgactagggatgatagtttttggccttgtatcgcaaggttgactttccctgcaacatttcctaaggcttgggtgactgcggcagctgcttggaataggttgcctttatctccccctgtacctgttaagacctgtgcagatcccggcttgcctggagcactctcaacggaagctacgattcctcctgaaccagtttctttgcggaatttgtttacaatcgagccaagctgaggctcttcagtacttacgagatcgccttgcccatcaaaggatatgtctaagtgcgcacgtatacgagggagcagcttttctaacgttcctcctccaggaattcgtcctccgccaccagttgttattatgtcagctttgattggtcctcccatcatcaaggatgtggtggtagctcctgtgcccgttcttaatgttgtagttgatggggttggaggtggtgaaggcagtagtgtttgtacgctaccacttcctcctgctgatcccgttgaagaagtgcttcctttccatggggatacaacggtttcttgggatgtccctgttgtttccatatcctggacgatatctccaagagtttggttagcttggagaggtccttctgtagaaccaccattgtcgccagggtaaacgacgtctaggtgtttacgcacggcagaaaggatatctttcatagcaggtccgtcatttccgacagaggcattcttgtctgattctgaggaagagacacttcctgaatcatctccagaagaggattctgtttcggatatatcgccattgactccaccagctccgtcagagtctttgtctgtcgtattgatatcatcagtttggttgttggtatttatgttatcgatatcgcttgtatctgtagaggcgtctgtagattgagttgttggtgtggtgttagtcgtgttgacattcgtatctctaatattcacattagttccgccaacgttgacattgacattgatgacaggaatagaggatggcgttggtgatggagcagctgcaggaccagctccaggagtttcattggagaaggaaatgccatcgtcttcgctactaggcccggcttgagttccccagttgattttattaaagtcgttggctttctcaaaaatttctccaaaatttacttgatgaccacgtctccaagcagaaggtgtataaccagaacttgcttcccggctattccaaggaccataagcaacgcaagttttgaatttattattgataatcactgtattgggaagattgcctccgctggccactccagctttggctgacatcataggttctacacgactgtcccagtcaccagagaatttgttaaaccctgtacagaattttgcacacatgttttccaagtctttgatgtcgagatcttctttggtctttccattttgaactttaattgaacagacttggtcccaatttccgttaggaacaagaatgaaactacttctatctgtatcaatgaagacgaaatgccccgagttttcaagcattttcnactttacatgagggttggagaggaaagtcaataacgaggttttatttgtaggatcgtatgaaggaagagacatgtctggtagtccttccggtccagggccgaatacaccctcgttacgaggccctgttgtgtaggaggagcctctatagagaattgagtgctgctgctgcaccaccactcgtattttctgggtcacttatgctagagccatcaatactctcataaatattctcataaatagattcagtagtgcttatcggctcgtaatcagcagcagcatcgtcataattgctgtaggaggagcctcttagagaattgagtgctgctgcaccaccactcgtattttctgggccacttgtgctagagtcatcaatactctcataaatattctcataaatattttcagtagtgcttatcggctcgtaatcagcagcagcatcgtcataattgctgtaggaggagcctcttagagaattgagtgctgctgcaccaccactcgtattttctgggtcacttgtgctagagtcatcaatactctcataaatattttcagtagtgcttatcggctcgtaatcagcagcagcatcgtcataattgctgtaggaggagcctcttagagaattgagtgctgctgcaccaccactcgtattttctgggccacttgtgctagagtcatcaatactctcataaatattctcataaatattttcagtagtgcttatcggctcgtaatcgctagggatatgatcgcttgatgaggtagagctagtttctgagctttctgaagtatctggagaagtgatttttccagcaacggcttgggaagttttattcgaagtggctgtggcttgtgtggaagaagaggaggtcgatacagttacagtgggggcggaggctgaattcgtatagtttactacagtctctccagtcgtttggatagaagatgtagccgctgaatttgttgcgtttgctgtttgtgtaactgtagcgtttgcggtagtagatacagaagaagctcccagagatccggaagcacctgatgccgaagtggttgatgatgtaaaagttgtaacagtaggttgatcacctgatatagaattcgtcataactacaaattaaataaaaacaacagccgatttaattagattttaaaaagttgtttttattatttgctacaaagtttatttttgtttgttttttaaaaacaaacaaatgtctctttgttaataagatgttttttttagaaaaataaagttttcgtgaaaaataacagcattaccgggtaacgtttgtgaagaaatgcaatagaaggaactgaaatgcctggtatcaaggtttttggagaaacggtcttaagaggatctgtgcgcgtgtcaggagctaaaaatgctacaactaaattacttgtagcctccttactttcggatcagcgaacgattttaaagaacgtccctaatattgaagatgttcggcaaacggtagatctttgtcgggttttaggggcgattgtagagtgggatcagcaagcgcaagtgattgaaattcacactccgcgcattttattgtccaaggttcctccgcaattttcttgtgttaatcggattcctattttgctgttaggagcgttgttacgtcgttgtccttatgggatttttgttcctattttgggaggggatgctataggacctcgtacgctacatttccatttagaaggattgaagaagcttggagcagagatagtaattagtgatgaaggctattgggcttcagctccaaatggtcttgttggagcacacatcacgttaccctacccttctgtgggagccacagaaaacctcatccttgcttctgtaggggctcaaggacgaacgattattaagaatgctgctcttgaagtggaaatcattgatttgattgtctttttacagaaagcaggcgtggagattacaacagataatgataagaccatcgaaatttttggatgtcaggatttctattctgttgagcacttcattattccagataaaatcgaggctgcttctttcggtatggctgcggtagtttctcagggaaggatcttcgtagaacaagcgcgccatgagcatatgatcccttttttaaaggtattaagatcgataggagggggattctctgtacatgagaatgggatcgaatttttctacgataagcctttgaaagggggtgttcttctagaaacggatgtgcatccagggtttattacagattggcaacaaccttttgccgtattgctctctcagtcagaaggttgttcggtgatccatgagacagtgcatgagaatcgtcttgggtatttgaaaggtttggtaaaaatgggagcgcattgtgatttatttcacgagtgtttgagtgctaagtcgtgtcgctattctacagggaatcatcctcatagcgcagtcattcatggtccgactcctttgcaggcaacagacttagtgattcctgatttgcgcgcaggatttgcttatgtcatggccgcactcattgcagaagcggagcctcatggattgagaataccgagatgctggatcgagggtacactgattggcgagggaaattagaaagattaggagctaaggttttagcgcgagacgcagtatctgtgtatgtttaagggaagactcgaagagcttcccttaaatattcatatgttacaggtgattcaaggttttaagacctagtaagtgcatacctgttgatagcgttcgttcggtaagtccgcagagataaagacgttcttgctgagaatcggatccttcgatatggcaatcgcggaagaaagtattgaacttattggtgagtgcatagagatagtcagttaggaantgaggacagagttctctgagggtgaggtccaaaatttcagggaaacgtaaaagagtaagtntaacgcttcttctgcaggctcatgaatagcaagaggcccttcttgaggcagagattctaatcccattctgcgtttaattccttggatacgtacataggcatacaggagagacatcgctgtatttccttcgaagcggagcatcttctcgaaagagaacacgtagtcattgattctatgagaagaaaggtctgcatatttaattgcattaataccaaggatagggccttgatatgccagttcttcttctgagatgtctggacgatgtgcttttagagactctttcgctttttccactgctgtatcgagaagttctcgtaatttgatgttctctcccgaacgtgttttgaattttcttccttgagtatccaagacaagtccgaatcctacatgtgaaaagatccctttagaaggaagatagcctgctgctaagcacgttgcttctagaagctggaagtgtaaggattgtcctgagtctgtaacgataagaattctatcggcctgatcttgttggatgcgataggcatagctgcgacatcggttgttgcgtaattgtatccgccatcactcttttgaatcatgagaggaatagagaaggcttcatggaatacgcattttgcgccatcagaaagcgtgacaaggtttttagattctaagtctgcgacaacctctgctaggaaaggattataaaatgattcgccgcgtgtatggagctcaacatccaaaatcgagtagattgtctgaaaggatttctcagaaacggaacagatttgtatccatagtgcaagagcttgagcatctccggattgtaaggctacaacgttatgttgggagcgttttttaaattcagagtcttctgcgaaacgcgcgtgagcttttttatataatgcagtgagatcttctagttgatgaatcgcctcctgagaggtctcttgcagataggtgattagcataccaaaagctgtaccccaatctccaatatggtttaagcgtaagacgtcatggccgacaaaggaaaagcatcgtgctaaacaatctccgataatcgtggagcgcagatggcctacatgcatatctttagcaatattaggagaagaaaaatcaataataactttttgaggagacgcagcacgaaacccatttgctaattcttttgagaaggtttggagctgactagctaggaattcttttgagaaagtaaaattgataaatccagctcctgcaatctctatagaggaaaaaggagcgggaggaatatgcgcaacgatcgattcggcaatggcacgaggggatttgcgtaatacacgtgcaagtttcattgcatcgttacattgataatgtccaaaatgctccttagtagagggagtgatgtctaaggttagctcttccaactcagggaaggcttgatgaatcgctgcagaacatagcgaagtcagaaaagaaagaagtgttgtcataagaatctataaaactaggggatttctccaatgcatccttgttggaaccaagtacgaagttcggtgatcttggtcataatgcggtcagttgctaattggtaagcctcttttttatcaatagcagggttatctatgaggtcttggaatgaaataggcgagcctattacagtagtcaaagttctccaaagcttaggaaatttttggttcttgccgaaggcttcgaaagttcctgccacgtaaacgggaataacagggacattgcctttgatagccagcatacccacgcctactttgccttgatgaatttctccgtcggcatgacgggttccttcggggtaaatgatgagcctccctccatgggaaaagatatttagagcagctttaaaggccgcagcatttccagcgtttctgctaattgggtagcatcctaattcacggaaaagcctgttagtgaatgaattagaaaacagtccggacttagctagctgatacaatttccctgggaaagctaaagggattatgatggggtcaagaaaggaaacatgattcgctgcaataatagcggctcctttcacggtagcgcttgctttcgacctcaggatttttcttctgtaaaacagagggaacagtaagcgaacaaggcttttggcgatagtaaaaatcatgttaaatgggagggtatcaaaggtaggattttctccagaatttggcttattgtcaaatcagaagagtcaataactatggcatcttgagggatcacaagaggatcgcactctctttgttgatctgcttggtcacgagcaatgagttctgccattaaagcctctttaggcaaggaaccttgagggaggtcttttaggcgtcgttctgcacgaatctctggtttagctgttaagaagatttttacttcagcatgggggaacactttcgagcccatatcgcggccttcaaatacacaattccctactgtcgcgtattgcttttgtaaggtttgcatgtaggctcgaactagaggctccttagagaagagcgatgcaaaattcgctacttcttgagagcttaactcggaagtgagaaggcgatctccatagaaagcttgtaaaggagaatctttagaaaaggagaaagaaaaaggaggtgaagcaagaaaatcttctaatgggacttcttgccaatcaggctggaggcgagcgtaggcaagcgttcgatacatggcacctgtgttgcagtaaagaaactgcagcgtttgagccaaagcttttgctagcgtactttttcctgttcctgacggcccatctatagtgatgatcatcctaaaaatgtcctattttgagtgataaggaggatagcgtaaacgataggagtcgaaagaagcaaggagtctagcacatctagcattcctccgatagactccagatcactgctgttcttaatctgtgcatcccgtttgaacgtagattcgataatgtctccaaagaatccactaacgcccaacacagtacctaaagcaacgaggatccgaggcaccgcaatctgatcagcaaaggctttaggaagatgggagtagaaaagaaggctaaccaagatagatccacagcaaccagcaatgaagcctactactgttttgttcgggctaatgactggtgcaatgcgttttttcccaaaagcttttccaaagaagtaaccaaaaatatcagagctttttgttgtagcgataagaaaaatcgcccaccaaattcctacaaatggagtatcggtatgcacaaacccatacaaaatgtggaggaacaagcggatagggagtgatacataaagcatacaaaacaacgcgagcccagttgagcctatgggaccaagtttataatggcgacttttaaatactaagcgaatcgtccaaaagaagagaaagaaccaaggaagtaggtctatatgctctggaaaatacattttacaacgagctgtaagacaggtcagagcaatgaaaatagcggatcctaatgcactatagcgtgtgaaagaaaatggaaacttgattctaaccatagcccccatctcatatgttcctagagctgcgcaagcggaggaaagaagccctacaataaaggctgagctgggatataaagatgtacagagaagaatgacaaggaaagtaagaagaatcgagtggacgaccagacgctgacacaaatcgctttgaaaaatggaattatgatccgaatcgaacatagcgtttatttacctccgcgccgtgatcgttgttggtatgttttaatcgcttctagcaagtcattggctgtgaaatcaggccataacacgtctgttacataaagttctgtataggctatttgccataagagaaaattactgacacgcatttcacctcccgtacgaataagcaaatctgggtcaggaaggccagaagtgtctaagtaggagctgataagctcttcagaaatgtcgttgaccgagatttttttacttgcaagatcctgatgtaattctttgaatgcgcgaacaagttcgtctttacttccgtaattaatcgcaaaaattaactccatgcgggagtaatgagctgtcgcggaggaggcttgctcaatgttgttttgtaattcttgaggaagtttcgataagtcgccaatacaccgtaatcggatctcccgatcatgtaggaaagagagnctctgcgcaactgcgagttgaataaagaaaataattctgcgacttccgatttcgatctagagaaattttctgtagagaaagcaaatagcgtaagagcctctacccctaggtgtaaagccgtgtcaacaatttgtggaatgctatcagctcctgacggtggccagatatagcacgtttctgacaaaattgttcatgttttctttgccaacgacgattcccatccatgctgatggcgatatgtctagggagggaactcccttgcggaagattttcttgaattagggtcgcctgttctaaagctagagacatacgcagtctgatattctatagtggctggagatttggctgttctctgagaattatagggatccatatccccctttttctaagaaaccatccccatatcgctagtaggaagaggtggcgactctggtagagggttcttagaactcagagcagggatggtacccatagataatgattattatcaagtctcctctgaatgtagaaaccagttcttctaaaaatctattttaagcatcagcaaaataaaaatttttatatttgaagttttgttttgatggttgcggtttagcagcttagtttggtaaaatggacgaacgctcttgttattcattaagagcaaataccttagatctctatttttgctttcgaagctttcaagtaagtccggattattcggcatgatagattggttagttagacagaaatagcggctttttttgcggtgatgagcaaggaaataagacatgaaattaccagaagtgagttttagtttgcctacagctgtttgggcatcttcaacaaaacgtctaagtcaagaaaaagagttcagttccttggatcgtgtacagtcaatgaattgggtgcaacgaatagtgccttcattgatcgttttgctagggatttctgttttgggctgtagcgttcttgctttctgtacgtgtttaacagttttaccaggactaggcttagtaattttgggctcattgttgctttattgggcgtatcaccagatagctaatatgcgtgttcgtatggctctttcttttgaagcttcttctgaagcgcctattcagtaagcagttttgagaaacagtttgctgttgatttttttagaagtcttcagttactcgtgattacccttgattataaacgttacaaaaaacatactgagctacaatttttttgacgtaacaaagggtgtggtccagggaacgctttcctggtcgagtcgccgggcgagagttttcggttggttttggtagacaagcattgaaagctaccgtgttgtccaaaaaattgcagaaaagattccaatccaaatttgtctctggacgtcaaaaaatgggggagactccgggctccttctcttgtcattgagagggctttcttttgtcaacatatatgttttgaagagcctagatcttccttcccgttgcttgagcgttgggctaagtagcngcatnngcnnaattcacgaataacgaagagcctcataatgaagcgtaattttaagcgaaatctcagcattattattcttgtttttgctttggctttgtatcatgtgttacctacatgtctatactattcacgacctttgaataganaantngatggacgagaggctcgcaagattatagangtttcacgcgacaagtttcggatgcacggaatgatttgacgctgcgtgttgcgaaaattttatccacgttaaaattacgcggggatataaagcngcatccaagtattcctggaattgtgaatgtacattttcctttagcagaagacgctgcactatttattgataatgtagtgcacggcgagccttctgttcctgtcaagtctgcacgattgtatgttgtagggagctctgagttcactggagagacagttgttcaaatttccggaagtttagtgacttctttgacagaggaagatctttcttttgtctcgtatgaagataaagatgttacggtttcgcaagaattagaaaatctcgcaacaaacttatttatcgagtcagaacgcccttgtgagtgcggatactattctttatgggattctatgcctattgaaaaggttatccatgtcacacggaacatttgttctggcttgcgattgctccctacaaggaagactcaagtttttctatctcggtgcttggggacggagcgcgattttacagcctttttggcaaggttggaaaaagctttacaacatgaggaagtgaaggaagctcgagaggagcttaaagatgcttcttatcttttacattctcgtaatttacgttggaattcgattagccctaaagtcgtagggaatgttgttgattgtagtgaactctctccttgtttttcctcaatgtccttgactgccgatgggaagttgttattccatttcgacgcggaagtagctgctaatcgtcaacagttagttggtaatgagcgtttagatttagagcgtctgtttgctatggagaaacagcacatagctactcgcttgaatcgttctgttgaagagacggaatttggttttgctgtccgattaagagatgaggcggctagcggtaaaattgttttgcaggggcacagagtttgtcagcgaatagtggaacatttgactgcactagtcttgaatcgtcctcttgcggaaacttgtgatttatccacagaaaatttccctgtgtatggtagggagcctttggatagcgatgccttaggatgctttattttctcgccggagcgaagctgtcggcatttttctaaaggttctgtttacattgtatttaaaggtctacgttcgattgtagcgaagtatgaacatgccggtgctgaagaagctgctcttttacaacatgatctacaaaatttatatgcatgttttattcatacggatgcagtttcgtggagtttgggagaggatcgtgttctagagattaaagagcctttgcaacgtgtcattcgaatttggggagaagagtttgttcaaagttttgggaaggcatctcttgaagtccgtgatgtgcgtgaccggttagctgtagtaaatcgtattgagaagactcagcatgccgagctagttcgttgggatgagcagtatcgacaagcgcaatgttctatgaatccacaggttcggttacgagctgcaattccacataagaatgttttctttgagaatttgaaattgaatatcagaaaatattctcgaggcgagcatgttttgcggtttggcacggattttgtaggagggaaacagattcggattgctttccgagatcaccaagggaacttattaaccgataaagcggggattgataaagtttctgatgagttatatgcccgtttgaacaaactaggggtatccgaagtagggatgcaaagggaaggtgatcatatacaggtgagcgttcctggagcagcaggtatttcttctgcagacattttagggacttccaaaatgtctttccatgtagtgaatgagcaattttcctcaagaagccctctacgttacgaagtacaaacgtttttagattacctttggtttacagcacgtagtctggacgaatgttctcctcaagctatcaatcgtttagcgggagctcttttccatggggataatggctcagctccagctaatgttcgtgtagcagtcgagaagttaagagaagctggattgagtttttctaaagagctagaaggcggttctgcttctttagatacacagtattcaatgattgctattgaaaaagagtctagagagcaggttaatcctctcatgattgtatttagaaatcatgccttagaaggagcttctcttaaaaatatccgtccagaatttgcagtaggagagggatatgttttaaattttggggttaaggataaagccactttttcggacggtagagaaacgcctgtgcaacaatttcatgcttggacatcaaagttttgccaagaaggggttagtggtacaaaaaatggccttttctctggagggagagggtggcgtatggctgtcgtattagatggctacgtgatcagcgatcccgtgttgaatgttccactgaaagatcatgctagtgtttctggaancttctcatacagagaagtacatcgtttagctacagatcttaaatctggagctatgtccttcatcccagaaattttaagtgaagaagtggtctctcctgagttgggaagttctcagcgtgtacaaggaattctctctgttgtgttgggacttgtagtgctcatcgtactaatgagtgtgtactacagatttggaggtgttattgcttctatagcggtgctgctgaatctattgctcatttgggcttccatgcaatatttggatgctccacttactctatccgggttagctggtattatcctagcaatgggaatggctgttgatgctaatgttctagtctttgaaagaatccgagaggaatatcttttgactagaagcttgtcggagtctgtagaagcaggttataaaaaggcattcagtgccatttttgactctaatttaactactattttagcttcagcattgctgctgatgttagatacaggacctatcaaaggtttcgcgctcactttgatcatcgggattttctcatccatgttcacagccctgtttatgacgaaatttttctttgtcatttgggtgcagaaaacgagagagacccaattgcatatgatgaataagtttattgggatcaagcataacttcttaaaagaatgtaaacgtttgtgggtagtttctggagtagttcttgttttaggttgtgtaggattagggtttggtgcttgggattccgtttttgggatggattttaaaggtggatatgcactgactttagattccgatgtgtgtgagtacaatccagagcagatgtgttctgtattgagaaagcgtttccaacaaatcggattatcttctcgagattatcgtgtgcgtagagcagatagttctggaaaagtcaaaatatatttatctcagaatgccttggatagagttgagcaaatagaaggagctggatcagaacagaaaggatcggattatcatcttgctcgagttcttcaagtattgtctgattccggaagttctactacttctatggtatttgatgcttctcgaggtagctggtttaaggtaagtggacagctttccaataaaatgcgtacacaggctgtcatcgcattatttggagctttaggaattatcttactttatgttagcttgcgctttgagtggagatatgccttcagtgcgatttgtgctttaatgcacgacttattagcgacttgtgctgtgctagttgccttacatttctttttgcagagaattacagattgatttgcaagcaataggcgcattgatgacagtgctagggtactctttgaacaatacgttgattatttttgatcgtattcgagaagatcggcgcgaaaaactgttcaccccaatgccgattttgatcaatgatgcattgcagaagacattaggacgtacagttatgactacggcaacaactctatctgtactggtcattttgttattcgttgggggaggttctattttcaattttgcattcattatgacagtggggatcttgttaggaacgctatcttcattgtacatagctcctccgcttctcttattcatggtgcgtaaggaagaacaaaattctctacggtaaatgatgaaatacgcttgggcgtatgtgatcctaaaattgtgggatgattatggggctcctttcctcctaaagaaggagggagcttttttttaacaggagttttcctccggtaggtatatggaaaaaggtagtttatcctcccttggacaaaaatgggattaccctaagcataatgaggtctttctaaagaagatcttaaaagagtttcatcttcatcctgcgattgctcaagtgctcatatctcggggatttcagtctatccaagagattcgagattttctgtatccccagctctcctcattgcactccacctctttgttcttagatatggagaaagctgtagcacggttactccaagctaaagcaaataatgagcacgtgatgatctatggagatggggatgtagacggtataacaggcgtgaccttgatcgttgaatttctacaaatacttggagtgaaaacaagttattgctgaccgggacattgtttaaacaacatggagagacagcttctttaatttctcaaatgctgcaggatggtatttctcttttaattactgtggattgcggtatcacagcagggaaagaggttcaggctatcaataaacagggtatagacgtgatcgttacggatcaccatatgcctacagggaagcttccgcattgcattgcaatgctaaatcctaaattagataaaaatccttatccaaataaagagcttacaggagtaggagtcgcgtttaaattggtatgcgcaacctatgaagaattgatccagcaggatgcttcttggaaagacaaaatagaccttttgcgttttttagatttggtaagtttggggacgattgcagatgtagggaggctttcaggagagaatcgtatcttagtttcttatggaattaaagaaatagcaaaaggaaaacgattaggcttaaaaaagctgtgttcattatcaggggttgataagtctgaggtatcgtcgaccaatctaggaattagaattactccaaaactcaatagtttagggaggttggcagattcaagtcagggtgtaaagttacttttgtctcaagatcctaaaaatattggaacgatcgtctcagagctttctgctgtaaatcaagagcgtcagcgaatagaagccgaggtactgcgcgatgtggaaaggattctagctgcgaatcctaagcttacagctcaatcagctattgtattagcttctcctaattggcactctagagtaatccccattatttctgctcgtttagcgcgtacctataacaagccagtagcaattattgctctccaagatgggataggaaagggatctttacgtactataggatctttccctttattaggagttcttcgtaaatgcgaatccttttttctatcgtatggcgggcatgatttcgctgccgggcttatgatcaaagaagatcaggtcgagggattcaggaaaaaatttattcatctagtgagttcttctttgagaaaagatgatgcaatgcgtacgctttccttagatgttgggatggatttctctcgcatcaatcgggatttaattgcttctatggagcttcttgagccttttggaaaagggaatgtatccccagtcttctatacaaaagccatacaggtacgttatccaaagttattagccgggaaccatgtcaaattgtatttgaatagtggggagagaaacttggaggggacggctttcggtcagggggataagattagtctactcaaagcgaattggaatatacctttggatatcgcctatacgttacgtattatgaggcggtcggctcgcggagcaattcgtttgttgattcaggattttcgtatacagattcctcggttgtaaatccttaaccccgaatttgtttagtggtttcgattgggtttttagaagtctgtattatcctctctagtcatctcagagtagaggagaggacaaaatctctcctattgtaaaaaactttacaaaactttgtttcaaaaatagcatttatttttaacaaaccacttgattaataagttttttgttgggaaaatattaccttctctttttaaggattttgcaatttttcagtaagcgctcgctaaactaggaagagaaagttatgaatagagtggaaagggcttgtccgacttagagattcaataagcatagctctaagagacggggttagaaggtcacagagccattattcacaagacaggccaagatttgtttttaagtggacgagagaggactaaacagtcgtatggaatgcttacaacaagatacaggggtcgaagcagaacaagttcaagttcagcagcaagaagagaatgctgttcctgttacttcgcaaagagtatcgattactcaggctgccaagttgcataatgtgactcgtcaggctatctatgttgctattaaacagaagaaattaaaagcatcgaagactactcgttgggaaatagatttgcaagatctagaggattacagacgtaatcgttattcacgagctaaatccacttatcaaggagagcttctgtttgataacgagaaaggcttttattccgtgggacaagtggcgtccatgctggatgttcctgaacagaagatttactatgctacacgcattggtgctatgaaaggagagcgtcggggatctgcttgggtcattcacgtttcggaagtagacagatatcgaaacgattatctgaagaaggaagctgagcgcaaagggaaaagtcttgcagccatgagagaaggttttgaggctttgggcgcagatttgctggcagacgcagaaaattttatctcatagagatagagccttctctgtaagggcacagcaggggagagcttgggcctcctccggaattccggagggggctcttttttttgttgaaaaagagctccgaaaaactcgttattttagttttgttaaagtcgccaagaatgaatctctctggtatcgtttaggaacgtagggctttgaacggtccgattttatgcctgattcataggacaggaacccgggacggggtgttcatttcataaagaagaaaagtttcctttcctgggttagtagcgaatgactgtccaaaatgtacgcgttagagtagccccttctcctacaggagatcctcatgtggggactgcttatatggctcagtttaatgaggtttttgcaagaaaatataatgggcaaatgattttgaggattgaagatacggatcaaactcggagtcgggacgattatgaagcaaatatttttctcgccctcaagtggtgcggaattcgttgggacgaaggtccagatgttggaggagcttatggcccttatcggcagtccgaacgcacagagatttacaaaaaatacgcagagatcctcttacaaacagattgtgcgtacaagtgttttgctactcctcaagaattgcaggaaatgcgggcggttgccagtactctggggtacagaggaggatacgatcgccggtatcgttacctatctccagaggaagttcgacaaagagaagagcaaggacagccttataccattcgtttgaaagtgcctttgacgggagaaagtgtttttgaagatcaatgcaaaggtcgtgtcgttttcccttgggcagatgttgacgatcaagttttggttaaatcagacgggttccctacgtatcactttgctaatgtagttgatgatcatttgatggggattacccatgtgttgcgaggggaagagtggttaagttctacacctaaacaccttcttctttacaaagcttttgggtgggagcctccgcagtttttccatatgccgcttcttctaaatcctgatggaagtaagctttccaagagaaagaatcctacttctattttttactatcgggatgctggatacaaaaaagaagcgttcatgaatttcctgaccctaatggggtatagtatggaaggggatgaagagatttattccatgcagcgtttgatagaagcgtttgatcctaaacgaattggaagatccggagccgttttcgatatccgtaagttagactggatgaacaaacactatcttaaccacgaaggatctccagagagtctcttacaagaattgaaggggtggctctggaatgacgagtttttattgaaaattcttcctctctgtcaatcacgtattactacgttagccgatttcgttgggttaaccagcttctttttcactgcgattcctcaatatagtaaagaggagttattaccatcctcgcttaagcaagagcaggctgcagtcatgttgtatagcctagtgaagtatttagagaagaaggatctatgggagaaagatttcttctatcaaggatctaaatggttagcagaggcttttcaagtgcatcataagaaggctgtaatcctctgctatatgtggctattactggtgcaaaacagggacttcctctttttgattcgatggaattactaggtaaggctaggacgcgagcacggctgacctatgctcaaaatctattgggaggagtatccaagaaagtgcagcagcaagtcgacaaagcattgcaggatcagcctcttgaagacattanatttttagacttctaattttgagacaattcttcaagacttgatacacagggtggtgctttggtaaagaaggtcatttcaaatactgcttgagctagagagaaatctaaggttcgggcgtgtttgaaaagaggggagcacttctgggctaagatgtactcccttttcgggggttcataggagcacccttgtgtcaggagggcagcagtagctacaataaaaaggaaaaatcttttcattttttcatccctccgattcttgtattatatagttagtctgtttgttatctatagtttagatagattttagttttagtttatttattctatcgaagtttgttttgtttgtaggcaaacttatctctttgaatccgagctgtttattattttattttgtttgctttgatttgctaattacctgttattagacgatttgttttaaaaaacaattgatataatttttattttataatgtaatattgtctatgagggctagtttcttttattattaaaagaattgcttttatcgataaaagaaacttcaagagcccttttctagaaaggagtctggaagttatgaaaaaaactgctttactcgctgctttatgtagtgttgtttctttaagtagttgttgtcgtatcgttgactgttgcttcgaagatccatgcgcacctatccaatgttcaccttgtgaatctaagaagaaagacgtagacggtggttgcaactcttgtaacgggtatgtcccagcttgcaaaccttgcggaggggatacgcaccaagatgctgaacatggccctcaagctagagaaattccagttgacggcaaatgcagacaataggtagcgcaagttaagagcctacccacaacagatgtagttagtaaggaagttggcttccttactaactatttcggctaacaagaaaatgttgagggtaaaagttagttaataacaatttctacccgatggcagacaaaaaataatctatgcgaataggagatcctatgaacaaactcatcagacgagcagtgacgatcttcgcggtgactagtgtggcgagtttatttgctagcggggtgttagagacctctatggcagagtttatctctacaaacgttattagcttagctgacaccaaagcgaaagacaacacttctcataaaagcaaaaaagcaagaaaaaaccacagcaaagagactcccgtaaaccgtaaaaaggttgctccggttcatgagtctaaagctacaggacctaaacaggattcttgctttggcagaatgtatacagtcaaagttaatgatgatcgtaatgttgaaatcacacaagctgttcctaaatatgctacggtaggatctccctatcctgttgaaattactgctacaggtaaaagggattgtgttgatgttatcattactcagcaattaccatgtgaagcagagttcgtacgcagtgatccagcgacaactcctactgctgatggtaagctagtttggaaaattgaccgcttaggacaaggcgaaaagagtaaaattactgtatgggtaaaacctcttaaagaaggttgctgctttacagctgcaacagtatgcgcttgtccagagatccgttcggttacaaaatgtggacaacctgctatctgtgttaaacaagaaggcccagagaatgcttgtttgcgttgcccagtagtttacaaaattaatgtagtgaaccaaggaacagcaacagctcgtaacgttgttgttgaaaatcctgttccggatagttacgctcattcttctggacagcgtgtactgacgtttactcttggagatatgcaacctggagagcacagaacaattactgtagagttttgtccgcttaaacgtggtcgtgctaccaatatagcaatggtttcttactgtggaggacataaaaatacagcaagcgtaacaactgtgatcaacgagccttgcgtacaagtaagtattgcaggagcagattggtcttatgtttgtaagcctgtagaatatgtgatctccgtttccaatcctggagatcttgtgttgcgagatgtcgtcgttaaagacactctttctcccggagtcacagttcttgaagctgcaggagctcaaatttcttgtaataaagtagtttggactgtgaaagaactgaatcctggagagtctctacagtataaagttctagtaagagcacaaactcctggacaattcacaaataatgttgttgtgaagagctgctctgactgtggtacttgtacttcttgcgcagaagcgacaacttactggaaaggagttgctgctactcatatgtgcgtagtagatacttgtgaccctgtttgtgtaggagaaaatactgtttaccgtatttgtgtcaccaacagaggttctgcagaagatacaaatgtttctttaatgcttaaattctctaaagaactgcaacctgtatccttctctggaccaactaaaggaacgattacaggcaatacagtagtattcgattcgttacctagattaggttctaaagaaactgtagagttttctgtaacattgaaagcagtatcagctggagatgctcgtggggaagcgattctttcttccgatacattgactgttccagtttctgatacagagaatacacacatctattaatctttgattttatcgatgtgtaggtgccgtccagggattcctgggcggctttttttgttatctatatgaaaataaaagagttcattttcgttctcagagcatattctagatgggtttttgaaaaaaataagtgtttgtgtagactccctgctcacaaccaaaaaaggaatgtaaaatatgagcactgtacccgttgttcaaggagctggatcttccaattcggcacaggatatttccactagttctgcaccattaacactgaaagggcgtatatcgaatcttctatcttccactgcatttaaggtgggattagtggtgataggactacttttagtgatggctacgatattcctagtttcggccagcttcgtttgtaaatcccatctatctagctattcctgctattgtgggatgcgtgaatatctgcgtaggaattttatccatggaaggatactgttctccggagagatggagcttatgtaagaagatattaaaggcttcagaagatatcatcgatgatgggcagataaacaactctaataaagtgtttactgatgagaggttgaatgccatagatggggtagtggtatctctatctagaagaaatagtctggtggatcagacccaatgataagagattgctctataggcaaaagatgatagcggcagtttttatggatgatctgctgacagatgatgtatggaaagggaggaggaaagagtcctcctcccagattttattgagctggagtttgtgatatagattttagaaggatcatatccttaacgatgttcacattcttccatttgcagatcgttgcttccaaacgatcgatcctgtttgtttgtttttttcaagtgttggacaaaaatctcaaagtttttgtttttttcaagacgttcttggctattgtgagcaagctgaggaagcatttctctccaaaccagttctggtttttgtaaatgtggagaatagtatttttgaaaccaaggacggatgttgatatctaggtctcccaggttgtcattgatcacattgtcgtattgatcagctggtagagcatactctaaaaagcgttctccgagtttatcttctgcataacgtgaggggataacaatgtctgatttcactccttcgagttgtgtggattttcccgaaggagagtaatatctccccactgtcactttaaagaaatcttcttgactgttgcttccagtgatagtctgatgttggatggttccttttccataagtttgttgatctcccacgatcagggctactccgtaatcctggagtgtttgtgcaacaatttctgctgccgaagcggaacttttagaaaccaaaacagctagcggcccatcataaaatttttgaggagaaatagtgcggtagcgttttaccgaaccatctgcatagcgggagacaaccacaaccccattcgttaaaaataacccagacactttgatggcttgagataaaaatcctcccgtattctctcgaatatcaagaactaagccaagcaggtttttttcttgtaattctcgaatggctttacgtagatcttgttcgctcgatacttggttttctccttcatagaaagagtgcaaggtgatcttaccgataatgccattaccgtacggctcgtaagacacgtcgacacgacgactatctaagagaattttttcacgacgtaactgaatgacgtgatcattattttgtctgtggatatctaaagtaacggaggatcctggagaacctcttagagaatctaaaaccccagggaaaggggtgttttcaatatttttcccatttacacggtaaataatatcacctacacgaaggctacccgttttatcagcagggcctccagcaaggacttctttaaccacaaccccatcaatatcttctttaagcacgactcctatgccacacatgcctttctccagctgagctctcatggatagagcttcttcctgactaaagtaggcggtatgcgcatctaggctatgagcaatagatttgataatacgaacatggaagctattggcctcttcctccggagacattctgtatccatgatcgttaatgccgatataaggattttcatggttttcaatctggcggatacagagtttaactaaaccatgttctttcccttgataacgattttttgctgcatcttctaaatagatagatgcgtaggaaagaagaagatcgtattgtctttgctttacttcttcaattgaagaagcccaagcgcttggttttttctcaatagtatgagacatggcatcttgaattactcgtatggaatcagtgagccaggatgagcgccattctctggctcgagaaatactttgttggatacaggtatctaattccttgaaagaagaaaagttatcttcttgatattgcttaaataggggatgtgttgcttcttctgaaaaagcgtgggagaagacctcgtcttgagtaaggtacgctttgtgagaatcaaaagaacgaacataatcttccaaagatcgagagagaatgtaaggagagatctgttgcgtatcaatatgatgttcgactagtttatctacggttttgcggacatcttgtcgtcgaagaggctctgctgaaaacgcaagttgtggaaatagggttaaaactagcagacaaaagcgagcgaatctcatcattacgaatatctctattaatcgtgattattcgtatcttcgacaggagtttcgcaaacttgagtcggtatttgttgtataaaaacccaagtacttggttgtttacctactcgctctgaaaaaaaacttttttttctcagaaaggaaaggtaacggagggttatttttcttttgtgacaagaaaatttatattggaaaatagtggaagaggaataggtctgtgagatagccagttcttcacattatagataagagccataagaaagatgcagagtgctgaaaaggctagaaacatcccgatgacaaaaaatgctccagcaaaaggaatagtggtttgaggaaaaagaccaataataaacaggactgccgaacacagcgtgaacaaaaggctgcaggttagcattgcggtatttcgaaaaaacgtaacacgttgattttgcggcaataccggagttgaaatttgtgaatattcttgagtaggattcacaacaactttcatgatacaagtcttgttttcaagtttttgaactaacagtattcgaagaaaacattttatcagcaaggatttaactctttttttattaattatttttagggaaggcttgttttaagaaaatcttttagaggaaatgttttttaataaaattgttatagagatcgataaactcttactagacctagaaataaccccttgcaaacaaagatattcttattctatattttcctgtttgtaagagaggttgaatcgagaagagtacatgccgacgattaatcagttaatacgtaagaagcgtcagtctggcgcaactagaaagaaatctccagctttacaaaagtctcctcagaaaagaggggtctgtcttcaggtaaaaactaaaactccgaagaaacctaactcagctttgcgtaaggttgcttgggttcgtttgtctaatggacaagaggtgattgcctacatcggtggagaaggtcataatttgcaggagcacagcatcgttttggtccaaggcggaaganttaaggatttgccgggggtgcgttatcacatcgtccgaggtgctttanattgtgctgccgtaaaaaatagaaaacagagccgttctcgctacggcgcaaagcgtcctaagtaggctggttccctaaacctaaagaaaagaaatacgaagaggtttgagtttatatgtcaagacgacatgcggctgagaagaaggtcattccaggcgatcctgtttacgggagcgtagtcttagaaagatttattaacaaagtaattgttgcacgggaagaagagcatcgctagaaagattgtttacggtgctttagagcgttttgctaaaagattaggcttagagaatcctttagaaggattcgaagaagctttggagaatgcgaagcctattcttgaagtgcgttctcgcagagttggtggtgctacttaccaagttcctgttgaagtggctcctgatagaagaagctgtcttgctatgcaatggattatcaagcatgctcgttctaagccagggaaatgtatggaagtcggtcttgctaatgagttgatcgattgcttcaataaacaaggggctacgattaagaaacgcgaggacacccatcgcatggctgaagcaaataaagcatttgctcattataagtggtangntaacgtttaacattcgtgtgtgagaggcaaaaaagttcgatgagcgatcaagagttcggtttagacgcgattagaaatatcggtatcatggcgcatatcgatgcaggtaaaacaacaacaacagagcgcattcttttctacgcgggaagaactcataagatcggtgaggtccacgaaggtggagcaaccatggactggatggaacaggagcaagaaagaggaattaccattacctctgctgctacgaccgttttctggctgggtgcaaagattaatattattgatactcctgggcacgttgactttactattgaagtagagcgttcattgcgagttctcgatggtgctgttgccgttttcgatgctgtttctggagtcgagcctcaatccgaaactgtttggagacaggcgaataagtatggagtgcctcggattgcttttgtaaataaaatggaccgtatgggcgcgaattacttnggcgctgtcgagtccatgagagaaaagctgggagctaacgctnttcctgttcattgtccaatcggttctgagagccaatttgtgggaatggtagatttgatctctcaaaaagctctgtatttccttgaagagactctaggagctaaatgggaagagcgcaagattcctgaagatttgcaagagcagtgcgcaacactgagaatgcaattattagaagaactagctaccgttgatgaaagcaacgaagcctttatggagaaagtgctggagaatccagattctatcacagaagaagaaatccatactgtaatgcgtaaaggagtgattgagggtaaaatcaatccagttctttgcggaagtgctttcaaaaataaaggtgttcaacagcttcttgatgttattgtgaagtggttgccttctcctcttgatcgtgggaatgttcgtgggattaatttgaaaactggagaagaagtctccttgaagccttcaaaagacggtcctttggctgctttagcattcaaaatcatgaccgacccttatgttggacgtattacttttatccgtatttactctggaactttgaagaagggttctgccattcttaactcgaccaaagataagaaagagcgaatctcaagacttctggaaatgcatgctaacgagcgaaccgatagggacgagtttactgtcggagacattggtgcgtgtgtagggctaaaattctcagtaacaggggatactctttgcgatgagaaccaagagattgtgctagaacgtattgaagctccagaacctgtgattgatatggcaattgagcctaagtctaaaggggatagagagaagttagctcaggctttgagtgctctctctgaggaagatccaactttccgagtttctactaatgaagaaacaggacagacgattatttctggaatgggtgaattgcacctagatattctccgtgatcgtatgatccgagagttcagagttgaagctaacgttggtaagccacaggtttcttacaaagagacgatcacaaaaacaagtaacagtgaaacgaaatacgttaagcagtctggtggtcgaggacaatatgctcacgtttgcttggaaattgagccaaatgaacctggaaaaggaaacgaggttgtcagtaagatcgtcggaggggtaattcctaaagagtacatcccagctgtaattaaaggggtcgaagagggattaaattccggagtgctggctggatatggattagtcgatgtcaaggtaagcattgtgttcggatcctatcacgaggtagactctagtgagatggcctttaagatttgcggatcgatggctgtaaaagaagcttgtagaaaagctcttcctgtgatcttagagcctattatgaaagtaacggttattactccagaagatcatcttggagatgtgattggagacttgaatcgtcgtagaggtaagattttaggtcaggaatcttccagaaacatggcgcaggtcagcgcagaagttcctttgagcgaaatgtttggatatatgacctcattgcgatcattaacttctggtcgagctacgtcgactatggaacctgcattctttgctaaagttcctcagaaaattcaagaagagattgttaagaagtaaggaatatatgaagcagcaaaaacaaagaattcggattcgcttgaaaggttttgaccaagggcaactcgatcagtctacagcaaatattgttgagactgctaaaagaactggagctcgtgttgttggtccaattcctttaccaacaaagagagaagtgtatacggtgttgcgatctcctcacgtagataaaaaatctcgtgagcagtttgaaattcgtactcacaaacgattaattgatattttagatcctacaggaaagacgattgatgctttgaaaatgttgtctttgcctgctggagtagatattaagatcaaggctgcctaattcttttgatttaaaaatgtctttattttctaaattcaaagctcagtggatgtttttacattcacgtgagctttgttcttccacatcggatattgggaatacttgttcggatcctgtttttcagattttatgtaatccggttcgttctgagatttcctataaagttggggattctttgggggtattcccaacaaatccttccacattagtcgattcagttctggatgctttacagtatggccccaggtctcctgtcgtatctcggcatgcagattctgttctccctcttcacgaatttcttactagttacgtagacttagataaaattccaaaatcgttaagaccttttttcccaggggatttagacgatacctggtctttagctgaagctattttggtttaccagccgcgtattccttttgaagagtttattcggagtgcgatgcctttattgcctcgattttattctatagcttcttctccaacatgttctcatgggaagctagagttgctcgtgcgctgtgttagtttccaaggtaaaacgcagctgcgctatggattatgttcggcttttttatgtaaggacttacaagagggagagtcttttcgtgggtttatacaaccgacgcggcattttactttggagcagaaaaattttgggaaacctttaattatgatcggagcagggacaggtatcgctccgtacaaagggttcttacaacatcgaatataccatcaggacgtaggctccaatattctattctttggagagcgttttgagaaaagtaacttctattaccgggcattttctccaggagctgatcgtttcaggaaaactccagttattcacagccttttccagagattccgagtctaaattgtatgttcagaatgttatagagcaacaaaaagaacttatacaagaagtctacgaacaagaagctttcttttttgtttgtgggaaaaaaatccttggtacggaagttaaacgtgctttagagcagatattaggtcctaaggcggtacgagagctgattgcacagaagagactagtttcagacgtatactaataccgacaatattccataatagttaaaacgcaaaagcattgaacaccatatccttgtcccatggcagttaagccttctccagaagtggctgtaatgttaatggaatctagaggaatgtgaagaacctcggctattctcttgcgcatactcggtaactgagggagcagtttaggacgcttcccttctatagtaatagctagatgcgagactcgttgtgtaggttttaaagaggcgacagttcttgtagatagactacgctatcggtaatgccttttgttttcaaaagctcgtcagccagtcctcccaaaatacctttgtgcgttacagacgaaaacgcattacatatagcatggaagacaacatctccatccgaattagcttcgaatcctggagtattttcaaaaataatgccacctaatatgcagggcttgggatcttcgtcagggagaaaacggtgactgtcctgaccaatacctacacgatatatccattcaggatctggaagaacaaaagaagaagggatttcggtcatgtgcttgcaaaggggacaggaattatatgccctctaaaagaggtaagatctcttcacaacttcttgaagagatcttcattaaaataaatagaaagattgttatcaacatcctgtcggttctttagttgaaaaaagaattttggaaggaggagtgtgaaatatctgtttgaattctgctgcactaatctctcctagacaccagtgttctttatcagggaggcagggaaatagttgtgcataggcacgaacgatagaagggctagtgagaataatagttttatggggaagaaaggtacttacggaaagtgtaatgggtttaactgtgtaatgaggataggaaaaggaggagaaagggagtgtttgtagaagagagcggagaatgggacgagcgagtacagagtgaggatagagtagggaggagctggaaggaagagtcgataggatgggaagaaatgcttctgcttgagggaatgcgctttgcacaatattggctttggggagaaaggcctttacacgagaagaagaggcttctcctatggtaacgaaggatttattcctgaacagggataaagggattcttttcctaatggaagaaaaaaaacaagcggtagaagaggggcttgttaacaaaatatgggaagctgatacaaggaacttcctagcatgtcgtatttgaggaacgtgttttgaaaaagggactatgcgaataataggctgaaaaacagcagaatattgtttagcagaggatggattgaggcctaagtacagaggcatgatcgatgagggagatctcttgtgtaaaaggtttcatgttagagttttttttaaatagaagagaagcttttttcctagtaggaagcttcttgacttttgctgtaagaatatgatcaactgaagctgcgatggtattaaagcaccttatggtaagcgactaggaaaaatggggcgcttggtaatggtcttggaagcatcgtttctttttcttgtagttatagttaaaataaatcctctttctcctagaaagtttagactttctcatcaaaagattagattcccataaaggataagagagagtgggtagaggataaggagtgcctctgcaaggtcttgcaaggtttaatcagtggaggtggaaatatggcatcgttattggatagatatctgagaaatatttccgacaaaagtcagcaaaatttggcatcagtggcctatttagcatcattagatcatctgttacacgcttttccatctataggacagagcattgtacaagaattaaagagtcagcgatctcgtttaaaaatgattgcttcagaaaacttttcttctctatctgtgcaacttgctatggggaatttacttacagacaagtattgtgaagggagcccattcaaacgattttattcctgttgcgagaatgtggatgcaattgaatgggaatgcgcagagacggcaaaagaattatttggtgcggaaagtgcttttgttcagcctcattctggagccgatgcgaatttattagcgatcatgtcgatcattacacagaagatccagagccctgcggttcaacagttgggatataaaacgatcaatgatctgcctgagcaggaatacgaagcattaaaagctgagatggctcagcacaaatgcctaggcccctctttaaattctggagggcatctgacacatgggactgtgcgcatgaatatcatgtctaaattaatgcattgtctcccttatgaggtgaatttagatactgaattatttgattatgatgagatagcaaaatnagcgaaagaacataagcccaccgttctgatcgcagggtattcgtcttattctagacgattcaactttgccaccttgaagcaaattgcagaagactgtggcgctgttttatgggtggatatggctcatttcgcaggcttggttgctggaggtgtgtttgtaggagaagaaaatcctatgccttatgcagatatcgtgacaacgacgacgcataagactttgcgagggccaagaggtggattggttctagctaaaanagaatatgcaaataccttgaacaaggcttgtctctanatgatgggcggcccacttcctcatgttatagctgctaaagctattgctctgaaagaagctatgacgatcaatttcaggaagtatgcgcataaagtggtagagaatgcacagactttggctgaagtgttccagcggaacgggctacgattactcactggcgggacagataatcacatgttgattattgatctaacttctctaggagtccctggacgtattgcagaagatatgttaacctcagtaggtatcgcagtaaatcgtaatactattccttcagatgcctctgggcagtggaagacttctggtattcgattagggactccagctctgacaacgctagggatgggcagtgccgaaatggaagaagttgcgaatattatcgtgaaagtattgcgaaatattactgtgagaagcaatgctgagagcggttctagtaaaagtgagggagagctgtcagaagggatcgctcaggaagcgagacaacgtgtggctgatttattaggaagattccctctttatcctgaaatcgatctggaaacgctagtttagtgggagactctatgcctgaaggggaaatgatgcataagttgcaagatgtcatagatagaaagttgttggattctcgtcgtattttcttctccgaacctgtaacggagaaaagtgctgcagaagccatcaaaaagctttggtatttggaactcaccaatcctgggcagccaattgtatttgtcattaatagccctggagggtctgttgatgctagctttgctgtttgggaccaaattaaaatgatctcttctcctttgactacagttgttacaggtttagcagcatctacgggatctgtattgagtttgtgtgctgttccaggaagacgttttgctacgcctcatgcgcgcattatgattaccaagccttctattggaggaaccattactggtcaagccacggacttggatattcatgctcgtgaaatnttaaaaacaaaagcacgcattattgatgtgtatgtcgaggcaactggacaatctccagaggtgatagagaaagctatcgatcgagatatgtggatgagtgcaaatgaagcaatggagtttggactgttagatgggatttctcttctcttttaacgacttgtagatatcttttatattctggagcaggaaacagtttcattttgggagaatcgatgccttctcttgaggatgttctgtttttatgccaggaagagatggttgatgggtttttatgtgtagagtcttctgaaatagcagatgctaaactcactgtttttaatagtgatggatctatcgcgtctatgtgcgggaatgggttgcagtcgcaatggcgcacgtagcccagtgctttggacttgaagatgtttctattgaaacagaacgtggtgtttaccaaggtaagttcttttctatgaatcgggtattggttgatatgacattacctgattggaaaaaagctgagcggaaattaacgcatgtgttgcctggtatgccggaacaagtattttttattgatacaggggttccgcatgtcgtggttttcgtttctgatttaagtaaggttcccgtacaagaatgggggtctttcttgcgttatcatgaagattttgctcctgaaggtgtaaatgtagattttgttcagcggaagaaggatgatctgctgcttgtctatacttatgagcgaggttgtgagcgagaaaccttatcttgtgggacagggatgttggcaagtgctttggttgcagcggatatcttttctctaggacaagatttctctatagcggtgtgttctcgtagtagaaatctgattaagattttttctgagaaaggcaaggtatttttagagggtcctgtgagcctattgaatcgtagtgagaactttgggtggttagagcctaaatcaagacgttttggataaaattgaggataacacaagagagagttgctatctaacagagcatcccctatactggagcctatgacgacatatcctgtacctcaaaatcctcttttattacgcgttctacgcctgatggacgccttctcgaagtctgatgacgagagagatttctatttagatcgggtanaagggtttatcttgtacatagatcttgataaagatcaggaagatctagataagatttatcaggaattggaagaaaatgcggatcggtattgcttgattccaaaattgaccttctacgaaattaagaagatcatggaaactttcgtaaacgaaaaaatttacgatatcgatactaaagaaaaatttttagagatagtgcagtctaagaatgcgcgagagcagtttcaggagtttttatatgaccatgagactgagcaggagaagtggcaacagttttatgttgagcgttctcgtattcgcatcattgagtggcttcgtaataatcagtttcagtttgtctttgaagaagaccttgatttctctaagcacattttagaacaactgaaggtacatctattcgatgccaaggtatcgaaagagttaacacaggcgcgtcacttcttttaaacaaatctaaagtatactattcgaacgaggctttaaaccctcgtccaaaaagagggcgacctcctaaacagtcggcaaaggttgaagctgagacgaccatatcgaacgatatctatacaaaagtcccttctgcggcacgacgttttctatttttaccagagataacatctccttcttcgcttactttttctgaaaaatttgatacagaagaagaattcctcgcacacttgcgaggaggagggcgtctggaagaccagttgaatttagctaagttttctgagcgttttgattctttgcgagaattatccgctaagcttggttacgatagcgatggagagactggggatttcttcaacgaggagtacgacgacgaagaagaggaaatcaaaccgaagaaaactacgaaacgtggacgtaagaagagccgttcataagccttgcttttaaggtttggtagttttacttctctaaaatccaaatggttgctgtgccaaaaagtagtttgcgtttccggatagggcgtaaatgcgctgcatgaaagattgcttcgagagcggcatccgtgggagatcccggatactttctttcagatacgaataagcatagctgttcccagaataaaaacggccgacgctaggaacaacaagatttagatagagcttgtgtagcaggtaaactgggttatatgttgctgggcgtgttagttctagaatacccaagtgtcctccaggttgtaatactcgatacacttccctaagagcctctaatggataggataagttccgtaatccataggccatagaagctaaacgaaacgtattatccggaagcggcaagtgtgttacgtcactcgtaatataggagaatggagctgaggggtggcgtttttggacgttttctagcatttttgttgagaaatcaacaagagttgctgaggctcgaggatagttctggacataagatagggctacccggcctgttcctgcacataaatctaatagatggttagtttctcctaagagagaaaccaaagcattgttccaagctatatgcaagcctaatgatagaataccattgattttatcataggtaggcgcaagagaatcgaacatgatttggatatttggcttgtcgtggaagtcggtcataatagtctctaaactgttctaaccctgcaaaatcctcttcagaaagctcatagcgacataaagtatagtattcttgcataagcgattctgggagttttagtaatgcagctgctttgctggtaatatcttctttatgattctgaaaataattcaatgtggaagagaactcctgttgaagctgaaatgaaatagttgaagaaaggctgagaatcccagcaaaaacaaaaggttttgcagtcaggtcataccaagaagctgctaggtcataagtgtggaatcctgggattataggatggcgtaatgccgtatctcctatcaataataaagcatcatagtgttcagcttgtgtaagaatgctgtccgaggaaagtagggtaacggaagggaacggaatattccataggttttcgcatagaactcgtagcagcaaaatagaagaaagactctctttagtagccgctatatgaggagcttccttagcaaaaaattgcgaagtagcatgtaagtttacgcttaggatttttttataagccgcgatcccaaaggaagatactctgtgtaaggaagaagagaatgttgctgctacagaggttaacgcataatctatttctcgtgacaggagtttaggcaccagattggtaggggtatccataagcaaggagacgcctggagcttgtgataagccgctagaaaaaggtaaagcgttaacgtagcgtacacaaccaatgtttaaacggtcttggaattgactaagcatgggatacgaccatgttgtattatgagatgggacatcccttcaatatccatacgaataggctcttgggaagaggccattcgaaataccttttctccttggtgagtggaagacaaatcattgcntccgcatgataacaagtgtagagcaacgtcgagacctaaataattccatagagctttaatattagggatgttgtctaggaatagtcgagcaactgcaataatagttgcaggaggaatcgagtgtcttgaagtcattttgtgtagacgctttcctaaagcattattctctgacgcaaatttgaggaggataaaattcttaaagccagaagttttgtcttgaagagcgcgcagtttactcatatgtgtcattatatctgcaggagtctctcgatggtagcacagcatggtagcattgctagggattcctaaggaatgcgctgtttcatggatctctaagaatccttgggaagataatctgcctcgcgagagggtctctcggacttcatcgactaagatctcagcacccccaccaggaatagaatcaaggccagcgatacgcaagcgttgcatgacttctttaactgggagattgtctaattttgacagataatcatactcgatagctgagagcgctttaatatgtagatctgggaaattttgcttaattttggagaagagctcttcatagtaagcaagattacaagaggggtagcatcctgctacaatatgcgtttctgtaatgggagaagggttttcttttatagattgtacgagttgatctggagtaaagaaccatcctgtagggttccctggtttggcatagaaagaacaaaacgtacagttaaactgacagaagtttgtagggtataaataaagggtcgacgagtagaaaactgtgtcaccaacacgattggcacgaataagatcagcaaagctccataaagcttgttgatcctcagcatcaacgagaagtaattgtaaagcttgtttttcagaaagacgcgctccagataaatagtcatcaaataaagttttaagccatgcgcttttaggtaggattcgagctggaagagtcgtcatagtagttatcagtttgtgagttttgcttttcacggggacaagacttctttttctgacagcagtcgctgcggccacatcctttagataggggtcttcctagtaggaaagaccctatcaaaacagctgttactcctatactgagaagggctgtagcgcaacagacgagtagaaataaagaagtcatgaaggcatcattttagttaagatctatccanataggagagctcaaagccatagctccattctcttgagtgactcgtaagtagtaaaaagcaaaaggagctccattttgaggatcttttagagtgacttgtgcaaaaggagagagatcgtcgtactcatactcaaagttatttccatctgggtggaagggatggagaatatccccattgcggatgatttcaatcgacgcaatcttggcagttcctgctacatatcccgaaatatgtctattgatcacgagccctggtttaatggctgtggagagttcggagcccataggagcagatgtaatctggaaattcacgataattctttggccggttgtagcatagcattgtcgttggtataatgcctcgagtaaggaatcccgagaatatttattgcagatcacagctgttaatccaggggagtattgctgttgatcggaatcaaaaaagtgattgtatagatttctatcatcaagaccaccggctacgaatccaaaaacgcaggtttctctttaaagcagatagaacagttccctctggattttctgagtcgatagaacctttaatagggaaagggttcccttcagcttcagttctttcagagcatccccaggcattataaatttcaacaactctttcaaattcaggatggaaattattaaaattgtatccaaatttctttgaagcagtgaagctgggggattgagattaactcatgactagttgattgcttatatagcttagataaaggaaatagtttgcattctttatgtttccctggggatttgggttccttcatcagcaatacttcacgaattccctcgccaggctcttcagaaaggtactgtgctccggataaggcaatgaaacgatcttcttcattaaaatcagcaacggtttggttaatggttttaatggtttctggggtcaggccatcttgaatttcgaaagaggatgttgcaaaaaagtttaacgcgcagtcatcacgaaaataacgcaagcaagactcgatattaccttcagagtcgacacgatcagattctccatgtagaagcccccacaaaagatgagaggaggtttctgcaaaacatttgataggcgctgatgtaaagacctcttttgttgcttgattgcgtagttgaatacgataaatacctggttcattgaaatacaggtttggaaggatcacaaagcctgtttcagggatgaacaattgccaattgaggttttcgcgaagatgttcgtacgaaagctcgatatgggtctcttctggggagaaattggttaagttcccaaattcatcttcgaagcgcactgtaatatcaaagcgtttgtttttgatcacataagaaggagcaaaaatccggatattttttaatacatttcctctgatatccattgtgaagatatcgggatctttcaaaagatcctttccctgatgggtcaacataaagagagaaaggtttacggcgttgagtaaataattgagcaccattacctgaagagtcctcttgagggaagttgggagaggagccaagaataatagagaaagtgtccccagcttccacatcacaagggagagtaaattcgaaagtagggatatagcctccgggagcatacacagcttttgcagccacaatatcctcggaaggcgtttctaaataaattgtattacatggttgagaaagatctatagaaggaatctcccagtctatagggcgtccgtctattcccaggtcaaattttagcaatgtgccttcgggaaggaaattagctgaagaatattcgaaacgccaggtagaaatttgaccagccctagcaactgaaggagtaacgtaacaaacagatctgcgcatagcaactaatatataagttcgagtaaccaggaagtcctttatctgtaaaaattttgctttcgcatgctttacagaggatcttcaaagaaaaggctatgttacaccaaaaattttttcaggaccacacaactttgataactacgcatcacttgaaaagagagcgagttgaaggtagggttaactgttttcttttgctaaagcttgtagagcttcattcacagagtcgaagaccttaaaataagacaaaaagcctgtgacataaagagtctgttccactgttttagagacagaagtgagagcaattttccccgcatttttccctacttggtgatagctttgtaaaagcacgcggatacctgcactagatatgtaatctaaatctccgcagtccagaataaatgtttttcatgccattggaaagagattcagaaatactttcttgtacagctggagaggagacaccatcgagtttcccttgtaaatgaaggatgcctgtttggccttgttcttctttctgaaagttactcattgggataggactcctaagattaagtagttagaagggctgcactatattctagagattgcacgaaaaggcatgaaatatcacgatcaaaagcaccttttcgtaatctcccttctactatggctatacattttaggacaacagctacagagagtgtgatttactagtgtttcattgagaagtagttgtatttaagataaaggctttcttcttcttggagtgattttcattttttctacgctacggtcagagcaagataagatatctatagcaaaatcttcatagtaaattttcattcctttttcaggtacggcacctaatttatggaatacatagccaccaagagtatcgtaactactttcatgttctatatggagtccaaagcactcttcggcatcggaaatgttcatgcgtccgtctacaatccaggcatttcctatttntttgtagtgaacatcttcttggtcatcgtattcatctgcaatttcgccaaagatttcttcgacgatatcttccatagagacaaaggccttctgtaaatccgtattcattaacgacaatcgctaggtgacaacgtttttgacnaaattcttgtaagagtagagaggctctacgtatttctggtgtgtacaagggaggataggcgatcgatgataaaggttgggaggtatgaggatccttatagtaaacaggtgacagatcttttacgagaaccattcctgtgatgtcatcaatactctttgtgaacagaggaatgcggctataaccttcgtctatgattagagggaatgcttgagaaatcggggtgtctccttgtaaagcaaagatgtcagctttgggagtcataatttctcgagcgatcatatgattgagacaggagatattcgtggatagctcattgggaggttctggaggaggggtctgttgcatagcagtgatagaaggtgttttaaagccagcaagacagttttccaaggttttaactgtagatgaggaaactttgtagctgaaggagtcgtccgaatagcctgggcaaaggggtaagaatttgtaaataactagagccaaagataggaaaatgagccaaaaaattgagggagacagagagaagaagttatggatgtactggtagactggggctccaagcattccgtaaattaaacaaaggagaggaagaactttaggacaagaagagaaagggggaaggccttctcctccgtatgctgaaatagaggctctgcggtgagttgctgagccgaggaaaagaaaaagaacgataatagccagcagaatatatagcatgatgaggggcgaaaaaagccagctcctgtaaaagaaattattgggagagtccacaaaaagactcgaggcttacttgcatgttacgataaaaatttttatcgatatagagatttctagagggaagcgaagacttttatactgcaggacgtaataacgcctggtgttcagctaaaaaggaaagggatacatcttcctgttcttgcatgatgcgtttgtcttcatcggtttgatcatcataccctagcatatgcagtaaggagtggacgacatagcgcgagatttcatgatacaattggtcttcggtatattgttccaagaatcgcatagctgctttagggcttacaaaagcttctcctaaaacatgaggaaaggaagcaattccaggcttatctatgggaagagtaatggtatctgttagggaaggatcagaaaattgctcgtcatggagctgagcaagagctgtgtcgtctagaaaataaacatacacctgatctgtagaaactttttgtagttccaaaaacagaacaacaagacgctgagcagattgtaaatctatgctaacatcttgttgttcgttagaaataaaaatttgaggagaagatcgatccaaaataagcaaaaaaaatataacttacttgattacaggagtcttaagaagccctgtggcttttttagcagtagcatcgtcccagcgtcctnatttacgnnacacttcgatgcgctcaaaacgcttaagaacgtttctcttagtctctcccgagacggacttcccgtaactacgatgtctagacatgttatttctctaataattaaccaatttgaggaacaaaaacgccaacaccttttgctgtgttagtgtgggccttaaaagcaattcttgaagcatcttgtggatgctgaacagcataaacgggcttgcgtttttttggactttgagctctacggcgagcttgtttactcattcgtgtcataaaataacccaacaagatccttctgccttcctgaatgggaagggatttaaaaagaaaatagcaactctgctgttgcttatgaaaggaacagaatagtagagcgccgtttttttttcaataaagctatgagtctggttcccactaaattcccttctttttaaaaagaagataatgattagggggactaaaactgtgggtgtatgaaaggtgaggtagcgcagggatctgagtttaatactccacaagagattacatatttaaaggcgtcttcgattttcatatccaaaaaagtaatgtcagattttttgaatagcgtgagaaaccctgaagtaggatttggagtagttgggataaatacggtaatcataggatcgtcagcatcctgtgagcatgtggttggagcttctccggccaccagaccaatacataagacctccctattagggaaaggcaccataaccactttgtttaaaggatcctgattgagacccaaagattgttgtcatgacctgttgagcagccttatacactgttttgatgattgggattctgtgcaggattttgtcgtacacggacaacaaagatttgaaaatcataaggcgagcaaggaagcctaggagaactgtggtaaagaaaagtccgaatagaagtacaatttgtagaccaagtctaaggaaagctcggtatttggtatagaaactaaatttttcgaacacatcggataccatgccaacgaagggttgtgtaagaaaattccataatcatccctacgactgcaatggtaatcgctaaagggagaagaataactaggccggtaataaaatgctttttcataacacaagctcctttggctggggaattcccgctctcttggaatcctaggcgcaactatagctaaatcctctataacttgtaatgcgtttttggaacggtctatagaagagggtttttctcacgaggaatttttaaacgagtttcaaagaaaaggtgcatgttaagaaatatcattgatttaaagcgggtatttctctaaaatagccccgtgtatggctagatngctcagctggtagagcagaggactgaagatccttgtgtcgtcggttcgatcccggctctggccatcccatgagtatgcgggtatgtccgctaatggcgtttagagagttttgacggagaactctctaaatttttttgtgacagatttcacatttgcgcaaaagagttagaagatttctacaagccgcttgtgttgttttgctcatgtcccaaataagaaaaaaagggacaagtcttttcgaatatagtggaagtagttatatttgttgttcgcttcgggatggtgtgtccttaagcgctaacaggggctctccggccaagtcaggcgcttccttctagaatggagagtttcaacaagtaaagtttatagggaaagaattgatggagccttacgctgtaattcagactggaaataagcaataccaggttcgcaaaggtgacgttatagacgtcgaactgttggatggaatttctgaagagaacaaagaagtcctttttcaagatgtattatttacttttgacggagaaaaagcttccgttggtgctccaacagttggcaacgctgtagtgaaaggagaattagtttctttcgttcgcggagaaaaggttgtggcttacaagtacaaaaaacgtaagaattaccacaagaaaatcggccatcgtcaaaattaccttcgggtgaagattagcgatttggttatgtaaattgtagggaacataaaggatttttgagtcatggcacataagaaaggtcagggagcaagccgtaacggtcgcgattccgaatcaaagcgtcttgggttgaaagttggcgcagggcagagagtttctactggaagcattttggttagacaacgaggaaccaaatggcatcctgcagtaaacgttggtagggggaaagacgatacgttatttgcattagcggatggtatcgttgtaatgaaaaaaacagatcgtacttacgtttctgttatcccacaagcttagttcatttttatttataattcagtttgttcaagctctgtttttgcctacgcgtaaaaatagggctttttttgtttgttccaggacgagtcatgtttgttgatcaaattacattagagttgcgcgccgggaaaggcggtaatggtgttgtagcttggagaaaagagaaatatctccccaaaggaggcccctacggcggtaatggggggaatgggggctctattcttatcgaaacagtgacgaatatgtattcatttgaagaataccgtaatcttcgtttccttaaagctgatgatgggcaagccggtgctagtaataatcgtacaggaagaaacggtaaagacttagtattaaaagttcctgaggggactctcttacgggatgcagccactggagaattgatacacgatttcaccaaggatggtgaacgtattgttgtctgtcagggaggcagaggaggtaaggggaatgttttctttaaaacatcgactaaccgagctccaacaaaagctactccaggtaaacctggagaaattcgcttggttgaactggaactcaaattaatagctgatatcggtctcgttggattccctaacgctggtaaatcaaccttatttaacactcttgcacgtacagaagtgaaagtcggtgcctatccgtttaccacgctacatccttcattgggtttggttcatcaagaaggaatgctctatcaaaaaacttggatcatggcagatattccaggaattattgaaggagcgtcgcaaaaccggggattgggattggatttcttcggcatattgaacgtacgcgattactgttattcgtaatcgatatctctggaatagaaagacactcacccgaacaagatcttaaaatcttaatgggggagctcttggcttacaaagaagagctaaaggataaagacatggtcatcgctttaaataagatcgatcagctactgcctgatgagcgcgaagaacgtgtagctcttcttaaacagcagttccctgatcaagaatttattttgctttcagggctgacaggagaaggggtagatgcattgtatgatctgttcaagagtaaactcagtgagtaagctcctcccatgagaatcgctatgacaggcccaactggcaagtctaggagataagcaagcataattcctaggaatgagcagacgatatttaagatagatgcgatgtaaatgatgtggctcattttgtaggagaaacgacaggctattgatactgggaggactaacatgctcaacattagaataactcccatgacatacataagaacaacagtcgtaattgctgttaagataagcagcaataggtaccaagtttttatggagtaatgattcaacgccatgtatttctcatcgaagcatagggctaagaatcgtgtgtgacaaatggatacggtagcaacgataaacagatctaggatcccaaggaaataaagatcttgtggggtgacccataagatattgccaaaaagaaaatcagagagctctgagttaaaggaagggagcttagatatacatataatgcctatagccataccaatggaccagatcatagaaatgatggagtcttcgcgttcatggtatttaagatggacattcccaatacagatcgctacgaagatagcactagcaatagccccgtgtagtggggatatagggagattaaattggtattgaagccatagggcgataccaactcctcctagaatggaatgtgctatgcttccactaatcgacacaatgcgtttcactacaatataagagcctacgattcctgcagcaatggaggcgccgaaagccgccagcagcgaagggaatagaagaggcgggaacaaagaacagagaatagagatcatgggcatctcccaaaagtgttgcagcagaatctttctgaaattgtagtggtgtctgctaaagttgttagtgttttattcatgaaaaagactcgattgaaacaacctgctgtgtggtgcagatcatgagtgatcatgaggatagtgcagtgtttattcagagcggaaagaatctgtaagattttttgttgattgacggggtcgatattggctgtgggctcatctaacaaaaggaattcaggacgcgcagccaaagctctagctaggagaacacgttgaatttggcctcctgacaaatgggaaaagcaagagtctttataatctatcagatcaacggtaagaagggcttcttcagcagcttcatgatcttcttgtgtataacgtccataccaaggcagtgtcgccaaccttccagacagaacagtttcctttacagtgataggaaatgctgcatcataggaaaaatgttggggaacccaacctatggatagagggcgatgatcttgtacagaataggtagagatgcttccacacaccggttgtaataatctcagcatgagttgggtgagagttgtttttccccctccattgggcccaataattccaatgaaatccccagaatagacttcgcaggagacgtggtcaacaattaggggaccggttttcccatagcggaaggacacattctctaatagcatttgttttgtcatagatttgcaaaagccgttgcgatagctagtaaattattgaagacatcttcagcatagggatccaatagaataggcgtcatattaaacttccgtactaaggcggcgctactacgtttccccgcatgcttgagcaaaattacagagtgcaagttgtgatcacgaatggttcgctctacacgaacaacatctttaggagataactctgagtggttagctcgctcgatagtatgttgtataaagccgtaatctctacagaaataagcaaaagctccgtgggtaactagaacattgcgttgtgatgtactagaaacaatagaagaaatcttttgatccaaaagatctagttgagactgtaatagagaacagtttttacggtacagagtttcgtgttcaggggcggtctccactaaagcttctgtaatggcctggatttgaatttttaggtttttaggacttaaccaggtgtgggtatcaaaactaagaaaacgctggcagcaggccccatttgtaattttatcgatatttgctgctagatctacttgcttgcacgaaataattctctcacaagttttttcaaatccctcaccaattctaaaccaaagttcaacctggcggatcttttctatatatttaggcgaaagctcatagttatgagggtcatggttatccataacaatagagaacacctgacaggtatcccccgcgatttgttccacaagaaatttataggggacaatgctgaccaaaatctgcttgcgagtagaaacctcgtctccataggaacaagtgatccccaaagaaaagaggagtaaaaagagtaaacgcatattatcttaaaatattaacaacgaaccattattctattgttgagtaattttgttcaatggcttgtcttccaaacaattttattctttagggaaatcgcgttaaatcattcacatataaattttttagtaatatggggttcagagcagagaagctttagaaaacggggtgaggaacagttttttaaagaaaaagcaaaaattgtacgaaaaaagctggagataaaatcttaaaaaactaagaatgttctttctactgtctttttgccggcgatagccgagttgtttggagagtagtagtttgttttcttggagagatgtccgagtggcttaaggagcacgcttggaaagcgtgtgtgcgttaacgcgtaccgagggttcgaatccctctctctccgtctgacacatttgctcgcgtggccctcacctctgcaagtgtgtcttttttttgttttgattctgttgtgattttttagtgagaacaagagttgttttctggaggcagggattcctagaaggcagcccttgcgagagctgcctttccaggatatttatttagaatatcatacgagcaccgcagttcatcatatgagctagtgtatgtgcgtctgcttctatcgtgtaggatccatacagagtccacaaaggtcccgggtacagctgcgtgctgtattctccgcgagctgagtttcttgtcggtactccacaaataatttctccgccttctcctgaagagagcacttggtatttgcatgttggagaatttcgatagattgatggcatgtatgctacagagaatctgttgtacatcaaaatatcgttaccagagagctctccttcgaatgctaaccccataggaattgctaagtttctataggtgcagttgtcgaagtaacgaggatcgtattctgtttctgtgaattgtttctgacggatactggagtattccaattctccgtaaacagtgatacgtttagtatccccttgtgcaggagttcttaagacagaggagacacggagagctgtcagccatcctaagtcttcccattctccttggtttcgttcacggatcgttggatagtgagtcactgtatcatgtttgatatatccgtaagagatgactccttgtaacaatagcggtagcgatttttccgtttttttattgattacaaagtggaatggtttgcctccgtataccgatgcttggtaagaatattcggatcctttgtgagtgtagttattctctcttttcaaggattttgttttcccgatcatcttactaaatgcagctccaacaatcacatcatgggctggtttagcatctaaggcaacagaagctcctctgctgtaataagtgaattcttcagaagtaggtgttcctacttgcgatagcatcgttcctagtcctgatatccacaggttgttatagctaacttcatcaaagcgagctagattcattttatcgttgagcaagccttgtttgactgtgaccattgacatttgagatcccagaatcgagttcgcatagaaatgattgtctctaggtacataagcccattgtctataagagtcaaatttccagagcgctgagatcgttccattttgtagttgatcaggatccagagtgagtgttcctgtatatcctttctgaggagcaatatcacccgtcagtactattttctgagcttgcatttttgatgagtctgtagggagcactaacaaggagatttgttggtcggatcttaatgcagggttctggaagaaggtcccattaggatcgatgagtttgatttctcctcctaggattacttggttgcttgttgtagttgtagccgttggtgttgtcgtaggtgtggctgtagctgcagcggcaaagtttcttgtacgagatgtgtgtgcagcagctactgcaggagaagacgatccattcgcgctttctccttgattcgaggcgtcattattattttgctccttggtatcatcactattctggttactttcactatctgtagatggggttccaccgcttccacttgtagtagtgtctatgattctcaattctggaggagtaaagatatttccttcagcaataccatttttctctacgctggataaatcaatggtcatgttatttatgaccaaagctccatcagcaacagtctggttcgaaagaacagatccaggtgtcataacgagagaagagccttctttctgctcaaaagaaatgacatgaagctcggtatttggcttcaatacaagagatccactgtgtagaactacgttttgtggaatataggatttattttcatgtaattcagaggagaacagaatcgttcctgtaaacgcagagtttacagtttctgaatcctcagatttattaatatcgagagtatcgtaggcagttgcctgtgtacctgttttcttagtagaggtccggattgcatcaaagaaactgatcgttttcccttttgcagcttgcatggttaatttaacatctcccgcaatactacagaaagtagaggttccggtatcagaagaagtaggacggtattcattgtttcggaaacaaatatttcctcctgaagcaatgagtttcaggggaaggttatccgtctgagatccgtttgagcttgctatttgtccaaagatagcagcaccatattttgttacatctcctgaggttgtggctggtgtgccttctgtagttgtgcttagcgttggggttactaagtttcctgtgaagagaacagagcctaaagactcaatagatgcttcttttgtaaagtaaatcgcgcttccttcttctagagatctgttttggttaaatgtcgcagtataggctttaatggaaacgacaggtgcgtaaatagtagctcgttttaaagctttatttttttcaaagtagtaggagccagactctaatttcactgtttctgtattttgtgtgtctggcaccaacccaatagcagatccgaggtcagcaacgttttctaagaaatgagcccctcctgatagagaaacagcagaagtagctccgatagctcctccaaaggtgtcttttctctgagtatctgtagcgttattagcattgtttgttgcagagtttttagaaaatactacaggagtagcaatggttacagtaggagagtagatagctcctccagcaacctgacctgttgtagattgagaagagacagtattcccggagaaggtgacagttcgtctagagtcccgctatcgagattaaacaatgttttagcatagaccgcacctccgaggacgttagatttggaagaggagccttctgtggtgttatcgatagctttgtttccagaaaatattccttggccagagaagttctcaatcttaacagtttctccatagatagcacctcctcctattaaagtaggagtttctgttgtagaaccagcttctggctcagtcggtccttcagagtctccagcgctatctccagatgaggaagagtctggattatcagaagatgcagtaacgtctgaacctgaagaattagatacaggggagctatcagtactcgcagcatagcttttagctaaacaagcgtttgcagagatagattgatctcctgagggagcccctgaagaagctgctcctccatcttgaggagtagatgatccacttttagaggacgatgagacactctcgtcagttatttcctcagtgtggctatcagatgattcgtctgtgttttcgttagattgatcaatactactattgggaagggtattttcttcattagattgtgtagaatcttgtagttgttctccagattcagcgtttccagtatctgatgtgtcttgagactcattgttaacaacaccagtccctgtatcagcagtatccccttgagatccttcaaggttagtgttagccgaacttccttctgtattagaattcggattttctgttgctgtagactcttctccttctactggaggaatctcttctggagcttcaggagtgctttctactattgctttaacagtgttatctgcaaaagtgaaggtagacttgaggttagatagagtaaccgttttagaatgaataaccccaccttctttagcagcagagttatagtgggataagagcgatccaattgcatcaaattctacgctttcagttaaacagagacctcctcctacatcctgggatgaattccctgaaagttcaagattgttaatacgggaaagtttagcttttttcccgtaaatagcccctccttttttcgcagaagtgttttgattgatagcgacattcaaaatgttctcaatcgacacgtctatatcgctattagtatcagaagtttctgtttgatccgtttgatcagactcagcctctgttagagaaggggctgccggttctgccgtagaggcaaagaatcgatttattttagcagaagcaactacttcggnagtgcttgcaggcgaggaggaagagggggtagaagactctggggtatctgttgttggtatagacgctagatctgtaaaaatagctcctccagactcctttgcagagtttttagtgagagtcaccgtttttaaattagataaagaaagtttgttagtgcagataccaccaccgtgccctttagctgtattttcagagaaaatcacttctcctacgagagggggagtagttatactttcactagttgtattagtaacagacatggtttgagtaacgtaggctcctcctccatgttgacctgccgagtttttcaaaaactgtaggctattcgtgttggtgcaagacaagttttctttagtgaatacacctgctccagaatcggtagctatgttactgacaaaatctatagtccctgtaattccagtgatggtcaaagatttttctgtatagataccaccacctttacctaaaacatcgtcggggctaggagttgattctggtgattctgatacttgtgtatcttttgtttcagacgaaccatcttgatttccatttgacttagtctgttccgtttctggagtgctatccagtgtatcttcggataagctatcaacgcattctgtgagcaatacgatcatttcttcatccagacattgttttactgctgttgctcctgcagcattcccttggaaatgtacattgttgcaatcactgattaacatatcttgttctgaatagattccaccaccaccttgttccccaccattggaggagaaggttgcttcggtaacattttctaaagatactcgttcttttgcatagacgctaccccctttctcganngagatatttacttctactagtagagattttatgttttcaaagactacctctttctctccataaatagctcctccgtttttgagggcaactctgtgatcaaagataacttcaccttctccgaagaaaaaactattgtcatggagttctatgcttggattagagagagagtcctgagattctgagatagttagtttctctctagcataaatgattccgccattgtctagttcttcttctgttttcttatcagtttctccagaagagggagctgaatcttgtgaattctcagtattttctccagatgaagatgaagacactccttctgtcgttggagaagcttcactactactactaagatgttttctaggtaatccggaagatgtcgaaaagtcatagaatgaaacactatcagcagctcgatactctgtgttgtctgctagcatcatatcagtaaatgcttgagaagttgaatatcctactttgctaacattgcagtcggtattctttatttgatcttggatcgagctcgcctcagtaacggaggagagtactgcagcaaatacagcagtagctgacagaaatttcataatttaaataacctaattgaacaacctacgatgataggtattgaatagatcataaatgaaaaaaaatcaagttttctataagcccaaaaaggcctagagagatatgtaagaggggttttctttgtattaagagatcgtaaaggccagccttttgaagaggctggccaaaaagaattagaagatcatgcgagcaccgcagctagtcatttgcgataggtatacatgcctacatcgatagtatagtttccgtagagagtccagaagggaccaagatatagttgagtactgtattctgctctagcagaggttctagttggcactccgcagataacttgaccagcttcattcgaagacaatacccgatatttacagacaggattatttctgtagatagaaggcatgtaggctaatgcaagcttattatacataagaatattacagttcatgatagctccttcgacagcgcatcccacaggaagcgacagatttctgtaagcacaatcatcgaagtgtcttggatcgtaatcgatttctgtgaactgtttctggcgaatgctggaatactcgagttccccatagacagtgatccgtttagaagaatctttagaaggttctttaagatccatagagatacgaagatccgctaaccatcctaaatcttcccaatctcctttatttctttcatggatagaagggtaaagtattgttgtatcatgtttaatatgtccataggacacgactccttgtattaggaaaggaagtgcccaaccatgttgcttattgagcaagaaatacaggaatttacctccatagacagaagcttggtaagagtactcagagcccttatggaagtaattatgcatttttttgatggctttggttttccccaccatcttactaaatgcagctcctaggataaaatcttgtctaggtttggcatcgatggcaactgaagttccgcggctgtagtaactgaattcttcggaaagaggagttccttgttgagctaagaaagttcctactcctgaaacccagaagttattgtaagcgatatcatcgaagcgggcattattcaacatgttgttgataagcccttgcttcacaacaatcattgagttttgggagcctaagatagagttcgcataaaaatgattatccctaggtatgtatacccagcgacgataggtatcgaatgtccatctggcttgaagtttccctgtttgtggattagaatttaatgtccaggttcccatgtaccctttctgagggaaaagatccccagataaagttaaatcatagacttggacgtcacttgtgttagtcggaagcttaattagtggtacatctagatcgcttcctaacatagggttttgataaaagtttccattaggatctattaaagtaaggtctcctgttaggaaaactttgttctcgctcatagttggagtagttgcggcagaacctgaaggcgctgctgcagaaatccctttaggatttgttggtatactcctgctgaccccgcttcttccggatgcactagaggtcgtggcaacgatacgtaattctggaggagagaagatttcccctgcttgaggagtccccatactggaaagatcaatcgttaacccattgatagctagagctccgttagctatgttttggttagataacacagctccgggttccataattaatttagacccttctttctgctcaaaagagactacgtggagttctgttttctctttaagaactaaagttccgttgtgaaggattgcattctgtgggatgtaagatttgttttcatgtaattcagaagagaacacaatagttcctgtatatggcttactgttctcttttttattaatatctaaagtttcataaacgttttgtgttgaacctgtttttttggtagaggtgtgcacacaatcgaaaaagctaatagtcttccctttagtggcttgtaaagagagtttgacgtatcctgcaatactacaaaacttgctagcgggagtaccaccttggttattctgtaaactgttgttgctaaaagtaatgtttccagaagaagcaagaagggttaaaatggcatctgtttgaggcgattgagtggttcctggatctccaaagatagctgccccatagttggcagtatttgtattttgtccagatgttgcagaactagcttgtgtagctgtaactttatttcctgtaaaaagaacagatcctaaagactcaatcttagcatcttttgtaaagtagatagcgcttccatcatgagtggatgtattttgattgaaggtaatattattccctttaatggaaacgctaggagagtaaatcgctccacgtttattagcttggtttctttcaaaaataaaagaactgttttttaaagtaattttttctgtaatgctattttgagatccgctagttgctctgggtgtatttgcattagctagagttcctattgcagctcctaaatcagccgtattccctgaaaatcgagagactccagatagggtaatggctgtccctgcaatggctcctccaatggtatctttaatagaatttcctgaggatgaagaagtcttcggtgtagccatagaggctgtattgttagagaatgtcgcaggacaattcaatgtaacagtaggggagtagatcgctcctcccgctatttgccctgttgtttgagatttcccagtggagacactgttccccgagaaaatataggaggttccagcatcggaagatctaatagacaaagaggttttggcatagatggctcctccttgtacgttcaacgatgattgggagggattgttatcgatagcttggttcccagagaactgacaagtcccgctacattgagagaatgtaaactgttctccatagatagctcctcctactacacctgaataagttggtgttgctggagatgatggtgcggctgctgcggctgcttgtagggaagcagcagctgcagcaggtgctgaagctgttgttgcgactcctgtggatgaggagtttgctttgttgttcgagaaagagaagcctgatttcagattagaaatatttacagttttagcatgtaagcctccaccttctttcccaacaaggttctctgttacagataaggagactagagcatctagttttaaagattttttacagcagatacctccacctatctctgtagcggagttctcagagatattcagttggtctatgcgggacatcttggcttttttagcatagattccaccgcctttcttagcagtgtttttgctgatagtcgtatcaactacataatcgatcaataagtctgtatcagcattaggatcttgagttttctcattagaggttgcaggagaggcttgtgaagaggctgctagtaaggttaatgaagagacggtagaagatgaaggtgtgcttagagcagttgaggccactgggtcagactcgggagtagatgtcgcggcagaagctgctgcgggctgttctgcagtatccgccgttgggaagctatctgggcatgtgtaggctccaccaccattttctgctgcagaattcccggatatagaaatgctttgaaggttagataaggcaagacgttttgtacacacgcctccaccattacctcctgtagatttattgccagtaatgactgtttcaccatgtacaggcgtgattcctggaattgtttccacatcagaggtgtaagtctgagagatttctttgggtaacaaaggctccaccaccatgtttttctgatgtgttattaattaaacagaaactatccagtcctgtcattgtaagagctttatctgtaccttttatgaagagtccaccgccctcttttttggcagtattctcttggaatagagtcttccctgtcaaattagatagggtgatgttgtcttctccgtagattcctccaccttgtttatcggaagagtttttcaaaaattgtagacggtgagagtttttacaagtaagggttccttttacgtaagcaccacctccaacatctgtcgctttgttaatcgcaatttcgataattcctgtgatgttagtaatcgaaagattcttatcagtataaagcccaccgcctttagctgtgactggaactgtttttgaggtatccgagtttgagccagagctagagtctcctgagtcggagactgtagttgctccagaactagattgaggagaggaagaggcccaagcatctgcatttcctgcagatgcttgagcttttgaaggtaaagtgattttttttgttttgaacgttccagctttattgtacttaatgcgaatttcttcaagatcttggaagtttatatttccttcaacatatagagccccaccaccttgtttactgtagttagaattaaaaagactctgtttagaagattgaattgagaggtcacctttagcatagatagctcctcccttttcttcagcaccgttagtttgtacttttaatgatgtaatattctcgaaagaaacatctttctcagcaaagatcgctcctccatctttagtagctttatttattgagaatagtaccttttgagagtctgcgatagtaaggtcgcctttagcatagatagctcccccagatcctggcttatgagagggagttgatgtttctgtatcggtttgagcagcaggagtagctgtagcacaaataaagtgactttgaagattagctgctgcgggttcagctttactggaactggaggaagacgccgaatcatttccgctagaactactagaacccgacgtttcgcctgctgtttgagcttcaggttttgtaggtttcttaacaggagcaggaacttctgcagagttggaggagaaagtcgctttagtaatccctgatagggagattgtagatcctccaaaaatcgctcctccggatagctgggataagttattttggatggttagacctgtcagatctgtaaatagcagctctccttgagagaagatagcaccgccttcaccagtcatttttatctcagacagagttaaggaaccttctgttcctgatcgtgtcataaaggacaaaactccggagtgcgcgttataaaangcgccgccacctttaggatcaggagtcgttgttgtagagtcactatccttagaaacggaagcagtctctctgttagagctagaggagtttgagttcgtgggagttgttgtattggtagtaggaatgttggtaaattttgtgaaagatgcgttactagagacgatatattctgccccagcttctccaactgtttcagtaaaagtggtagaggaagaagttcctacgcgagagaaatttaantnnnntaggttctgg

SEQ ID NO: 2 - protein, 98 aa, Chlamydia trachomatis
GIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 3 - protein, 924 aa, Chlamydia trachomatis
  VARIANT (1)...(924): Xaa = Any Amino Acid
KSVFLSYSKQLPNRLSKTYKKSWIARKALSVYSSRSKQCLKMFITKELMNRVIEIHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTITFSDNAAGDLGGGAILLEGKKPSLTLIAHSGNIAFSGNTMLHITKKASLDRHNSILIKEAPYKIQLAANRNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAEIRAGNAPLRLSGSPSIHDPEGLFYENRDTAASPYQMEILLTSDKTVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNXTLCAALDHNAMVRICSKKDHTYGKWDTFGMRGTLGASYTFLEYDQTMRVFSFANIEATNILQRAFTETGYNPRSFSKTKLLNIAIP

SEQ ID NO: 4 - protein, 609 aa, Chlamydia trachomatis
VVMFPQKITLWLYPLGLFANLFFGTAFCVQWFLTRKKGYSVVPKIFWYLSGTGAVFMICHGFIQSQYPIALLHSFNLIIYFRNLNIASLNPLPVSKIASLLVSVATAITVSFAIGTRYLHHMTWMASPNILHLNLPEASLSWQLIGCIGLTIFSLRFFIQWFYLEYKNQSALPAPFWKASLLGGSICLLYFLRTGDLVNVLCYGCGLFPSLANLRIASREAFRKPFSNSCFISAGEHSGDTLGGNLLKEMHAKYPDIHCFGVGGPQMRAQNFHALFTMEKFQVSGFWEVLLALPKLWYRYQLLYRNILKTNPRTVICIDFPDFHFLLIKKLRSRGYKGKIVHYVCPSIWAWRPSRKTVLEKYLDLLLLILPFEQNLFKDSALRTVYLGHPLSETIKSFSPNLNWKDQLHLPTDKPFIAAFPGSRRSDILRNLTIQVQAFQASSLASTHHLLVSSANPEYDHLILEVLQQNRCLHSHIVPSQFRYELMRECDFALAKCGTIVLETALNLTPTIVTCQLRPLDTFLAKYIFNIILPAYSLPNIILGRTIFPEFIGGKKDFQYEDVAAALNILKTSQAQEKQKDSCRDVYQAINESASSMKECLSLIFETAS

SEQ ID NO: 5 - protein, 425 aa, Chlamydia trachomatis
MMACNQELLSPRGLDLLSKNSHSNLTPTIFYPSDHNIDLQSFSTHALSVVRTLKKAGYEAYIVGGCIRDLLLKTEPKDFDISTSAKPEEVKTLFKNCILVGKRFRLAHIRFPNQIIEVATFRSGSNEEDSLITKDNLWGSAEEDVLRRDFTINGLFYDPSAEIIIDYTGGVEDLKNRYLRTIGDPFLRFKQDPVRMLRLLKILSRYAFTVDPKTLEALQESRHELVKSSQPRVFEEIIKVLSSGESTIFFQLASEHRVLEILFPYMAKAFSLSKTLQDQTFACLTALDTKIQKRSFCSERHFLLAILLFPIVNFNVRYKYSQYPTMTIQSIFDYIRNFLTEFFADSFTSCSKKNFILTTLLLQMQYRLTPLSAMKKEKKSFFNRRLLRHAYFREALYLLEIRSKVYLKVEATYGEWLKHYELASE

SEQ ID NO: 6 - protein, 453 aa, Chlamydia trachomatis
MSAFLSFLTAFDDFIWSYIAFVLILLLGVLFTCKSKFAQFTQLPAFFKLFYHFSKEASSKKENQKKGVHPLKVFFASAGGNIGIGNVVGIVTAASVGGPGALFWVWIAGILGSIVKYSEVYLGIKFRQSDANNVYHGGPMFFLDKAYRTRIVSVIVAVLLCIYGVEIYQFSIIANTLASCWDVPKLMAIASLLFLVMYAVQGGLQRIGKICSLVLPFFMLVYCGMAFYILIQEIHTLPALFSSIFRSAFTGHGAIGGFAGCTVASTIRQGLSRAAYSGDIGIGFDSIIQSETSATNPQTQAQLSIVGVIVDNLVCTLSLLIVLASGVWHRAGLEGSEIVEQALSSYFPYIRVFLPAFLFATGYTTIISYFLVGKKCANFICGNKGSKFYTVYGIIALPAFCFLPQDTALLVMSVSGALLLCLNLLGVFLMRKELIFPKKEAETLEVSESTLSS

SEQ ID NO: 7 - protein, 167 aa, Chlamydia trachomatis
MPTRSLPTFLTLLLLASIDWVSKLVVLLKSCQLSPHSSAFLYSYVWGHFSFLIIPSFNEGAAFGLFAQYKIPLLIFRVCVILGLALFLRIKYKSLHRRTRIALTLILAGALGNVGDILLHGKVVDFLFLSYYSWRFPSFNLADAFISIGTLLLIGHLYFTKESKKCF

SEQ ID NO: 8 - protein, 135 aa, Chlamydia trachomatis
MVKNKHEKENCMPLTDEEIANFKTRLLEMKAKLSHTLEGNAQEVKKPNEATGYSQHQADQGTDTFDRTISLEVTTKEYKLLRQIDRALEKIEEASYGICDVSGEEIPLARLMAIPYATMTVKSQEKFEKGLLSGN

SEQ ID NO: 9 - protein, 154 aa, Chlamydia trachomatis
MLCPFCNHGELKVIDSRNAPESNAIKRRRECLRCSQRFTTFETVELTVQVLKRDGRYENFQESKLVNGLKAASSHTRIGQEQVQAIASNIKQDLLGKQNREISTKEIGELVMKYLKKADMIAYIRFACVYRRFKDVGELMEVLLSATPDGEKQT

SEQ ID NO: 10 - protein, 201 aa, Chlamydia trachomatis
LSMFSGIIQEVARVDLIHHLGDSMEIGVFARKLIDVVPGSSFSVDGICLTLVKRQYELLFFDVTEETMAWTTIKDYTVGTMVNLERSVRLGDEIGGHFVSGHVCGIGTIIAIEKSYMFFKAPANLVPYILEKGFIAIDGISLTIARVKGDIFSVSLIPETRARTSLGYKQVGAHVNMEPDMMTKMQVDTIMRFHAEKEISK

SEQ ID NO: 11 - protein, 296 aa, Chlamydia trachomatis
YDDKNAGGHNYAFPCRKRDQQMMDYELLDSGDGKKLERFKDVCLIRSSATAIWPKSSPSLWGQYSAEFVRMGEQGQWRYRNRNLKEWWITIDSVSCLLKLTPFGHVGIFPEHAGFWKDLQPSVAKPSCRVLNLFAYTGASSIFCAQQGATVYHVDASKAAVKWAQKNVEGNAFQDKRVFWIIEDVFSFLKKEIRRGKTYDVILLDPPTYGRGPDGETFKIDRDFFPLLELCSQLLSSSFSHMLITSHTPGHTPEFLHCLARRALPMLPLQGWRLGENFCGEGNQRLPSGVFAQWSL

SEQ ID NO: 12 - protein, 224 aa, Chlamydia trachomatis
MEFIGKNNARVKSALALKRQRARNGTYFLLEGFREIHRALISGYRCSHVFCGELIADKEIALDRELTSLGIEKLYCSKDILEKLSFKENPENFIAVFEKKELSCQEFLGLQRKNQAPFYLIVEQAEKPGNIGALLRIADGAGVDGVILCDPVVDLYNPNVIRSSLGTVFTMPVWQASLKEVLDLVHQQEWQVFTTTPSAQTFYFDQDFCQPTVVVFGSEKDGVA

SEQ ID NO: 13 - protein, 419 aa, Chlamydia trachomatis
  VARIANT (1)...(419): Xaa = Any Amino Acid
LIFNVLYAILQDALVWKATWVKRTKSLSQPFRVVIVFAGCSFRKNLSRAPMRFSFFSGIRDLFRHLIISATSGALSDRLGWLWAVIARVFSGSVWLRHKIAKSPHQVQATVVSVGNIVVGGTGKTPLVLWLAQALHERGLSCAVLSRGYKGKYSKKKAFTIVNPALHTASCVGDEPLLLAKHLPSGAVRIQKDRKTLAEKSAGDFDVLSLDDGFQYNRLHKDVEIVLVNGSDPFGGGSFFPKGRLRDFPERLAKADYVMINGRCSPSDQRELDRLHPEXKIVIEPQISEIVWMNQSVNMPRDHWEGLGVGVFCGLGFPKGFLAMLRDAGIHVLGTYLLPDHVGITKQELELFCKKIILRQGVGILCTEKDSVKIGALAEEISLPVGEXRMRFSCVCNERRMXAMLDAIESIQKNKRVTT

SEQ ID NO: 14 - protein, 296 aa, Chlamydia trachomatis
  VARIANT (1)...(296): Xaa = Any Amino Acid
EVLGLYLATTSVAIGIGLAFALFFSPGKGCDLQGFNAVDLASSGSSGGMNFLATFAQVFPSNPLRSFVEGNILQIIIFALFTGIAMRLAGEAARPVERFVHGCNEIMLRMVNMIMSFAPYGVAASMAWISGNHGLTVLLQLGKFLVVYYLACICHAILIFGGLVRLGCRSSFSKFLSSMMDAISCAVSTASSSATLPVTMRCVSKNLGVSSEVSGFVLPLGATVASNMNGTAIXQGMAAVFIAXXYNCPLSLTSLLLLVVTATFSAVGSAGVPGGGMITLGSVLTSVGLPIQGTQS

SEQ ID NO: 15 - protein, 71 aa, Chlamydia trachomatis
  VARIANT (1)...(71): Xaa = Any Amino Acid
MFEFRFPKIGETASGGIVVRWLKQVGDPVQKDEPLIEVSTDKIATELAPSQAGILEECLVQEGEEFSLEXF

SEQ ID NO: 16 - protein, 346 aa, Chlamydia trachomatis
  VARIANT (1)...(346): Xaa = Any Amino Acid
DSYRVSSFSSWHFGGVPGSGRGRVFPGXILARLRETAAANTPVKSPVENPVREENHSVDREQKWLSPAVLGFAQREGLDLQELQKISGTGEGGRITRKDVERYLSDKREPRDPICSKEENRIPLSPLRRAIASSLRQSSEEVPHASLVVDVDVTDLMNLISAERERFTAAHGVKLTITSFIIQCLAKSLEQFPLLNGSLDGDTIVLKKAINVGVAVNLNKEGVVVPVIHNCQDRGLVSIAKVLADLSSRARSNKLDSSETKGGSVTVTNFGMTGALIGMPIIRYPEVAILGIGTIQKRVVVRDDDSLAIRKMMYVTLTFDHRVLDGIYGGEFLTALKNRLESVTMS

SEQ ID NO: 17 - protein, 169 aa, Chlamydia trachomatis
VKVMYVPGIAENLCLDIFHKQKQVISQYFASFHYDCVHQLTEKLLCHQGSVFFSGIGKSGCIARKLVATMQSFGEKAFFLSGDLLHGDLGVVSPGDIVCLFSNSGETREILEWIPHLKNRPIFLVGITAAPCSSLAAFSDFVVVLPKLEELDPFDLNAYNLNHMPITFF

SEQ ID NO: 18 - protein, 110 aa, Chlamydia trachomatis
ALRSKGSNSSNFGSTTTKSEKAAKLEHGAAVIPTRKMGLFFKCGIHSKISRVSPLFENRQTISPGETTPKSPWRRSPERKKAFSPKDCIVATNLRAMQPLFPIPEKNTDP

SEQ ID NO: 19 - protein, 258 aa, Chlamydia trachomatis
GKISMHDALQSILAIQELDIKMIRLMRVKKEHQNELAKIQALKTDIRRKVEEKEQEMEKLKDQIKGGEKRIQEISDQINKLENQQAAVKKMDEFNALTQEMTAANKERRTLEHQLSDLMDKQAGSEDLLISLKESLSSTENSSSAIEEEIRENIRKINEEGRSLLSQRTQLKETTDPELFSVYERLLNNKKDRVVVPIENRVCSGCHIALTPQHENLVRKQDHLVFCEHCSRILYWQELQAPSAEGATTKRRRRRTAV

SEQ ID NO: 20 - protein, 697 aa, Chlamydia trachomatis
LVGKAKNKKKFLKNRKQVLVPGTLFVHSRKGFGFVSPDQPELYPFDIFISASDLKGALDGDHVLVALPFSLRGGEKRKGVIHKVLSRGKTVLVGTIVSLINPTLAMVCVNTIGPEHPLKAELLPKRTYKLGDRLLLKTPVWKENYPSKEPPPLAMLEFIGNISNAKTDFPVIKAEFSITEEFPDAVVQEASQFLQKHVTQALHSRKDLRDLLCFTIDSSSAKDFDDAVSLTYDHEGNYILGVHIADVSHYVTPNSALDREAAKRCNSIYFPGKVIPMLPSALSDNLCSLKPNVDRLAVSVFMTFSKEGFLSDYRILRSVIRSKYRMTYDEVDEIIEKKQTHPISKTILKMAELSRIFSDIREQRGCTRLVLPSFTMSLDNLQEPVALIENKQTAAHKLIEEFMLKANEVIAYHISHQGITMPFRTHEPPNEESLLVFQETAKAMGFTITQTPAQEPDYQYLLQETTAGHPLEPILHSQFVARGSMKTASYSTENKGHYGLCLDYYTHFTSPIRRYVDLIVHRLLFHSLSVEEEHLEQIVRACSSQERIAAKAEGAFVNIKKARFLKKFIEEQPATLYKAFIITASPEGISFVLPEFCHEGFIPAAKLPQAYVLQTKIGLEELPEHLRPGAVISVQLASVTLLTQSIEWTLVEATTKAKAKRTSKKKKTESVTTKEKKKSSAKKKKGATKTKKGSGKN

SEQ ID NO: 21 - protein, 463 aa, Chlamydia trachomatis
  VARIANT (1)...(463): Xaa = Any Amino Acid
EEELSIFLSWKSVTEVFEVLSTNGDTHLGGDDFDGVIXNWMLDEFKKQEGIDLSKDNMALQRLKDAAEKAKIELSGVSSTEINQPFITIDANGPKHLALTLTRAQFEHLASSLIERTKQPCAQALKDAKLSASDIDDVLLVGGMSRMPAVQAVVKEIFGKEPNKGVNPDEVVAIGAAIQGGVLGGEVKDVLLLDVIPLSLGIETLGGVMTPLVERNTTIPTQKKQIFSTAADNQPAVTIVVLQGERPMAKDNKEIGRFDLTDIPPXXRGHPQIEVTFDIDANGILHVSAKDAASGREQKIRIEASSGLKEDEIQQMIRDAELHKEEDKQRKEASDVKNEADGMIFRAEKAVKDYHDKIPAELVKEIEEHIEKVRQAIKEDASTTAIKAASDELSTRMQKIGEAMQAQSASAAASSAANAQGGPNINSEDLKKHSFSTRPPAGGSASSTDNIEDADVEIVDKPE

SEQ ID NO: 22 - protein, 150 aa, Chlamydia trachomatis
  VARIANT (1)...(150): Xaa = Any Amino Acid
PILKKHWLLLSDSSVENSLKSNLKLKQSPTKLLLTRKVDAVFDVEQKLYTPEEIGAQILMKMKETAEAYLGETVTEAVITVPAYFNDSQRASTKDAGRIAGLDVKRIIPDPTAAALAYGIDKEGDXKIAVFDLGGGTFDISILEIGDGSF

SEQ ID NO: 23 - protein, 109 aa, Chlamydia trachomatis
VFNMSEKRKSNKIIGIDLGTTNSCVSVMEGGQPKVIASSEGTRTTPSIVAFKGGETLVGIPAKRQAVTNPEKTLASTKRFIGRKFSEVESEIKTVPYKVAPNSKGRCGL

SEQ ID NO: 24 - protein, 120 aa, Chlamydia trachomatis
KMLFMDFLPPIESMEKALGFASQTSEEVKNWAIGFQMILQQFKQIFEEKGVVEYSSKGELFNPYLHEAVEIEETTTIPEGTILEEFTKGYKIGDRPIRVAKVKVAKLPAKGNSDSNEEKE

SEQ ID NO: 25 - protein, 95 aa, Chlamydia trachomatis
MTETPNTSSEEIQTSEPSPDNELQVLQQENANLKAELQEQNDRYLMALAEAENSRKRLQKERTEMMQYAVENALYGFPSSYRKYGEGFGIRFSNL

SEQ ID NO: 26 - protein, 392 aa, Chlamydia trachomatis
MENRIEMSQLRASKKDSKISYVLLMATKLYLESGQPVGSKLLEETYCSDLSSATIRNYFAQLETNGFLRKNHISGGRIPTDLAFRYYADHNAPFLEQEEILAIQQKLTELPEYSKNIVKDLQKASEVLSDILQLPVCFSSPRFESDSVINIQLVAIDDQRVVFVLSTEFGQVFTDVLWLPEQLPENSLKRIEGFLQNYLRKQPSDSLLSQKEEDLGMVLYNEVVVRYLTRYCHFSEEDLYQTGLSRLLKYETFKDPETLAQGLAFFENRKHMCQLLNTYLHKETPTAFIGRELTDIVGNTDPSCAVITIPYYMDRTPLGAFGVLGPMNLPYQQVFGTLSLFTERLKVILTQSFYKFKLSFRRPCPTDPRCSQRPAELTRSSSIKLLPAKELS

SEQ ID NO: 27 - protein, 581 aa, Chlamydia trachomatis
MRTSLLFYRTSKNANKEASVLSYELLQKAGYLFKTSKGIYSYTPLFQRVILKMTEIIREELNAIGGQEVCLPLLQPAELWEKTGRWKAFLSEKLLYVLKDRENKAMCLAPTHEEVVSEFVAQWLTGREQLPIHLYQIGTKFRDEIRPRFGLMRAKEFLMEDSYTFSDSPEQMEEQYAKLRLAYQRIFDRLNLKYVIVAADGGKIGKGKSEEFHVLCSLGEDTICVSGSYGANVEAAQAIPPSYVYDSNLLPVEEVATPNIRTIEDLEVFFNTPKHKILKTLVVKTRQKDSEKFFAICIRGDRQINLTKVASFLQVDDCELASEEEILKHLHVEKGFIGPLYCPIPCYADETTRPMTNFICANNQKDVHCKHVNWGRDIPLPAFGDFLLAEAGDLCPQNGGAPYEIFQGVEVAHIFNLGTRYTESFSVGFQDKNGDKQLCWMGTYGIGVGRTLAACIEQLADNKGLVWPLAVAPFSITILYNGGDTEGEATALQLYQSLNTEGFEPLLDDRNERLGFKLKDSDLLGIPYKLIIGKSFQSTGLLEIESRSGEKCNVSPENLLDWCSKNLPCHTRKIPPLREQN

SEQ ID NO: 28 - protein, 357 aa, Chlamydia trachomatis
GRRGDESRRVTPSGQTISFPAVGKSTSAEDIQQLALPIIQSDAMASSPSVGGAVGEVEVAEIIADVMEKNDANVQKLDEDMEALLQAISSSEEQLESPGVRNKSALKGTNRSNSHREEIARNQRLRSLSVRHGLAHNRHSLRRLARGIRHHAGLVTASFATLHKTLRAVPQEDLKSILGKDSDTVLARLHKLGLEVNEKGEWRLRANGEVGSINQSISNLARSAERLHDDGPLSINDQASEEEVTACCSVGRRACQFLQEHLMGALRAIYYQILRFFHWISRRVEVESEDTDYYMRPGTFINPYASYLSSSPSVEDPRSLRDRLRDGGALSGEDTLFSMPQDESLDSESVSDDDRGF

SEQ ID NO: 29 - protein, 354 aa, Chlamydia trachomatis
QPANVYKWLLLCNHKVCMLLRKFCGYLFCSSLVCSFISVIVVSFRSEPITPSIAIFSSFSHNSLSECIESCQKELTSFGNMPTISLFNAEDNVVKARKIARTLHKDPNVVMIITLGPIATKVMSQIETQKPIIYAVVPAGEALRFPKEQVNIYGVNDSVDTNQCCFAIHAVTNNANSLVYLQPHEPFPSSLQEEITNKLRASGIKVTELPISAANMSSRIQFIAENRPSAVFFPLSSLSEKMGTTLIKSILKENIPLITDDSSLVMEGACAACSVDYKLSGKQIACIVARGYLLSKKNNEEHLNQISAEPILSKITFNEEIIRFLGLPFNMAPAHQFISFHSADNTGLVTLQIP

SEQ ID NO: 30 - protein, 406 aa, Chlamydia trachomatis
LTLPCFMDFRWFMKRNPHFVSLTKNYLFADLQKRVAQFRLENPQHTVINLSIGDTTQPLNASVAEAFASSIARLSSPTTCRGYGPDFGLPALRQKLSEDFYRGCVDAKEIFISDGAKADLFRLLSFFGPNQTVAIQDPSYPAYLDIARLTGAKEIIALPCLQENAFFPEFPEDTHIDILCLCSPNNPTGTVLNKDQLRAIVHYAIEHEILILFDAAYSTFISDPSLPKSIFEIPDARFCAIEINSFSKPLGFAGIRLGWTVIPQELTYADGHFVIQDWERFLSTTFNGASIPAQEAGVAGLSILPQLEAIHYYRENSDLLRKALLATGFEVFGGEHAPYLWVKPTQANISDRDLFDFFLREYHIAITPGIGFGRSGSGFVRFSSLGKREDILAACERLQMAPALQS

SEQ ID NO: 31 - protein, 230 aa, Chlamydia trachomatis
RRSRRKTCWLCYFGGDFIFLRLFDVSRFHGDMDIGLQGAVFSVFDLDHPEACMVNSDFFVAALCNFAVNKWSYRFRLWHLSSHLGDEFILANQLPPKKRYNRSDEAVDFFASFRYTPQIRVYGGIGYIISRDSTFPEDPLYFEGGIELRPFGLREDNLHAQPVFAMHFRFWEEHDFSIDQTYIVGMEWSKFQDVGRKVRAVLEYHQGFSHEGQFVREECDYYGFRLSYGF

SEQ ID NO: 32 - protein, 254 aa, Chlamydia trachomatis
RGCLITHTNMMKPLRFGYFFCAIYFTLLQAAFAKEPNSCPDCQNNWKEVTYTDQLPENIIHADDACYHSGYVQALIDMHFLDSCCQVIVENQTAYLFSLPTDDVTRNAIINLIKDLPFIHSVEICQASYQTCHHQGPHGKTSLPEQRSFCTKVCGKEAIWLPQNTILFSPLVADPRQATNSAGIRFNDEVVGKRVGSATSVEILSSYDYLMSPDSMETWILVSKELYSLFSTWIIQKLAWSTLTFLSPLCATLQ

SEQ ID NO: 33 - protein, 115 aa, Chlamydia trachomatis
VRFLLKLLSKEKENILLEGFWVLEVRVTTKARENRVVCLEDGILRVRVTEVPEKGKANDAVVALLANFLSIPKSDVTLIAGEASRRKKVLLPRSIKAFLLEQFPSESSSTTGKKS

SEQ ID NO: 34 - protein, 519 aa, Chlamydia trachomatis
FGYLLDSFLLFKNHLVIPNSAFRHFLALYQQIVEGQHVPCGNHILLIKTEPLHIRTVFARVVNQLLPQGLSHTSANILEPTTRESGDIFEFFGNPSAQIERIPLEFFTIEPYKEHSYFCNRDLLQTTLQSESEIKKIFETAPKEPVKAATYLSKGSEISSLHTDSWLTGSAAAYQYSEQADKNEYTHAQPCYPFLEAMEMGLINSEGALLTRYFPSASLKGMLISYHVRHYLKQIYFQVPSYTHGNYFSHNDRGLLLDLQQADIDVFWADEESGRVLQYTKRRDKNSGMFVIKNRVEEFRSAYFIAIYGSRLLENNFSAQLHTLLAGLQQAAHTLGIPGFSKPTPLAVITGGGTGVMATGNRVAKELGILSCGTVLDLEASPAQIDQPTNEFLDAKMTYRLPQLIERQEHFYADLPILVVGGVGTDFELYLELVYLKTGAKPPTPIFLIGPIEYWKEKVAHAYEINLKAGTIRGSEWISNCLYCITSPEAGIAVFEQFLAGELPIGYDYPPAPDGLVIV

SEQ ID NO: 35 - protein, 198 aa, Chlamydia trachomatis
AGSSHTRIPMTLFHSHHDAVSPDGYLCSSLQLVGTGVYEGEIEIQNIPSYFLGFQLPSHCIHLNLKSSLAQLGIDASLLHCELSKNQHRAHIHAQFTGHGPIAESMLALLQPGDRVAKLFAADDRRLVARGSPDYLESMLKNTDKAGHPLLCFGKKLEHLISFDVVDDRLVVSLPSLPGVVRYDSDIYWTPSSYSKIT

SEQ ID NO: 36 - protein, 304 aa, Chlamydia trachomatis
LFVVLLSRGSRRIMRMQIPRSVGTHDGSFHADEVTACALLIMFDLVDENKIVRTRDPQKLAQCEYVCDVGGRYSTEHKRFDHHQVSYTGSWSSAGMVLDYLHGLGFLSHDEYEYLNNTLVHGVDEQDNGRFFSKEGFCSFSDIIKIYNPLEEGGNTDKKIFFALRFAIDLLTRLREKFCYDRVCRDIVKQVMEKESVCLRFDRPLAWQENFFSLGGESHPAAFVSFPCSDQWILRGIPPTLDRRMEVRIPFPEEWAGLLGDQLVQATGIPGAIFCHKGLFLSVWDSQESCEEALNLVLKQQRLV

SEQ ID NO: 37 - protein, 124 aa, Chlamydia trachomatis
RSTEFSVKTAEISMTTIFERIIEGAVECDKVFEDENFIVIKDKFPQAPVHLLIIPKKHIEKLQDIQGDDFLLLAEAGKIIQLMARNFGIENGYRVVVNNGLEGGQSVFHLHIHLLGGGLLGSIA

SEQ ID NO: 38 - protein, 251 aa, Chlamydia trachomatis
EVTGYTRRRFSLACRSWEDYSVDGSKFRDRKWVSRCCQQWLRRGAERIPPTHSSSWWRLIRLHSIVYLLVMCCVDGSNSIQQRMRFCEYRTAAQEAKTSLSSDCSLLEARLALRALAKHHEYSAWREAFLRSQERFPSLEADRDIHEDLAASLLQKNIRHSSLTVRVITILAVGMARDYRLVPIVLQALSDDSDTVREIAVQVAVMYGSSCLLRAVGDLAKNDFFYSSTHHCLSCCSRVGDTRSCALIYEL

SEQ ID NO: 39 - protein, 358 aa, Chlamydia trachomatis
SKIHKLDGTERREAWRSLCVLTRPHSGVLTGIDQALMTCEMLKEYPEKCTEEQIRTLLAADHPEVQVATLQIILRGGRVFRSSSIMESVQKLACNSLSARVQMQAAAILYLEGDPFGEDKLTEGLSATSSILCEAASEAVCSLGIHGVHLAGRFLSKVQGMRSRVNLAFALLVSREKVEEAGDVVASFMHRIEPCQAIEQFLCEDQKIFVASSPLQVEIMKRDLAKKIIRLLVAAQYSKAKMVVAQYLAGQQVGWSFCSEVFWEEGDSEDFVEPLQEESFAFALEKALSFLQREGGEAGLHAVISLYPHSRWQDKLTILEAIAYSENRIATCFLRERCLQEAASLQSAAAGAVFALFK

SEQ ID NO: 40 - protein, 266 aa, Chlamydia trachomatis
  VARIANT (1)...(266): Xaa = Any Amino Acid
RQRKTFVKIFSLYRKMIARLLKAMFGSIPCYPGYNNIPAYSNSYFYCTLCDGVVSPTNVDIAIVVPNKPTAHSESKLSVLRCKNHPVKGLHSGGPITSLRGLIPFLSPLLEETHQKMLNLCARVHCLDVLTVCSTLIASLLAITGAILQFIVAAPIPTFIPLILFGVAIAFYLGAXLCTRISQKDTLRWQALSKNIIRSSHNVPVQAGTERYTLLTEFPPTCYENHSIDLYSIRPSSWCAPRVVVKKTACKLSARIQKILKNQRGH

SEQ ID NO: 41 - protein, 293 aa, Chlamydia trachomatis
FAVHELREETRKTNLMGKKRVPLPHVFNSNRSPVIRLSETVSIGGGTPIIIAGPCTLESQEHAITLGLQVKSAGAHIFRGSIRKPRTNPHSFQGWPPDHVVWHSRAKAVHGLLTETEVLDVRDVEITAEHVDLLRVGARNMQNFVLLDEVGQSHRPVILKRNPSATISEWLSAAEYLLQHASCPGVILCERGIRTFETTTRYTLDLNTVAWIKKETSLPVIVDPSHASGRRDLVLPLARAAIALGADGLMIEVHEHPELALCDGSQHILPCELEELGLWVQEIGSLETGAVFV

SEQ ID NO: 42 - protein, 261 aa, Chlamydia trachomatis
VSMCIKRKKTWIAFLAVVCSFCLTGCLKEGGDSNSEKFIVGTNATYPPFEFVDKRGEVVGFDIDLAREISNKLGKTLDVREFSFDALILNLKQHRIDAVITGMSITPSRLKEILMIPYYGEEIKHLVLVFKGENKHPLPLTQYRSVAVQTGTYQEAYLQSLSEVHIRSFDSTLEVLMEVMHGKSPVAVLEPSIAQVVLKDSPALSTATIDLPEDQWVLGYGIGVALASDRPALALEIEAAVQEIRKEGVLAELEQKWGLNN

SEQ ID NO: 43 - protein, 278 aa, Chlamydia trachomatis
TTNFRKRLRGLIMEETSCSGKIVFLGTGDPEGIPVPFCSCEVCSQGRICRLRSSVWVQSQGKNFIIDTGPDLRTQLLRYRVPRLDGVFLTHPHYDHIGGIDDLRSWYITHLESVPIILSSFTYDYLCKTKEHLVQKETPNNSLAASLRYTILNEKCGEQEFLGIPFTYVSYFQKNCQVTGYRFGDLAYLTDMSHYDEQIVDYLQGVNTIIVSASLGVLPKAFGSRTPSHLTLEQADLLMEKVGASRLVITHVSHYLHKVLEKDVTRECAYDGMELLWT

SEQ ID NO: 44 - protein, 416 aa, Chlamydia trachomatis
  VARIANT (1)...(416): Xaa = Any Amino Acid
GRKEMKKDNRDGKKERQSAIGWRFLLPREEQDPAQALAVCCYTNRAEQDRVSEYVEELISLANSCDLSVLETCTWLLRAPSSSFYLNEGKLEEIERILEEFPTIGTLLIDEEISPSQQRNLEKRLRVVVLDRTELILEIFASRALTAEAGLQVELAQARYLLPRLKRMWGHLSRQKSGGSGGGFVKGEGEKQIELDRRIVRERIHKLSRDLKNVERQREERRKAKKRNQIPTFALIGYTNSGKSTLLNLLTSADTYAENKLFATLDPKTRRCVLPCGQRVLLTDTVGFIRKLPHTLVAAFKSTLEAALQEDILLHVVDASHPLALEHVEITKAXLQELGITQPQVITVLNKMDKVADGVTASRLRLMSPNPVCVSAKTGEGIRELFTLHGGHGTRGVSSSDFTSSLQGIRIVYRIV

SEQ ID NO: 45 - protein, 314 aa, Chlamydia trachomatis
  VARIANT (1)...(314): Xaa = Any Amino Acid
YKXKERRSLVSHFLKRRIMMGKGFLDCESLVALQEMALHPIDLTASGCLSEERIQKNSLSVEGFTYSYATERVDDRCLEALQGLTEERELIKQMECMQQGAIMNRIEGFQSESRPVLHTATRAWVRDQDLHEEAAAIARHSKEEALRLAEFLYIARAKFSTLVQIGIGGSELGPKAMYFAMQGSCPSDKRIFFVSNIDPDNAAEVLREIDLEQTLVVVVSKSGTTLEPAANEELFRQAYQNKGLSIAEHFVAVTSQGSPMDDKSRYLEVFHLWDSIGGRFSATSMVGGVVLGFAFGYEAFIEFFKEQLLSMLMR

SEQ ID NO: 46 - protein, 268 aa, Chlamydia trachomatis
  VARIANT (1)...(268): Xaa = Any Amino Acid
YWRKIFSYIHGRRSCIRFCFRLRSFYRVFQGAAAIDAHALTPKMRENLPLLSAMLGVWNRNLLGYPTTAVIPYSTGXKYFTAHLQQCGMESNGKSISREGKEISFRTSPIIWGDVGTNCQHSFFQSLHQGTDIVPVEFIGFLHNQRGLDCVLSGSSSSQKLFANLVAQSLALAQGRDNANPNKRFKGNSPSSILVAQQLSPRIAGSLLAFYEHKFAFQGFCWGINSFDQEGVSLGKELATQIIGIMSGNAPVEFPEARGVLRLFNVLT

SEQ ID NO: 47 - protein, 339 aa, Chlamydia trachomatis
EYVRFVKVKRGWLMVSQTVSVAVTGGTGQIAYSFLFSLAHGDVFGLDCGIDLRIYDIPGTERALSGVRMELDDGAFPLLQRVQVTTSLHDAFDGIDAAFLIGSVPRGPGMERRDLLKKNGEIVATQGKALNTTAKRDAKIFVVGNPVNTNCWIAMNHAPRLLRKNFHAMLRLDQNRMHSMLSHRAEVPLSAVSQVVVWGNHSAKQVPDFTQALINDRPIAETIADRDWLENIMVPSVQSRGSAVIEARGKSSAASAARALAEAARSIYQPKEGEWFSSGVCSDHNPYGLPEDLIFGFPCRMLATGEYEVIPGLPWDAFIRGKMQISLDEILQEKASVSL

SEQ ID NO: 48 - protein, 266 aa, Chlamydia trachomatis
  VARIANT (1)...(266): Xaa = Any Amino Acid
HPMGSSVLQPLRNRPLFSCKEHRSSPMXTEWWDKARCEITVPGMVIADGLGALYIKHGVTIDNDKYISGLWNACASLGTQYYDELIDDISAIAEFYDHIIVTPGANADILPELKHLPLSKVKGQLVEIAWPAEIPMPPFSINGPKYMVADTTRNTCILGATFEHNQPDATPDAQVAYQEIMPPILALFPGLKDAQVLNYYAGMRSSSPTHLPMISRVQEKLWYLGGLGSKGLLYHGLLGDMLAQALLRDSTAYIAKEFLYTPEGAA

SEQ ID NO: 49 - protein, 124 aa, Chlamydia trachomatis
  VARIANT (1)...(124): Xaa = Any Amino Acid
GIFMHIAVLGAGYAGLSVTWHLLLYTQGRISVASPLFDPTPIGSGASGLSSGLLHGFTGKKAIKPPLANLGITTTDSLITKASLSIGEPIVTSNGILRPAASQEQATIFMQRAQEFPDXNGVVG

SEQ ID NO: 50 - protein, 130 aa, Chlamydia trachomatis
YIFSSNAWNTMLEITGVMVLPAYLTSSLFLVKFSLSKKYPKQAAIKARIAMITGLLGSLYSLWLIYAGGLQHLFMVAILLALGIPFYVDSGIRHKQEKTFLNRKEILKMTIMALAALLAIFLFSANKIHL

SEQ ID NO: 51 - protein, 358 aa, Chlamydia trachomatis
MLLKKRSPTSILGTLALTGIVISYMIGGGIFSLPQNMAASASAGAVMLAWMLSGIGIFFIANTFKTLSIIRPDLKAGIYTYSREGFGPYVGFTIAWGYWLCQIFGNVGYAVITMDALNYFFPPYFAGGNTIPAILLGSLLIWIFNYIVLRGIRQASFVNIIGVVCTLIPLLLFILITARFFKFSIFKTDFWGTAPQHTLGSIGSQLKSTMLVTLWAFIGIEGAVVISGRAANPSSVGKATILGFSGCLLIYVLLSLLPFGSLFQYQLAKIADPSTAGVLNILVGKWGEVLMNTGLLIAVLTSWLSWTILASEIPYAAAKNGTFPECFAIENSKHAPSFSLFMTSGLMQITMLLVYFLF

SEQ ID NO: 52 - protein, 136 aa, Chlamydia trachomatis
PFTNKKGGPMPYGTRYPTLAFHTGGVGESDDGMPPQPFETFCYDSALLQAKIENFNIVPYTSVLPKELFGNILPVDQCTKFFKHGAVLEVIMAGRGATVTDGTQAIATGVGICWGKDKNGELIGGWAAEYVEFFPT

SEQ ID NO: 53 - protein, 481 aa, Chlamydia trachomatis
TLAKKSFFHYTGGKALLEVVVSFRSVLLTALLSLSFTTTMQAAHHHYHRYTDKLHRQNHKKDLISPKPTEQEACNTPSLSKELIPLSEQRGLLSPIYDFISERLCLHGVSVRNLKQALKNSAGTQIALDWSILPQWFNPRVSHAPKLSIRDFGYSAHQTVTEATPPCWQNCFNPSAAVTIYDSSYGKGVFQISYTLVHYWRENAATAGDAMMLAGSINDYPSRQNIFSQFTFSQNFPNERVSLTIGQYSLYAIDGTLYNNDQQLGFISYALSQNPTATYSSGSLGAYLQVAPTASTSLQIGFQDAYNISGSSIKWSNLTKNRYNFHGFASWAPRCCLGSGQYSVLLYVTRQVPEQMEQTMGWSVNASQYISSKLYVFGRYSGVTGHVFPINRTYSCGMVSANLFNRNPQDLFGIACAFNNVHLSASPNAKRKYETVIEGFATIGCGPYLSFAPDFQLYLYPALRPNKQSARVYSVRANLAI

SEQ ID NO: 54 - protein, 204 aa, Chlamydia trachomatis
SCQPFSLFERSIQGMRALGTSEQEAWDTLYPDWLSIQRQGSIKQIETAIPLLITKVQNQNKIVFAYSERKVCAQDVTLEQLAKINLSFEKANLPYTSLPSNICFTKGVLFGSEIHKGPGLQHFLDAQPSLPEKVIYIDNEKYNVLRIGEVCKQKNIPYLGIVYTASKYHPPIYLPDIARIQYLYRQKLISNEAAALLSRHRLDK

SEQ ID NO: 55 - protein, 507 aa, Chlamydia trachomatis
QLLLMDDFAKLYLNTFLQKSWRKNSMLCTTISGPSFLEAKKQILRSLKECHCFEMRVDLLSVSCLELKKLMELAPISILAWKKPESCSQADWIDKMQSLAELNPNYLDLEKDFPEEDMIRIRQLHPQIKIIRSLHTSEHTDIIQLYAHMRSSAADYYKFAVSSSSTTDLLDICHQKRSLPENTTVVCLGGMGRPSRILSPILQNPFTYARSTGSSPVAPGQFSLKHHYFYNFASLSAQSPICALIGDTSRSIGHLTHNPFFSQLGVACPYIKLPLTPQELPKFFSTIRTQPFLGVSVTSPLKTAVLPFLDKQAPSVKASGSCNTLVIRQGEIEGHDTDGEGLFSVLMQHQIPLNNQRVAIIGAGGAAQSIATRLSRANCELLIFNRTKAHAEDLASRCQAKAFSLEELPLHRVSLIINCLPPSPSCTIPKAVALAPCVVDINTIPKHSAFTQYARSQGSSIIYGHEMFTQQALLQFRLWFPTLSFKHLEKTFIRRAAVLASLFSIAP

SEQ ID NO: 56 - protein, 379 aa, Chlamydia trachomatis
TSLYPIMIELVTDSPHPIHLVDSLQNPKLFASLSTDFPLIFITNTKLNTLILPPLLDLARSLGFSVETLTIPEGEETKTGDTFLSLHQQLTDLNVPRQATLIGVGGGVILDIAGFVAATHCRGMPFIAIPTTLVAMIDASIGGKNGINLNHIKNRIGSFYLPKAVWICPRKLSFLPQQELHHGIAECIKHAYIADSAILPLLQDPNALKKEDKLSLLIKKNCLCKASVVQQDVRDYAKRQILNFGHTLGHALEMLFIGKIPHSCAISVGMVLETKLSLSLGVARSPAILHSLIQDLLRYQLPVSLKDLYMRAQIPPHNCDQILSALTYDKKKQNTPLPPFVMIEEIGLAASFDGRFCQTISKHILTKVLEEEFYAMHNN

SEQ ID NO: 57 - protein, 357 aa, Chlamydia trachomatis
MHNQYGSIFSITTWGESHGPAIGVVIDGCPAGLSLSPEDFLPAMARRRPGQLHTSPRQEPDLVTILSGVYQNKTTGTPISLLIENKDVSSSSYEHLQHCYRPGHAQFAYEGKYGFADNRGGGRASARETASRVAAGVIAKKILLSQGIETLAFLSGFGTLESKNYPKLSDSLIQQVHTSPFYTLLPQEEIQNLLLLNPDDSFGGVVSFITSPLPIGLGEPVFGKLPALLAAGMMSIPAAKGFEIGAGFSSSQMTGSAYLDAFIADESGVSLQSNRCGGALGGISIGQPLEGRVAFKPTSSIKKPCSSVLKDGTPIAYRTPNQGRHDPCVAIRAVAVVEAMLDLTLVDLLLQHRCTQL

SEQ ID NO: 58 - protein, 164 aa, Chlamydia trachomatis
MPTFDTTKQIFLCGLPSVGKTSFGQHLSQFLSLPFFDTDHLLSDRFHGDSPKTIYQRYGEEGFCREEFLALTSVPVIPSIVALGGCTPLIEPSYAHILGRNNALLVLLELPIATLCQRLQHRSIPERLAHAPSLEDALSQRLDKLRSLTIKMPSLYEQRLPLKL

SEQ ID NO: 59 - protein, 440 aa, Chlamydia trachomatis
MVSSNQALLISPSIPYGEIAVPPSKSHSLRAILFASLSKGTSIIENCLFSPDSQTMLTACEKMGAHVRRIGDSLHIQGNPDPHHCHPPYFHMGNSGIALRFLTALSTLSPTPTLITGSHTLKRRPIAPLLSSLKQLGAHIRQKTSSSIPFTIHGPLSPGHVTISGQDSQYASALAITAALAPYPLSFSIENLKERPWFDLTLDWLHSLNISFLRDQDSLTFPGGQSLESFSYSVPGDYSSAAFLASFGLLSSSSKPTILRNLPSQDSQGDKLLFSLLKQLGAHILIEKHHIEMHPSSFSGGEIDMDPFIDALPILAVLCCFAKNPSRLYNALGAKDKESNRIEAIAHELQKMGGSVHPTRDGLYIEPSRLHGAVVDSHNDHRIAMALAVAGVHASSGQTLLCNTQCINKSFPHFVIAAQTLHANVRHYQADFPLRSSFCR

SEQ ID NO: 60 - protein, 142 aa, Chlamydia trachomatis
EKLSNDCPPGKVKESWSLKKEMFKECSQSKVRSNQGRSLRFSIEKERGYGAKAAVIANADAYWESCPEIVTWPGDNGPWMVKGIEEDVFWRMCAPSCFKLDRRGAIGRRLSVWDPVIKVGVGDKVERAVRNRRAIPEFPIWK

SEQ ID NO: 61 - protein, 463 aa, Chlamydia trachomatis
DRSCSENDIQTEGKERTLLGAGLTGAGLVLKLGSSYIPGGYGSALGKLGDVSYNKGRGALFAGFAHYLYVRFFQSKKAASGEALTPEEMLIEGAKIRKLANGLVLLGVGFACLGIALAVVGTLAVTGGAATALIVLAPPLISLGISLVISNMLHTTLGQWRAFARAQQDQDLLVDTKLKNISQADFSYRVDNNIEVVVDPRESNLPSIERLPQGEIDAALSLTKKQQRILILSGLLLLAGVTCTLLAGFGGLPAVQVLLLFSIGRAVLLSAVPMVVSGMVHVAHQLKARLQISLARRREARLKARMIREMDNRRWGESRASLLSKKEQEETWKLVGKPVIFQTEQAIREYVNGATKEERFQSILVATIILLAGLGVLSLTLIPGLAPISGGILAIGGVLLGISITMYLQRFIQWLYEQLIKLRDYIQNRQSVIVQGASACDFDAEDIIVDLVADLLRSMGILL

SEQ ID NO: 62 - protein, 253 aa, Chlamydia trachomatis
MRVADSIMKKSIGLVGDTGRMGVLLTQALLCRPHCFLGKGFSRRSQTSLEEVVTENDILIDFSSPEVTSLLLDFLLKTPRPVIIGTTGFTNDSGVKTKLSALSEYVPVVVCANTSLGAYVQKRLAAFAAKLFSTSYDVRILETHHRAKADAISGTAISLAEAIRSAKAESCEEEPEPFIEMHGSRLGNVCGEHEVSFVGEDERFVIRHEVFSRRVFSDGVLLILEKIMGEGLPKGYYTSDVLYESLFQEKVFG

SEQ ID NO: 63 - protein, 339 aa, Chlamydia trachomatis
KLRMTMRIAILGATGLVGQKLIALLQNHKQWEIAELGASSEKHALRYESACLWQEPLMEMPESVARGDLSIRSVEEIESNIVVSCLPSSVAFSAETTCLSSGKIVFSNATAYRMHKAVPILIPEINSDHLSLLEEQPFLGKIITNSNCCVSGIALALKPLLLFNIEHVHVITLQSASGAGYPGVSSLDLIGNTVPYILGEEEKILRETVKILGQPGFPAEFSITASVHRVPVAHGHVISVHVMFDQEVDLEEITSCYEKDSATYVLYDSPWHPQVRKDLAHDDMRLHIGPISYGGNTRTIKMCILLHNLVRGAAGALIANMNLFRDRGGFVHQERLTYA

SEQ ID NO: 64 - protein, 432 aa, Chlamydia trachomatis
RMLRQKTAPLVCKFGGTSVGTAQSIRRVCEIIQEERPSFVVVSAVAGVTDWLEEFCRLPKGKRAALTEKIRERHESIAKELGIEVSLAIFWEILEHFEDVEELLSEDQARILAIGEDLSSTLICSYCCTYVLPLKRLEARQVILTDSQFLRAVPDLALMQTAWGELALQEDAIYLMQGFLGATSSGKTTVLGRGGSDFSASLIGELCKARELRIYTDVCGVHTADPKILKDTQLIDSLTFEEMQELASSGAKVLHQDMLKPCVRAKVPIFVTSTFNVTKEGTWICASLNESTEGPVIKALSLKSNQALWFVEYNSPLVRLEDVLGCVRSLGFVPGVVMAQSLGVYFTIDWEEYPQAITKALEAFGTVSCEGPLSLVALVGAKLASWSMSRVFEALHRTPVLCWSQTDTVINLIINKDFGVAVTELLHDCLFK

SEQ ID NO: 65 - protein, 286 aa, Chlamydia trachomatis
MSVLGACITPFKADLSIDFAALESVVRSQEHAGNGIILFGSTGEGLSLTYEEKLSILSFVSTLNLNVPIFVGVTATSVQETMSWIDFAQQWPIDGFLVPTPLYTRPGLNGQKAWFDRVLSVSRKPIILYNNPIRTGVSLYPEVVKSFVSHPLCIGVKDSGGSAQACELFAESGLRVFCGDDNLWPDMRLSGASGVISVLANVWPELARDYVALGRPIEAWKKVCSWLNLSTNPLGIKALMAAQKMIECDAVRPPLSIRDLQRRDELADILACRATLQTELLSVCRQ

SEQ ID NO: 66 - protein, 214 aa, Chlamydia trachomatis
GDFTTFMRKAFLFGSIGCLCLLVTLESSGEGLYRGSNGRMTFISAVESANSQLELERKKEQRVIEILKEICKEIGVYESLFDEVTDSLEFCELLKKILAEKDSEDFLEDVSTQDSLSSNEQPISEQTIGDRVEESAMISECMIKDVLNALQQSTESFQRKEEEASFLERKDLELRERELAFKEERLSWEREKAEKEWAWKKEQYIRDLVKREQK

SEQ ID NO: 67 - protein, 196 aa, Chlamydia trachomatis
  VARIANT (1)...(196): Xaa = Any Amino Acid
MVAKSITKEYSETLISNPFVKVIAGSLFLACLAKISISLPFTPVPITYQTLGVFCLGLVMTPQMAVTTVVAYLLEGLFFPVFCSPMCGIAVFCGPTAGYLFSFVPAVALISWLYGKXGRSEAKSWDVAMILFVGGGVSLCLGALWLACFLKSIGVSNSLDLVGAFKIGVLPFLIGKIVKIALVVQGRSVRRLFIRK

SEQ ID NO: 68 - protein, 186 aa, Chlamydia trachomatis
LQQRNNNKTHSTQRSFMATPIAVPPSSASSQSSPDVSPHSSSASAKNAIYNTKQGRPWPVIVSQIALLIMRISSIIVLGLGIAFLASNPMLGWSLLIAAITLVISSLLCAIAISVYQTLTIRKLQSEVSSLERQSGVIFIEEGVEDALLSFESPFAGLEDDLVSPISPPLSPEDRSYRSSGDASRS

SEQ ID NO: 69 - protein, 124 aa, Chlamydia trachomatis
TEIAIAHNREEITRVIAAISRLHPNIGFDARNAIPNPSTIIEEILIIKRAIWLTMTGQGLPCLVLYIAFLAEAEDECGETSGEDCDDAEEGGTAIGVAIKDLWVEWVLLLFLCCNQLGTGVFTQ

SEQ ID NO: 70 - protein, 112 aa, Chlamydia trachomatis
KHMPVVQKPSVLEYAPVSPSTTSDSKIPNHRSGASCIKISMILACSLLAVGIILAIALLASPGSLAYVLVAGILALHAVLALALGLWISSSTKHALLSENSGTELITTKKQQ

SEQ ID NO: 71 - protein, 643 aa, Chlamydia trachomatis
LILKLKVYLLFFLFFIMTTDQPFTNKLITEKSPYLLLYAHTPVDWYPWSAEAFQKASAEDKPIFLSIGCTHSKWCQVMLKENYENPEVAAILNKYFVCIKVDKEELPHLANLYFELSQMLSVSGEVQDSPTWPLNVFLTPNLLPFFSLGYASFAGKMRASSFVQMLEKLHIMWEDREDREVFVQQAERVLEVALAAFLEGCSCKKESLEEECLKRVTEAIYRDVDAQFGGVKSFPKTLPGLLSLFLLRVGAEYQDSRAIFFVNRSLQSVANGGIFDHLAGGFFRYTIDDRWLIPCFEKRAFDNALMMLVYTEAGVYMRNPEFVIVAKRVLNYLIKELTDPKSGSFYLSEYGQQWAGTDIDSQYTWSGEEIRSLLGEQAEMFCEYYDVSREGICNGRNILHVSPYMNRKEIEERYHCSLEEFQKKLEASREKLCVYREGKTQASKDDQSFTFQNGWGIFSLIKTGILLGEPECFVVAERCGEFIANNLYKNGRLLRRWRQGESKYSAGLEDYAAMIMGALALFEIGSGAKWLVLAEELAKEVLVSFRADTGGFYSTDGRDSSLLIKKACFVDGDAISSNALLCQGLLKLHIISGKRHYLTFAEDILQCVQGKWAKHKFSSLGSLLAAQEYFFQTTSEDFYFFRE

SEQ ID NO: 72 - protein, 406 aa, Chlamydia trachomatis
LLPRTRVGSFLEYKLLCLGVCHISREAVRSKEKGEEEQPKILKVFLPKNYKSRMRVVKRAVIACYLGITIFSGIAFGYEGAFSSGSFEQNPSGVAIHNRVLFKVDEDTVVTTLDVIRKLNILFYSTCPQLVDSVSARSQYYSAMWPVVLETVINEFLMAADAKAKKIFIDPTSVNQEIEAMFGRDLSPFAKFFDMTPEDVFNVVHRILVAQRVEGMMVRSRVMLKVTPGMVREYYQKLADEAAQITQWTYRVLTIKAGLEFLAHKIAGKVQERLNEGSSWDKERLTALVLSQGGQLMCSEEFFREDAQLSVAHRQSLEEINFPEERCGKVLEHASGLKLFVLFNRATKTLDPLDKMEAQLKQQLMMEFAAEEEANYKNKLHARYGFDPATITKLLAEDAPQLFSLL

SEQ ID NO: 73 - protein, 119 aa, Chlamydia trachomatis
KRRGRVARSSIEQLTSFLRSVNGRAKKALSQNFLVDGNILRKILTTAEVQPGDWVLEIGPGFGALSEVLLSQGANVIALEKDPMFEESLSQLPMDIEITDACKYPLTSLEDKVGKGKDV

SEQ ID NO: 74 - protein, 170 aa, Chlamydia trachomatis
GWKGKGRIVANLPYHITTPLLTKFFLECPYRWKTVTVMIQDEVARRITAKPGDKDYGSLTVFLSFFADVQYAFKVSPNCFYPKPSVHSAVVHMRVHEQFALADSEIEEFFTLTRAAFGQRRKLLANSLKNLYPKDKVLQVLEQLGFSEKTRPETIFLEEYLKIFHLLKDI

SEQ ID NO: 75 - protein, 166 aa, Chlamydia trachomatis
RPIFLRLCIGICGIMIRDLEYYDSPILRKVAAPVTEITDELRQLVLDMSETMAFYKGVGLAAPQVGQSISLFIMGVERELEDGELVFCDFPRVFINPVITQKSEQLVYGNEGCLSIPGLRGEVARPDKITVSAKNLDGQQFSLALEGFLARIVMHETDHLPWRLVY

SEQ ID NO: 76 - protein, 102 aa, Chlamydia trachomatis
VVALFYIFLFLFLLLCLILCGLVLVQESKSTGLGSSFGVDSGDSVFGVSTPEILKKVTAWLAGAFCLGCLILSFATSYLGKGENREPLPQQYVEDLIQDVEE

SEQ ID NO: 77 - protein, 704 aa, Chlamydia trachomatis
SGVKRFFPLFIGVLLAHTLPSEGLSHQQAVQKKISYLSHFKGITGIMDVEDGVLHIHDDLRLQANKAYVENRTDCGIKIVALAHGNVMVNYRGKILICDYLEYYEDTDSCLLTNGRCSLYPWFIGGSTITISPSSIIIHKGYISTSEGPQKHICLSGDYLKYSSDSVLSMGPSRLSICNTPVLLLPQISIMPMEIPKPPITFRGGSGGFLGSYLGVSYSPISKKHCSTTLFLDSFFKHGIGLGYNMRFSSQENPSNAINIKSYYAHRLAIDSSGAKDRYRLHGDFTFSKERAHLAGEFHLSDSWETVADIFPNNFSLKNTGPTEVSLSWRDNNLFGKMTSSVKVNSFQNVKQELPQAILHHRPVRIRRSRIFLENRLEAGFLDFHFSSNIPGSNFSSWRFSSAHKVYCGLVLPIGTLTPSLSGTAIYYTRMLSPNAAHCQLSGSLSFDYRVALQKEYRHARHIVEPFCSFLKTTRPVLSSDEPHIFSIKDAFHSINLLHVGLESKVLNKHSTLSTPSHLKLWTTYIFDEPHAKDTFPKTACWFSLPLTLQNTLSLDAEWIWKKSRWDHLNVIWEWILNDNLGLTLEFLHRSKYGFIKCAKDNYTLDVSRSLDTLLASPLSDRRNLITGKLFVRPHPHWNYNLNLRYGWHRPDSPSYLEYQMILGHKIFEHWQLFSVYEKREADKRCFFYLKLDKRKQKHRHPFG

SEQ ID NO: 78 - protein, 468 aa, Chlamydia trachomatis
  VARIANT (1)...(468): Xaa = Any Amino Acid
HQLMGLSRLAFIGFLSFTLSASCDFPSSVSQRILFSCQKSVPQALEAYLEASVTYQQHDFSVLRVIAESYLQQSFLSEDTHIRKSAIIGAGLSGSSEALELLSEAIETQDLYEQLLILNAATSQLSKTSDKLLFKGLTASHPVIRLEAAYRLACMKNSKVSDYLYSFIYKLPEEIQNLAATIFLQLETEEADAYIHRLLSSPNNLTRNYVAYLIGEYKQKRFLPTLRSLLTSASPLDQEGALYALGKLEDSGSYPRIKALSSRSNPEVVLAAAQTLLFLEKEEEALPILTNLCQQKLLRALYTARFLSQEKGEELLLPIFYNATQEEIRLNTALALVHQGCTDPQVLHYLTEILESKVLHRIFLPTHSTGKAIQFWKECTTFPLMSQEDKMRTLAMYRVAEDTILSALLKLPNDAYLPYLERILASQKTILAAKAIAFLSVTAHPQALSLVSKAALTPGDPIIXXTLI

SEQ ID NO: 79 - protein, 196 aa, Chlamydia trachomatis
VEARLVLGSSSERRKAVLESFRIPFICVSPDFDERSIVYSGDPFKYTKELAWNKANVVRSQGFSDALIITADTVVVYKGEVFNKPESEEHAVEMLRTLSGSSHSVITTLVLMQNEKVLSASENTQVSFIDIPPQHLKTYVRSFSSLKRCGGYCVQDGGGLIIKQIEGCVYNIQGLPIKTLNQLLMEFNISLWDYLV

SEQ ID NO: 80 - protein, 541 aa, Chlamydia trachomatis
LYSKKVFVILLSMSIVLDKIGKTLGTRVLFDDVSVVFNPGNRYGLTGPNGAGKSTLLKIITGLVEPSRGTISLPKKIGILRQNIDSFGDVIVLDCVIMGNSRLWEAMQRRDALYAEEFTDAIGMELGEIEEIIGEEDGYRAESEAEELLLGIGIPEEFFSQKMATIPLDLQFRVLLCQALFGHPEALLLDEPTNHLDLHSINWLGSFLKDYNGTVIVVSHDRHFLNTITTHIADIDYDTIIIYPGNYDAMVEMKTASREQEKADIKSKEKKIAQLREFVAKFGAGSRASQVQSRLREIKKLQPQELKKSNIQRPYIRFPVSDKTSGKVVFSIEGISKTYDADPLLFNPFSLEIYQGDKIGVIGNNGLGKTTLMKLLAGVEQPSQGQVKLGHNVAFSYFPQNHADILKDCGEETLFEWLRRRKTGITDQEVRSVLGKMLFGGDDAFKQVKALSGGETARLLMAGMMLENHNMLILDEANNHLDLESVSALAWAINDYPGTAIFVSHDRTLIDECATKLLIFDKGTISFFDGPMSEYLASQKK

SEQ ID NO: 81 - protein, 100 aa, Chlamydia trachomatis
RFPGLNTTDTSSNKTRVPNVLPILSRTILMDKRITKTFLEYKKFAGVVTPLSCEGEFHRGSVFLISWKHEYKWLSSQEKYGLTGVEWFLNPSRALTSEWQ

SEQ ID NO: 82 - protein, 317 aa, Chlamydia trachomatis
LGMITSFYAFLDYLKNMKASSLHTLRNYCMDLSSLKCFLEKKSDLSPTPPLSLHDNTYDYPPLSFSLFTKDNIRLYLLEQIQTHHSKRTVRRRLSAIKSFARFCVKNQLIPENPAEMIRGPRLPQELPSPLTYEQVLALMAAPELDKVTGFRDRCLLELFYSSGLRISEITALNRADIDFQSHLLHIRGKGKKERIVPMTKVAVQWLQDYLNHPDRASVEQDHQACFLNRFGKRLSTRSIDRKFQQYLLKTGLSGSITPHTIRHTIATHWLERGMDLKTIQLLLGHTSLETTTIYTHVSMKLKKQIHDETHPHNLEE

SEQ ID NO: 83 - protein, 304 aa, Chlamydia trachomatis
MSYRGLTILGCSSQQPTRHRNHGAYLLRWNGEGLLFDPGEGTQRQFIYANIAPTVVSRIFISHFHGDHCLGLGSMLMRLNLDRVSHPIHCYYPASGKKYFDRLRYSTIYHETIKVIEHPIDREGIVEDFGNFRIESRQLDHLVDTLGWRITEPDTTKFIPEKIKAAGLKGPIMQELINKGRVKVNDTIVHLDDVSYTRKGDSIAVVADSLPCQAIVDLARNARILLCESTYLEEHSHLAKSHYHMTAKQAAEQAKRAEVQQLILTHFSARYNTTEEFVQEAGEIFPNVFAAEEFCSYEFPKNPS

SEQ ID NO: 84 - protein, 698 aa, Chlamydia trachomatis
AQVLLSIEDRIRIVKPIQDKYLKAKVSYHKENKELTEELKAYSISIVSIIKDLLKLNPLFKEELQIFLGHSDFTEPGKLADFSVALTTATREELQEILETTDMHDRIDKALVLLKKELDLSRLQSSINQKIEATITKSQKEFFLKEQLKTIKKELGLEKDDHAVDLEKFMERFNKRDVPQYAMDVIQDEMDKLQTLETSSAEYAVCRNYLDWLTIVPWGIQTKEYHDLKKAESILNKDHYGLEDIKQRILELISVGKLANGMKGSIICLVGPPGVGKTSIGRSIAKVLHRKFFRFSVGGMRDEAEIKGHRRTYIGAMPGKLVQALKQSQIMNPVIMIDEVDKIGSSYHGDPASALLEVLDPEQNKDFLDHYLDVRVDLSNVLFILTANVLDSIPDPLLDRMEVLRLSGYILEEKLQIATKYLVPRARKEMGLSAQNVTFQPEAIKHMINNYAREAGVRTLNENIKKVLRKVALKIVQNQEKNPSKKSRFTITPKNLQDYLGKPVFSSDRFYEKTPVGVATGLAWTSLGGATLYIESVQVPSSSGKADMHLTGQAGDVMKESSQIAWTYLHSALERYAPGQPFFEKSQVHIHIPEGATPKDGPSAGITMVTSLLSLLLDVPVLNNLGMTGELTLTGRVLGIGGIREKLIAARRSKLNILIFPEDNRRDYDELPAYLKKGLKVHFVTHYDDVFKIAFPGV

SEQ ID NO: 85 - protein, 211 aa, Chlamydia trachomatis
AVYKYFIVDTSGSQPFLAYVDCRDVLEVWSLPTGPDQGVVLNFIFNSLDLPFQGIGVSVGPGGFSATRVGVAFAQGLSLAKNVPLVGYSSLEGYLSLGQEEEALLLPLGKKGGVVALNSELSLDGFLLTDTTSTPGILLSYSEALEYCLDKGCCHVISPDPTYFVELFSSRISVRKVVPCIDRIRKYVVSQFVLSQNLPLCLDYRSISSFF

SEQ ID NO: 86 - protein, 355 aa, Chlamydia trachomatis
SGGRFKEVSEAYEVLGDAQKRESYDRYGKDGPFAGAGGFGGAGMGNMEDALRTFMGAFGGDFGGNGGGFFEGLFGGLGEAFGMRGGSESSRQGASKKVHITLSFEEAAKGVEKELLVSGYKSCDACSGSGANTAKGVKVCDRCKGSGQVVQSRGFFSMASTCPDCSGEGRVITDPCSVCRGQGRIKDKRSVHVNIPAGVDSGMRLKMEGYGDAGQNGAPAGDLYVFIDVEPHPVFERHGDDLVLELPIGFVDAALGIKKEIPTLLKEGTCRLSIPEGIQSGTVLKVRGQGFPNVHGKSRGDLLVARGVSVETPQHLSNEQKDLLRQFAATEKAENFPKKRSFLDKIKGFFSDFAV

SEQ ID NO: 87 - protein, 684 aa, Chlamydia trachomatis
EGAAVRHSVYQLDSAVENVFRLAWTLRFSERKMLLLSRQSGSGGSFQLSCAGHELAGVVAAKSLIPGKDWAFPYYRDQGFPLGLGCDLSEIFASFLARTTQNHSAGRMMPYHYSHKKLRICCQSSVVGTQFLQAAGRAWGVKNSGKSEVVYVSGGDGSTSQGEFHEMLNFASLHQLPLVIAIQNNQWAISVPFADQCGADLVALGNSYSGLATYEVDGGDVSVLTQTFERAVSDARHRHIPALVIVNVVRLESHSNSDNQAKYRSEEDLSCCQAQDPLVRLEKSLLDDFGVAHEVIEQIKAELQETVNQACELAESAPFPCKGATKHEVFAPYNISLIDYENALETASLQKLEPRVMRDAITEALVEEMQRDPGVVVFGEDVAGNKGGVFGVTRTLTEQFGENRCFNTPLAEATIIGAAVGMAFDGFYKPVAEIQFADYIWPGINQLFSEAASIYYRSAGEWEMPIVIRTPCGGYIQGGPYHSQNIEAFLAHCPGLKVVYPSNAADAKALLKAAIRDPNPVVFLEHKALYQRRLFSTTPVFSSDYVLPFGQARIVHPGTDLTIVSWGMSLVMSVEVALARDLLELGISVEVIDLRTIVPCDFATVCESVKKTGKLLVVHEASEFCGFGSELVALVAERAYRYLDAPIKRIGALHAPVPYSKVLENEVLPQKEKIFQEAKLLAEF

SEQ ID NO: 88 - protein, 448 aa, Chlamydia trachomatis
DRPTNSNHPLGNRGTLANTSSQESVLRICSRESTSTGCLEQADVTLSLYHCIPNLITSPICLRIRLFSSCSVFQKQHPIFIGSAYWLAGMLAHQAPICCALLIVALHPFIPKRCLKTLFSLSICFGVPLLFSPLISPSNASRSVALANSKIQVTKGSASGYFLIKKKLTHRYSGTALSLETEDKQSYQNLPCSIISTIPLSEHTVYHLEGCVSKSSCPITFRSSKLINTPTQSSIFLRNSSNYSLPILKENFRFFLHQRILNLFSDKDIGRFSSSLILGTPLSYKHKELFKSKGLSHLFSVSGWHFSLFANTFFFLLGTLSPKKRGLWVLFLLSLLNFVFPTSPSVFRTWFSSILFCLAPFSIGHCSSLNRLGISFIFCSLFFPISSPALILSFLATLGILFSLYRYYVSFTLPGNHYSALVGFSSLFGLYSQPYQSLLLPSFLSFSQ

SEQ ID NO: 89 - protein, 122 aa, Chlamydia trachomatis
RYKENKMPKVAKKLSISAGDDIGKKSEQKIKLIPSRFRLEQCPIEKGARQNRILENQVLNTEGEVGNTKLRRESRKRTQRPRFLGESVPNKKKKVLANSEKCHPDTEKRWDNPLLLNSSLCL

SEQ ID NO: 90 - protein, 116 aa, Chlamydia trachomatis
ALPMKIGCCFWKTEQELNSLIRKQIGDVMRLGMQWYKDSVTSACSKQPVEVLSLEQMRRTLSWEEVFAKVPRLPRGWFELVGLSQADRIELFRDFWFSALGVENTDFPGICHFFPL

SEQ ID NO: 91 - protein, 185 aa, Chlamydia trachomatis
FPWYLSFFSSLSHLDVARGITRNSLSAPYDVQMVYSYKGIVYLGAPPFETVGVVFPKLGDETYRHFFSIHNGFSREGEIGIFPYRYLAQAQYLLREDLLSRGKISLEDNCSSLGIFPFYAQYDIADSRCFIIDAKIRQYFPSYNVRLDNQSLFPHGKIAISEMLSDSHYHTFLLWLEQYLLSQKP

SEQ ID NO: 92 - protein, 128 aa, Chlamydia trachomatis
LDLAYHHFVFTRTGKNTMSGGNDSVLHRPVEAPLMEDGELSAVFTIRNPSGIHVRPAGTIVKLFEGEECEATLTYLGKTVASNARSVMSILMLGASYNGEVAVHIKGPSASRVMQKLSEVFNSGFGEL

SEQ ID NO: 93 - protein, 573 aa, Chlamydia trachomatis
MSVTGQDNKELQQEFVIVGEPIVPGIGLGKALLLGKSSLRIRELTLPQEEVEHEISRYYKALKRSRSDLAALEKEAKGKQGYQEIASILQAHLEIIKDPLLTEEVVKTIRKDRKNAEFVFSSVMGEIEKSLCAVQKTTATTVDRVQDIHDISNRVIGHLCCQHKSSLGEFDQNLIVFSEELTPSEAANANPEYIRGFVSLEGAKTSHTAIVSLAKNIPYVANFTTELWDTINEFSGTLVLINGDKGEITFNPQLSTIQTYYRKQASVSVTVPVQVQTGKNLPLISLSAQIVSTEELPMIERESPGTSVGLFRSEFMAFSLGRLPCVEEQADQYAQLVQFQCSDIHVLRLFDFGEDKECPCISSSHRSVARGWLLEQEKVLKEQLQAIAIVSRIGRLKVLIPGVIDASEIALVKRLFQEEIRLLKGISENILWGSMIEIPSAVWMIEEILQESSFVALGTNDLAQYTLGTSRERSLLGERSRVPHPSVIRMIHHVVEQAKQKNVPVSVCGEMAGDPALLPMFLGLGVKELSAVIPAINSLKMRLLDLNSRECSRLTKQLLRAKTYEEVHQLLYV

SEQ ID NO: 94 - protein, 105 aa, Chlamydia trachomatis
MGSGYAKKKKEAKLMERQFMEMEASLEQKRFSGEAGNGLVSVTINGKCDLVDVRIKPDCLDPEDPEVVADLFRADLKQLKQLWIVKCPLCKWECRSNFFRYTYRS

SEQ ID NO: 95 - protein, 216 aa, Chlamydia trachomatis
PISTCRSHYYPKLRTSVTPVSDAMQMGVAPAHFLQDVTLLFRSFLLKQYSKQFHSVATKYSSEILLEILDFLGESARHINLALFEKTFLETVIIRLLRIYSRPTFSQLVSQIRQPAPTQIRPIPTASELESCPPQIKSSNTEETKSSPQPTAVAKLSQGSLLTAASSQTKKETIHQETPPPSLDKISPSESAAIDTLLQFAVVEFSGVLTKEPKHG

SEQ ID NO: 96 - protein, 265 aa, Chlamydia trachomatis
DLLSSFFKKVPPEQFFRDSWPGYSRVYTQEFPASESRRHAYIFSGIRGTGKTTLARVFAKALNCQNPTQDQEPCNQCAICKEISLGTSMDVIEIDGASHRGIEDIRQINETVLFVPSKSRYKIYIIDEVHMLTKEAFNSLLKTLEEPPAHVKFFLATTEIAKIPNTISSRCQKMLLKRISEETIIDKLATIAKQEGTETSREALLPIAKAAQGSLRDAESLYDYVVGLFPESLDPDSTAKALGILSEDSLYQLAEAITTQNYEQA

SEQ ID NO: 97 - protein, 258 aa, Chlamydia trachomatis
HLRTCCAILEKDPSVFSEIIFLDSYPQIASSRSDISTYFDIAPSLRNFYASLTQAKALNISVSMFSPNTKQGQCSDCWGLGYQWIDRAFYAMEKRPCPTCGGFRVQPLIQEVVYEGKHFGQLLQASLNEVAETFSFLKKIQKPLHTLITNGLGYLSLGQNMASLSLSEKIAIKLTKHLFLPPKHPTLFLLDEIATSLDNQQQSALLVQLNTLVSLGHTVVIIENHPAFSQQADFWIQMGRKTDNHILFAGPNPNLSFT

SEQ ID NO: 98 - protein, 189 aa, Chlamydia trachomatis
IGLLDRVGLGYVILGQEQQSLSDGEHYRLLLAKAFSSGLTDVIYLLEDPLAGIHPEDAPCLLAVIKKLVTNHNTVIVTDREGSLAEHADYLLHLGPEPGPNGGYLLSTSALKQSQPVLCNTRSSEETPQLSVSVSTSMIQIENLAFPLQRLSTISGVSGSGKTTLLNSIYEHAALFLKRILLYSQKLFF

SEQ ID NO: 99 - protein, 1224 aa, Chlamydia trachomatis
NSCHSRWNSTDFARSSSRQDVLTVRECLRQGFTKVLIDEEVVPIHKFLTTGIPVPGQLIVDTLIKNTSNTPRLKVSLFTTLDIGHGECSLHFDNQKRVFSTQATLPETQQTYAPLSPDLFSSHSHKDRCPQCQGSGIFISIDDPCIIQQTLSIEDNCCPFAGNCSTFLYRTIYQSLADSLGFSLSTPWQNLSPEIQHIFLYGKEGLSIPVKLFDGTLGKKTQTHKQWKGVLNEIGEKIRFSNKPARYLPKGTSYTVCPRCNKTGLSDYANATRWHGKSFADFQQMSLQELFIFLNQLPKKELAIEEVIQGFKSRLAILIDLGLPYLSPERAIDTLSGGERERTALAKHLGAELIGVMYILDEPSIGLHPQDTHKLMNVIRRLRDQGNTVLLVEHDEQMISLADRVIDIGPGAGIFGGEVVFNGSPREFLAKSDSLTAQYLRQEQHISVPAKRTNSLGTITLSKANKHNLKDLTVSIPLGQMTVVTGVSGSGKSSLINDTLVPCVEEFIEQGFCSTLSIQGALSRLVHINRDLPGRSQRSIPLTYIKAFDEVRQLFAEQPRCKTLGLTKSHFSFNTPLGACAECGGLGSITTTDNRDSITCPSCLGKRFLPQVLEVRYKNKTIADILEMTAYEAKNFFLDEPSIHQKIETLCTLGLQYLPLGRPLYSLSGGEIQRLKLAYELLAPVKHPTLYVLDEPTTGLHTHDVKQLIYVVQSLIHQGHSVIIIEHNMHVVKVADYILELGPEGGNKGGYLIASCSPEELIHKHTPTAIALRPFLSSPQELPYLPDPSPKPPVPAAITIANAHQYNLKHIDLSIPRYALTAVTGPSASGKHSLVFDILHAAGNIAYAELFPPYIRQALIKKTPLPAVDKVTGLSPVIAIEKTSASRNSNHSVASALEISEMLESLFTRIGHPYSPISGDALRTISPETIAEELLTHYTKGYVTITVPFPKEEEFFSYTQEMLQEGFLKLYANEQFYDLDGPFPTSLENPALVIHHVKILEKNLPSLLASLTLAFSKASSVCLHIEYAGTSLSKTYRQGLQDASGNLFPNIETPSILNHESYLCPLCHGKGFLSTCSILPHKKRFAQHTPISLFTSLFPNQDPSPIYPLLNELGIPSIALFQEIDVLSFESLCLGTQQHLGLNALCTKAMLMESEEDFPPDLISKTPCNQCQGLGVYTYKHCIRIHSISLSEIYQSNVAFLKKLLLSVEEEPSLVQDILSRLAF

SEQ ID NO: 100 - protein, 201 aa, Chlamydia trachomatis
MSSIVRLSGITVRNLKNITVEFCPREIVLFTGVSGSGKSSLAFNTIYAAGRKRYLATLPSFFATKLDSLPDPSVKKIEGLSPTVAVKQNFFEQHVHATVGSTTEINSYLALLFSLEGQAYDPVTLHPLTLYSKEKILSEIAAIPDGTQLTLLAPLPARMFLPFENVSVKGLPKSSLMKRLFLFISFLQQAFLFPVNSLSIR

SEQ ID NO: 101 - protein, 496 aa, Chlamydia trachomatis
IFYSLIPVSRFMIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETASGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDALSPSLDEIVP

SEQ ID NO: 102 - protein, 337 aa, Chlamydia trachomatis
  VARIANT (1)...(337): Xaa = Any Amino Acid
KRPIRYHGVKAHFQNTSLKKTSGNVELQTPISFPQHAGNILCRLGKKYPQLQVVTPAMSLGSCLEDFRKQFPDRFTDVGIAEGHAVTFSAGIARSGTPVCCSIYSTFLHRAMDNVFHDVCMQELPVIFAIDRAGLAFHDGRSHHGIYDLGFLCSMPNMVICQPRNALVLERLFFSSLLWKSPCAIRYPNIPANEKASNSSFPFSPILPGEAEILCQGDDLLLIALGHMCNTALTVKEHLLDYGISTTVVDPIFIKPLDRKLLQSLLTHHSKVIILEEHSIHGGLGSEFLLFLNQHNIKADVLSLGVPDMXIPHGNPELFKFDWTHQRSHHSTNPFSF

SEQ ID NO: 103 - protein, 296 aa, Chlamydia trachomatis
MTYSLLPHIHSPQDLHALSLDKLPVLCDEIRNKIIESLSLTGGHLASNLGGVELTVALHYVFSSPDDQFIFDVGHQSYVHKLLTGRNTEAFSNIRHDNGLSGFTTPQESNHDIFFSGHAGNALSLALGLAKGSSNSSSHILPILGDAAFSCGLTLEALNNIPADLSKFIIVLNDNQMSISENVGNIPQGISQWIYPQKISKLSQKIHSWIQNLPSFLHKKKTLSHKVDIALKSLSHPLFEQFGLHYVGPIDGHNVKKLVQALQMIKDQPQPILFHVCTVKGNGLTEAERDRFAIME

SEQ ID NO: 104 - protein, 92 aa, Chlamydia trachomatis
PVMQEISVPEASHLDTVIQRLLVLQKALEDCHSVEAILAIYEEMFSLIQEGETNLNHVEQLSFQLQLNPDGSVAVDTSGNPIKHPFIPGESV

SEQ ID NO: 105 - protein, 530 aa, Chlamydia trachomatis
LEEPLYLQRISYPLYNKSISHNSHVPMSITSPPIEVSVLTDSIKNLLEKNFLRVVVKGELSNVSLQTSGHLYFAIKDSKAVLNGAFFHFRSKYFDRKPKDGDYVILHGKLTVYAPRGQYQIVAYALTFSGEGNLLQQFEERKQRLAAEGYFDPKRKKPLPSGARVIGVITSPTGAVIQDILRVLSRRCHQFQVILYPVTVQGATAAQEISQAIQFFNQNSMRVHALIIARGGGSIEDLWAFNEEELVKSIVASSIPIISAVGHETDFTLCDFASDVRAPTPSAAAEIVCKSSDQYRQELQNLRRYVSSHARQFIAAKKNLLTHWQRHLASVDFYHTAQQTLDYTRAALERGIETKLEYYKQRFAQYRRWLKSDVLIRIEKHLADLNQSLMLSIKNKIYTKKTSLNQLYTSCLKNELLNLQHRTQHSRNILSQLSRRLHIAIASSQQTHQECLVRLQNELSFTIQHLLTKAKERCQAIQEQASSLNPKNVLKRGFAQLFDFNKHFVIISAESLKQSDLVRSASKTVKQLYQ

SEQ ID NO: 106 - protein, 274 aa, Chlamydia trachomatis
MFTDKETHRKPFPTWAHLLHSEPSKQFVFGNWKMNKTLTEAQTFLKSFLSSDILSNPQIITGIIPPFTLLSACQQAVSDSPIFLGAQTTHEADSGAFTGEISAPMLKDIGVDFVLIGHSERRHIFHEQNPVLAEKAAAAIHSGMIPVLCIGETLEEQESGATQDILLNQLTIGLSKLPEQASFILAYEPVWAIGTGKVAHPDLVQETHAFCRKTIASLFSKDIAERTPILYGGSVKADNARSLSLCPDVNGLLVGGASLSSENFLSIIQQIDIP

SEQ ID NO: 107 - protein, 212 aa, Chlamydia trachomatis
PLCCMKVKICGITHPDDAREAAKAGADYIGMIFAKDSRRCVSEEKAKYIVEAIQEGNSEPVGVFPEHSVEEILAITEATGITSIQLSGEDILFKFSQLREHFSIFYVVSVYSNGQPSAALPPMNDAVTVVYDHIGGERGSPFDWKAFSPFQHNNWMLGGGVNLWNIKEGISLLNPRGIDVSSGVERPGILRKDIFLMQALINSAKELSSSTL

SEQ ID NO: 108 - protein, 344 aa, Chlamydia trachomatis
RTRGGGLFSNFCSSPTVQALLRAWDRFFSRVSDGRFLQIYYGDGGLFVERALQLISCPLQRARIRVVGINPSFFVTVSDNRHFYTSPGSCGRILDMSGYLSARRDGCVSHVPFSPHSQSITPGVGDACFELGLRMEFMRLAGLSSLSAASSPTSEDSDSSRLQLVRVVSSEDSVAFARLYAALNEDITSSVRAANPFPFSYVRLILLLTTLCRHTLTTTKAAYSYTPASWEALDMLDSGFTASYVGGVLSEIFLLCTHSPRRAQRSRMLRMLAKLFSSWAWLVGVMELSCGYGVTIQLLLQNDPRQSCLRNLFFWMESTLTPVILLDIAERIGLPYGIELLDWA

SEQ ID NO: 109 - protein, 97 aa, Chlamydia trachomatis
LKIARDMSRSSLQQYLYTKSTVIANSTTPSLNNTSTCSGNSTTRPVLPSITGIYETDVQTTGVARTLNVIRMIWCGVMLLYFLYTAFRLVRNARRRN

SEQ ID NO: 110 - protein, 149 aa, Chlamydia trachomatis
TMILTTPSEHKACLEKQEKAVALLFPENFVKDTFYKQLLQIGRTAKPFPKEFLTKENLVLGCQSDLYLHGEFKNNAVFFFTYTEALISSGVAVLFSDIYSGETPETILTCKPLFFEKLSRHLSMGRSRGGESLFLNMQRIAVQYLARKT

SEQ ID NO: 111 - protein, 221 aa, Chlamydia trachomatis
AMVKAAHPLHSSISGALPLHSSRGGAYHDSLGDLHSPISLTPPALSVLTPEPAQSKSRVQAVANTIGDFLQRNWKHLLLYILAWSLILICHSSVALVLSIWLGIGFGAGVVLGIISANFLDKENKYPHLNSLWNITNHGLQQLDPNGTRQVLLATVIASISALIYASPQAIGFIIGAFLGHQTSSLAVYGYRFKSGQDILQIRNCLINKKNEFDKPSCSVG

SEQ ID NO: 112 - protein, 397 aa, Chlamydia trachomatis
LRIFEMSKETFQRNKPHINIGTIGHVDHGKTTLTAAITRTLSGDGLADFRDYSSIDNTPEEKARGITINASHVEYETANRHYAHVDCPGHADYVKNMITGAAQMDGAILVVSATDGAMPQTKEHILLARQVGVPYIVVFLNKIDMISEEDAELVDLVEMELAELLEEKGYKGCPIIRGSALKALEGDAAYIEKVRELMQAVDDNIPTPEREIDKPFLMPIEDVFSISGRGTVTGRIERGIVKVSDKVQLVGRDTKETIVTGVEMFRKELPEGRAGENVGLLLRGIGKNDVERGMVVCLPNSVKPHTRFKCAVYVLQKEEGGRHKPFFTGYRPQFFFRTTDVTGVVTLPEGVEMVMPGDNVEFEVQLISPVALEEGMRFAIREGGRTIGAGTISKIIA

SEQ ID NO: 113 - protein, 183 aa, Chlamydia trachomatis
FMFKWYVVQVFTAQEKKVKKSLEDFKEASGMSDFIQQIILPSENVMEVKKGEHKIVEKYIWPGYLLVKMHLTDESWSYVKKTQGVVEFLGGGAPVALSEEEIKNILADLEEKKSGVVQKHKFEVGSQVKINDGVFVNFVGVVSEVFHDKGRLSVMVSIFGRETRVDDLEFWQVEEVVPGQESE

SEQ ID NO: 114 - protein, 143 aa, Chlamydia trachomatis
  VARIANT (1)...(143): Xaa = Any Amino Acid
LNMSNKKIIKIIKLQIPGGKANPAPPIGPALGAAGVNIMGFCKEFNAATQDRPGDLLPVVITVYSDKTXSFVMKQSPVSSLIKKALGLESGSKIPNRNKVGKLTRAQITAIAEQKMKDMDVVLLESAERMVEGTARSMGVDVE

SEQ ID NO: 115 - protein, 195 aa, Chlamydia trachomatis
MTKHGKRIRGIQETYDLAKSYSLGEAIDILKQCPTVRFDQTVDVSVKLGIDPRKSDQQIRGSVSLPHGTGKVLRILVFAAGDKAAEAIEAGADFVGSDDLVEKIKGGWVDFDVAVATPDMMREVGKLGKVLGPRNLMPTPKAGTVTTDVVKTIAELRKGKIEFKADRAGVCNVGVANFLSIVRKSKKMLKRCVQP

SEQ ID NO: 116 - protein, 178 aa, Chlamydia trachomatis
LSLKRKNERREKVALREVEEKITASQGFILLRYLGFTATHSRSFRNNLSGVSAEFEVLKKKIFFKALETSGVEMDPEDSEGHLGVVFAYGDPVSAAKQVLDFNKQHNDSLVFLAGRIDNASLSGREVEAVAKLPSMKELRQQVVGLIAAPMSQVVGIMNSVLSGVVSCVDQKAEKTQE

SEQ ID NO: 117 - protein, 107 aa, Chlamydia trachomatis
KIIGRKVGRYAAAPVVALAVAGAAAAGDAPASAEPTEFAVILEDVPSDKKIGVLKVVREVTGLALKEAKEMTEGLPKTVKEKTSKSDAEDTVKKLQEAGAKAVAKGL

SEQ ID NO: 118 - protein, 1258 aa, Chlamydia trachomatis
SLRRARMFKCPERVSVKKKEDILDLPNLVEVQIKSYKQFLQIGKLAEERENIGLEEVFREIFPIKSYNEATILEYLSYNLGVPKYSPEECIRRGITYSVTLKVRFRLTDETGIKEEEVYMGTIPIMTDKGTFIINGAERVVVSQVHRSPGINFEQEKHSKGNVLFSFRIIPYRGSWLEAVFDINDLIYIHIDRKKRRRKILAMTFIRALGYSTDADIIEEFFSVEERSLRSEKDFVALVGKVLADNVVDADSSLVYGKAGEKLSTAMLKRILDTGVQSLKIAVGADENHPIIKMLAKDPTDSYEAALKDFYRRLRPGEPATLANARSTIMRLFFDAKRYNLGRVGRYKLNKKLGFPLDDETLSQVTLRKEDVIGALKYLIRLRMGDEKTSIDDIDHLANRRVRSVGELIQNHCRSGLARMEKIVRERMNLFDFSSDTLTPGKIISAKGLVSVLKDFFSRSQLSQFMDQTNPVAELTHKRRLSALGPGGLNRERAGFEVRDVHASHYGRICPIETPEGPNIGLITSLSSFAKINEFGFIETPYRVVRDGIVTDEIEYMTADVEEECVIAQASAELDEYNMFKTPVCWARYKGEAFEADTSTVTHMDVSPKQLVSVVTGLIPFLEHDDANRALMGSNMQRQAVPLLKTEAAIVGTGLEGRAAKDSGAIIVAQEDGVVEYVDSYEIVVAKKNNPTLKDRYQLKKFLRSNSGTCINQTPLCSVGDVVTHGDVLADGPATDKGELALGKNVLVAFMPWYGYNFEDAIIISERLIKQDAYTSIYIEEFELTARDTKLGKEEITRDIPNVSEEVLANLGEDGIVRIGAEVKPGDILVGKITPKSETELAPEERLLRAIFGEKAADVKDASLTVPPGTEGVVMDVKVFSRKDRLSKSDDELVEEAVHLKDLQKEYKSQLAQLKVEHREKLGALLLNEKAPAAIVHRRSADILVQEGAIFDQETIELLERESLVDLLIAPCDMYDVLKDILSSYETAVQRLEVNYKTEAEHIKEGDADLDHGVIRQVKVYVASKRKLQVGDKMAGRHGNKGVVSKIVPEADMPFLANGETVQMILNPLGVPSRMNLGQVLETHLGYAAKTAGIYVKTPVFEGFPESRIWDMMIEQGLPEDGKSYLFDGKTGERFDSKVVVGYIYMLKLSHLIADKIHARSIGPYSLVTQQPLGGKAQMGGQRFGEMEVWALEAYGVAHMLQEILTVKSDDVSGRTRIYESIVKGENLLRSGTPESFNVLIKEMQGLGLDVRPMVVDA

SEQ ID NO: 119 - protein, 1396 aa, Chlamydia trachomatis
  VARIANT (1)...(1396): Xaa = Any Amino Acid
MFREGSRDDAALVKEGLFDKLEIGIASDVTIRDKWSCGEIKKPETINYRTFKPEKGGLFCEKIFGPTKDWECYCGKYKKIKHKGIVCDRCGVEVTLSKVRRERMAHIELAVPIVHIWFFKTTPSRIGNVLGMTASDLERVIYYEEYVVIDPGNTDLVKKQLLNDAKYREVVEKWGKDAFVAKMGGEAVYDLLKSEDLESLLGELKDRLRKTKSQQARMKLAKRLKIVEGFVSSSNRPEWMVLKNIPVVPPDLRPLVPLDGGRFATSDLNDLYRRVINRNNRLKAILRLKTPEVIVRNEKRMLQEAVDALFDNGRHGHPVMGAGNRPLKSLSEMLKGKNGRFRQNLLGKRVDYSGRSVIIVGPELKFNQCGLPKEMALELFEPFIIKRLKDQGSVYTIRSAKKMIQRGAPEVWDVLEEIIKGHPVLLNRAPTLHRLGIQAFEPVLIEGKAIRVHPLVCAAFNADFDGDQMAVHVPLSIEAQLEAKVLMMAPDNIFLPSSGKPVATPSKDMTLGIYYLMADPTYFPEEHGGKTKAFKDEVEVLRALNAGGFILKDEICGSRRDETGRGIHIHEKIKVRIDGQIIETTPGRVFFNTIVPKELGFQNYSMPSKRISELILQCYKKVGLEATVRFLDDLKELGFVQSTKAAISMGLKDVKIPEIKKEILKDAYDKVAIVKKQYEDGIITDGERHSKTISIWTEVSDLLSNALYSEIKKQTNSKHNPLFLMVXSGARGNKSQLKQLGALRGLMAKPNGAIIESPITSNFREGLTVLEYSISSHGARKGLADTAHKTADSGYLTRRLVDVAQDVIITERDCGTLNHIEVSTIRQGSEELLPLKDRVYGRTVSENIYQPGDKSNVLAYAGDVLTSAQAEAIDDAGIESVKIRSTLTCESRRGVCAKCYGLNLANGHLIGLGEAVGIIAAQSIGEPGTQLTMRTFHLGGVAATSSTPEIVAECDGILVYLDLRVVVDQEGNNLVLNKMGALHLVQDEGRSLSEYKKLLSTKSIESLATFPVELGAKILVNDGAAVTAGQRIAEVELHNIPIICDKPGFVHYEDLVEGVSTEKVANKNTGLVELIVKQHRGELHPQIAIYADANMKELVGTYAIPSGAIISVEEGQRIAPGMLLARLPRGAIKTKDITGGLPRVAELVEARKPEDAADIAKIDGVVDFKGIQKNKRILVVRDEITGMEEEHLISLTKHLIVQRGDSVIKGQQLTDGLVVPHEILAICGVRELQKYLVNEVQEVYRLQGVDINDKHIEIIVRQMLQKVRITDPGDTTLLFGEDVDKKEFYEENRRTEEDGGKPAQAVPVLLGITKASLGTESFISAASFQDTTRVLTDAACSSKTDYLLGFKENVIMGHMIPGGTGFDTHKRIKQHLEKEQEDLVFDFDSEFESVAG

SEQ ID NO: 120 - protein, 308 aa, Chlamydia trachomatis
LNSIVFFGRLHLESKIDKVFMSSQFDQFKLWSVLVGDTGDPALIKTLGVQDATTNPSLILKVAQEPKYQSMLTEAISWGIRQNGDDVQTLTFVLDKIQVNLGLEILKHVPGRVSLEIDARLSFNTEAMVQRAIFLSQLFEKMGGDKKRLLVKIPGTWEGICAAEVLESQGIACNVTLIFNLVQAIAAAKAKVTLVSPFVGRIYDWWIAAYGAEGYSIEADPGVASVANIYSYYKKFDIPTQIMAASFRTKEQVLALAGCDFLTVSPKLLEELKKDQQPVERKLSVEEAKKIRYSTCGVVRECISVLNE

SEQ ID NO: 121 - protein, 78 aa, Chlamydia trachomatis
KNSRKISSLLKESLAWKKRKKLDIQPVELSESVFRFLMNEDAMATEKLAEGIRIFSGDTQILESAVTEFIRQIAAQEA

SEQ ID NO: 122 - protein, 242 aa, Chlamydia trachomatis
NQTLNLMKRVILCSLLFASFPIVSKAAAEGKPLSRAAQLREKRKDLHVSRKPSPRYALKKRALEAKKNRPSISWITYSNATYSFLIPNTWQCIDDKTQLPEKLDVLFIGKGAGGLTPTINSAHEIIHKTEDAYIEEILDYHRANENTLESSIFAHIQAPSGKFTIIKTEKNTSWGRVFCLQGVTVIDHTAYIFTSTSTIDDYPNVSLALLKAASSFKLSEKEEAARGDAILEKALKDLQNGK

SEQ ID NO: 123 - protein, 203 aa, Chlamydia trachomatis
TLFFLVSDMADLSAQDKLKQICDALREETLKPAEEEAGSIVHNAREQAKRIVEEAKEEAQRIIRSAEETADQTLKKGEAALVQAGKRSLENLKQAVETKIFRESLGEWLDHVALATDPEVSAKLVQALVQAVDAQGISGNLSAYIGKHVSARAVNEALGKEITSKLKEKGVSVGKFSGGAQLKVEERNWVLDMSSEVLLDFID

SEQ ID NO: 124 - protein, 216 aa, Chlamydia trachomatis
ERVMNQYYFLSSFLSPQQPESSPLYSFQEINDLLALNFTDKDWRSYVILRRFFDLENFAFFWAGKSIPFSFGTVTNSNVESLLRLQMWSDEWEFEDFFKDFLLRYKTPRERLTHFSELVRDFLDHYQDYPSEFLRTYFRFKQDLRIILAGFRARVMQKDVSFVLRDEDSSNPIVLHVLMQKDSPNYELPDEFFELRDVLGRLRASSTHVESDSLFL

SEQ ID NO: 125 - protein, 597 aa, Chlamydia trachomatis
DGERNQMVATSKQTTQGYVVEAYGNLLRVHVDGHVRQGEVAYVSVDNTWLKAEIIEVVGMKLRFQVFEETQGISRGALVTFSGHLLEAELGPGLLQGIFDGLQNRLEILADTSLFLRRGEYVNAICRETVWAYTQKASVGSVLSRGDVLGTVKEGRFDHKIMVPFSCFEEVTITWVISSGNYTVDTVVAKGRTSTGEELEFTMVQKWPIKQAFLEGEKVPSHEIMDVGLRVLDTQIPVLKGGTFCTPGPFGAGKTVLQHHLSKYAAVDIVVLCACGERAGEVVEILQEFPHLKDPHTGQSLMHRTCIICNTSSMPVAARESSIYLGITIAEYYRQMGLHILLLADSTSRWAQALREISGRLEEIPGEEAFPAYLASRIAAFYERGGAVKMKDGSEGSLTICGAVSPAGGNFEEPVTQATLSVVGAFCGLSKARADARRYPSIDPMISWSKYLDSVAEILEKKVPGWGESVKQASRFLEEGAEIGKRIEVVGEEGISMEDMEIFLKSELYDFCYLQQNAFDAEDCYCPFDRQIELFSLMNHIFNSRFCFDCPDNARSFFLELQSKIKTLNGQKFLSEEYQKGLEVIYKLLESKMVQTA

SEQ ID NO: 126 - protein, 438 aa, Chlamydia trachomatis
MQTIYTKITDIKGNLITVEAEGASLGELVQIERADGRSSYASVLRFDARKVTLQVFGGTSGLSTGDKVIFLGRPMEVIYGDSLLGRRFNGTGKPIDHEDECFGEPIPITTPSFNPVCRIVPREMVRTNIPMIDMFNCLVKSQKIPIFSSSGENHNALLMRIAAQTDADIVIIGGMGLTFVDYNFFVEESQRLGFADKCVKFIHKAVDAPVECVLIPDMALACAERFALEQQKNVLVLLTDMTAFADALKEIAITMDQIPANRGYPGSLYSDLAVRYEKAVDIAQGGSITLISVTTMPGDDITHPVPDNTGFITEGQFYLKDNRIDPFGSLSRLKQLVIGKKTREDHGDLANALIRLYADSRKSAERMSMGFKLSNWDKKLLAFSELFEARLMSLEVNIPLEEALDIGWKILSQSFHSEEVGIKEQLIQKYWPKACLHK

SEQ ID NO: 127 - protein, 204 aa, Chlamydia trachomatis
SMSSQIKLTKNSYRAEKQKLNMLGMYLPTLKLKKALLQAEVQSAIRLAAESTATNEQARDRMYAFAELFSIPLYTDAVEQCFSVDILEKDVENIAGVEVPLLKRVVLTSPEYSLLDTPIWLDSLLASVKEYVVSKIYAENAQERLLLLEEELRRVSIRVNLFEKKLIPTTSQTLKKIAIFLSDRSITDVGQMKMAKKKIQQHKE

SEQ ID NO: 128 - protein, 441 aa, Chlamydia trachomatis
  VARIANT (1)...(441): Xaa = Any Amino Acid
STKSGYLVTEQLLQEIFDLNQEITTLTESLKALGKXIVRVKPLGDFSSEEIRELTLKTGLAVRFFYKRHIEGAPLEVEEENVFYLATAYNYDYYAVIGIVSLSKDIFTEIEAPRSVNELREEAGHLQALLRKKKARVCELYAYREDLLEALCEQCNEQSLQHAEASAEDLFDDKVFSALGWVIVDRLDEVKKLCDSLGIYLERVQPDPDEVIPTYLENHGLGALGESLVNIYDTPASTDKDPSLWVFFSFFVFFSMIINDAGYGLVFLATSLFLSFKARKQIKRSIALKRFLQMFMILGLGCVCWGGATTSFFGVSVSYTSPFREYSLTHFLALKKAEYYLKERPKGYKELVHDYPILKEKKTPKEFLLAQSTSSGDSVYKAVVYDKFIDNILMEIALLVGVVHLSLGMLRYCRQRYSSIGWVIFMCGDICICLSICKPYL

SEQ ID NO: 129 - protein, 170 aa, Chlamydia trachomatis
TAVFFYRMGNLYVRRYMYLPIYLQAVSLIHYALHIPYELGGLVGYYVTFIGLGVAILGGVIQRGLRGLDEITAVIQVFSDVLSYLRLYALSLAGEMVGNTVMVMSERFSPAVGILIIIFGHTVNIALSIMGGVIHGLRLNFIEWYHYSFDGGGKFLHPLKKVIYQKSQNL

SEQ ID NO: 130 - protein, 125 aa, Chlamydia trachomatis
EMSSERKYMIDVSVVGPVLAMALAMIGSAVGCGMAGVASHAVMSRIDEGHGKIIGLSAMPSSQSIYGLIFMLLLNDAIKDGKVSAVSGIVMGIAVGSALLLSAFMQGKCCVSAIQAYARSSANIW

SEQ ID NO: 131 - protein, 216 aa, Chlamydia trachomatis
  VARIANT (1)...(216): Xaa = Any Amino Acid
GWKSLCSQWYRNGYSCRICVIAFCFYAREVLCECYSSLCAFLCKYMVNHLLRLGLLSLLRYLLSFLRYCYSKWXAAAFSALCLGGCSQPALSSFLEFIDNDYTAAAHLGIDRGCVTESVGQQLVVTWGLPSRFRDSLPMVLHVWVYYGNGEAAKFSYDVQHLSGYQVYTLKENDYQDRQGIXSYKVSLTKDGKEILSRSHHLWMEVISLKAFSQLS

SEQ ID NO: 132 - protein, 943 aa, Chlamydia trachomatis
MNEDQFPKAYDPKSSETGVYSFWERSGMFVANASSEKPAYSIVMPPPNVTGILHMGHALVNTLQDTLIRYKRMQGFEVCWVPGTDHAGIATQTVVERHLKASLGKRRTDFSREEFLKHVWDWKEKSQNVILSQLRQLGCSCDWSRQRFTMDPGANRAVKKAFKILFDKGVIYRGYYLVNWDPILQTALADDEVEYEERDGWLYYIRYQVVNSEEFITVATTRPETLLGDTAIAVSPEDQRYSHLIGAKVVVPFVNREIPIIGDFSVDASFGTGAVKITPAHDKDDYKTGMNHQLPMINILTSTGEINENGGIFTGLSREVALARENIITSLEALGLFVKKEAYSSRVGVSYRSGAIIEPYLSKQWFVSVDSFRDSLREFVNSEEIRIFPPEFVRNYLTWVNNLKDWCISRQLWWGHRIPVWHNKHDENVICFDGEGGPEEVMRDPESWYQDPDVLDTWFSSGLWPLTCFGWPDEDSLDLKKFYPTAVLVTGHDILFFWVTRMVLMCSAMVDTEPFSDVFLHGLIFGKSYREYDEKGEWFYVSGERKRDYDKGKALPKNVVAKWEKLSKSKGNVIDPIEMIEAYGADAVRLTLCSCANRGEQIDLDYRLFEEYKNFINKLWNGARFIFGHISELTSRDLEEGVASNQDLLGLEDFYILDRFNELLDLIDGHYNCYSFDKIASLAYDFFKNDLCSTYLEIIKPTLFGKQGSDQQRATKRKLLATLLINILGVLHPIVPYITETLFQKLKATLGTVENGKGDSVTGHAVSMLRSEACMVAEYPKPIHVAFPQGLRESFGIAERLVYTIRNIRGEMQLDPREPLQAFVISSEKKELVDVCIPIMCALGGVKTVEQLAEAPKDSIFSLGVVEGIQVGVILPPEHLAKERVRLEKEKTRLEKSIDSVSKLLASEDFRTRANPSLVQAKKDSLRNSQRELQSILDKLASL

SEQ ID NO: 133 - protein, 945 aa, Chlamydia trachomatis
TRIALKEAVLLQRYELIRLIGKGGMGEVYLAHDKACSRRVALKRIREDLSGNALLRKRFLREAKIAADLIHPGIVPVYSICSDGEAVYYTMPYIEGFSLKSLLKSVWQKEVLSKELEEKTSVKSFLPIFDKICATVEYIHSKGVLHRDLKPDNILLGLFGEVVIVDWGAAIFKHAKELKLEQDDEAAVSFDERNICYSSMTIPGKIVGTPDYMAPESLLGVEASEKTDIYALGLILYQMLTLAFPYRRKKGRKLSYRDVVLPPIEMSPYREIPPSLSQIAMKAIAINPADRFSSIQELRQALQPYLQGDPEWTVKATLMAKEKSCWKYYDPILLSRYFPVLASSPAQWYNFMLSEVEISASTRVEYTVTKSAVHEGMGILFLPSKEAERGEFYCGYGLWFSVQNHELTVSLIKNGIEIQKKSQEMISQQYRFAILIEKSDNRIAVFVEQALFILHIDYLPSLGNRLGVIIQDLQGMSNIAISESIGALRVSCLAVPDAFLSEKLYDQAAIFYRKIRDSFPGRKESYEAQFRLGVTLLTQIEEQGGDLTQALSSFDYLHGGAGAPLEYLGKALVYQRNGSFVEEIRCLLFALKRYSQHPEIPRLEDHLCFRLYDSLHKHRSEALVFMLLILWIAPEKISVREEKRFLRIIYHKQQATLFCQVDKAPLQFRSSKMELFLSFWTAFSLFLPELFRRAGELRDYQALADIFYVAGVSGNREAFMQFSTALANVSDEITFPESLHNQKVAELMFFVKGVEALRNKDYQKAKKAFMGKTPFTLQLYALDIFHIQAFLDEEIESFIDLLQAIYDPASEEERDHILVYIIQTHLWNRDLERAYKLLNDRFPLDEELAEYSEAFILWGCYLALTGDRVAVKAHFSRCRYKYGKSALIGKCVDGDIFDYLDNLVWWEKKMTLFQSYFLLRCLNESPRRYEKYRQAYLSMENNFFD

SEQ ID NO: 134 - protein, 133 aa, Chlamydia trachomatis
PPLGNQSVICTGPIFLEICVMSSISSPGNIQHPLPTTAAPNPPQKTGGHSNLLFVLALLPVIGLGVAIYLCARRANYWKGNAAIATAGGLGLITIAAALMVVITPIIFCLRYLYQLLCQLPAHCCGSSHQIEI

SEQ ID NO: 135 - protein, 241 aa, Chlamydia trachomatis
MLSAYYNDPFLADFCLGNIPLRLASRQSSLAVLQAHECLRKLQIFFPRLWGQIITTTTQGDLDQETPLCAVENTGFFTDDVDFLVQSGQCDLGIHSAKDLPENPKATVVSITASIDPRDILVFHEKYLSIPLPRRLRIGSSSVRRKELLSLLYPSAIITDIRGTIQTRLKLLEEKNFDAIVMANAAVSRLGLRLPCTKILPPPYHPLQGRLAITASRHIRSWRGLFLTCGITEDVEIMCFS

SEQ ID NO: 136 - protein, 487 aa, Chlamydia trachomatis
MYKSLLMGIFGEKALQDQKKKQKNLLLNRRYQHMTTKIKTQWTCTECGTHSPKWLGQCSGCLQWNTLVEERTAPKLNTSSYSSSSSIPIPLNNVEFQEEIRIHTQAQGWNRLLGGGTVRGSLALLGGEPGIGKSTLLLQISSQFAAAGHKVLYVCGEESVSQTSLRAQRLQISSNNIFLFPETNLEDIKQQIDNIAPDILVIDSIQIIFSPSLSSAPGSVAQVRETTAELMHIAKQKQITTFIIGHVTKSGEIAGPRILEHLVDTVLYFEGNVHANYRMIRSVKNRFGPTNELLILSMHTDGLREVENPSGLFLQEKIVETTGSTIIPIVEGSETLLVEVQALVSSSPFSNPVRKTSGFDPNRFSLLLAVLEKRANIKLYTSDVFLSIAGGLKITQPSADLGAVLSVVSSLYNRYLPKNYTYTGEIGLGGEIRHVSHMEHRIKESIIMGFKGIVMPFGQIKGLPKEFLDQIDIIGVKTIKDAVRLLQ

SEQ ID NO: 137 - protein, 234 aa, Chlamydia trachomatis
KIVMQHTVDIQAIESKLNFTFSHPRLLITALTHPSYRNEFPSAEEDSERLEFLGDAVLGLVVTEHLFLLFPALNEGLLSTTRAALVNAEACFEYTQKLSLGEHLLIGRGEKMQSHRGKISAYANLFEAILGAVYLDGGLSPARQIIVPLLPDKESILPLMLVNPKNRLQQFTQQTLKVLPSYKALPWKSEDGSPGYHVQVFVNGDLWGEGFAGSKKEAEKLAAKQALSTHDNKN

SEQ ID NO: 138 - protein, 157 aa, Chlamydia trachomatis
VSMRAVLHLEHKRYFQNHGHILFEGLAPVSDCKQLEAELKLFLKEVAVVKDRHLQRWRENVHRTLPGVQMIVKRVRLDHLAAELTHRSRVALVRDLWVQKQEEILFDDCDCSVLLCLSGEKAGWGLFFSGEYPQDVFDWGAGDTAIILRFSSAGFPN

SEQ ID NO: 139 - protein, 593 aa, Chlamydia trachomatis
MEIPRRKIEGMFDPQTAKNILSWLEDVVCDHTSVLTLLDNDPERLRELFSETLTFGTAGLRGLMGIGTNRLNVFTIRRATQGLARVLKRRYPDEKISVVIGYDTRHDSFEFGQETAKVLAGNGILAYLFQIPEPLALVSYSVRELQAKAGVMITASHNPPAYNGYKVYMSTGGQVLPPMDQEIMEEFQKVEMVSAVESLDHPYIRMIQEDMENYYEETLHKLQLCEEDNRRHGSLLRISYSPLHGTGVTMIPRILKDWGFSSVSLVEKQMVPDGDFPTVVLPNPEDPEALVLGIQQMVEQKDDLFIATDPDSDRIGVVSLEKEGPYRFNGNQIACLLAAHILSKESQKAPLGAEDKVVKSLVTTELLTAISESYGANIVNVGAGFKYIGEKIELWRSGMERFIFGAEESYGYLYGSYVEDKDAMIAAVLISEAALQQKIRGCTLRDALLELYEVYGYYANRTESIDLPIDQPQRKQELLDRWETQDPLRMSLSSRKLIAFENYNTGEGRDLVTDITYKLSLPKMSMLCFYYEGDCRVIVRPSGTEPKMKLYFEIKQSFSEFSKERTVREAREKESFEALQQFIKETKSHLFYS

SEQ ID NO: 140 - protein, 222 aa, Chlamydia trachomatis
KIEKVARIVTLFFRMAMVFSSYMLPALPYDYDALEPVISAEIMQLHHQKHHQGYINNLNEALKSLDVANATQDLTRLIAINPALRFNGGGHINHSLFWEMLAPQGKGGGVPPRHELLKLIEKFWGSFDSFLKNFIASSAAVQGSGWGWLAFCPKKQEFVVQTTANQDPLEATTGMIPLPGVDVWEHAYYLQYKNVRIDYLKSFPSIINWDYIENRFVEMSKQ

SEQ ID NO: 141 - protein, 312 aa, Chlamydia trachomatis
EDGFVRLFSYDKPKIKVQKIKADGFSGWLKCTHCSEMIHANELGQNFNCCPKCSYHYRISVSERIALLADKDSWNPLFSDLRSQDPLNFVDTDTYPNRLEKARKDNPDSEGVLVGACTIGSYPVALAVMDFSFMAGSMGAVVGEKLTRLIEKAIDSRLPVIIVSASGGARMQESVFSLMQMAKTSAALAKLHEAKLPYISVLTNPTSGGVTASFASLGDVIIAEPKALICFAGPRVVSQVIGEDLPEGAQKSEFLLEHGMIDKVVERKQLKTTLESLLSFFSCQAYSGGKGNCPRDISKTIKEIFLLTDDNK

SEQ ID NO: 142 - protein, 145 aa, Chlamydia trachomatis
  VARIANT (1)...(145): Xaa = Any Amino Acid
MKFFCKLESGSSLPEYATSGASGADVRANINEPIAILPGQRALIPTGISVEIPHGYEIQVRSRSGLASKYGVIVLQSPGTVDADYRGEIRVILANLGEXTFIVEPGMRIAQLVVAKVEQVSFVETQEELTATARGTGGFGHTGEC

SEQ ID NO: 143 - protein, 168 aa, Chlamydia trachomatis
VDLGILGNVKMTCVADHKQAVTLSSLLSSDLITFLHSDTREDILFELSELAARAGLLEDREAFFRALLARENIMSTGIGMGVAIPHGKIDGSADFFIALGIHSEGILWDAIDGLSVRLVFLIGGPSDAPSKYLKLLSALTQSLRDEARRSQLLQVQTVEEVMSVFSGV

SEQ ID NO: 144 - protein, 102 aa, Chlamydia trachomatis
  VARIANT (1)...(102): Xaa = Any Amino Acid
RSYECFFRSLVMDLRLDQLAVLLDVAEDSIRQWVSCGGIPSYTINDELRFNREEVEDWLIHNHGVIPDEKREEKGESKDLSLRYSLYRAXYXGRGSKKCSCR

SEQ ID NO: 145 - protein, 174 aa, Chlamydia trachomatis
  VARIANT (1)...(174): Xaa = Any Amino Acid
MGLFQMKNERKKGSPRICHLDIAYIELFIXGGVLKNVLVDSKEGALRYAAHYIANKFELDPVVLFEMLMHRESLMSTGIGEGIALPHAKDFLINVGYDIIVPVFLSQSIEYGALDGKPVDTLFFLFANQDRNHLNLVNKIVHLGMSIQARLFLKEHPDQPQLLAFVKNWEAQIH

SEQ ID NO: 146 - protein, 400 aa, Chlamydia trachomatis
VINKKRIVRPSCEKSFNVAMVIPKVDLGESAVMLGYKLTSQLAMLSILLTFTHTMGHASQMSQTLPTIMEAQAEEALQADRGVSGQALKKLRKKRCASRKSAWKASFEKKDFFSCITNGLFSRNHEQRLTAKKENKARGKEPRVVVQTTKKRQTTQSEKEFFDWLCNSKRDDKRKLLKKKPVNTSLAKSEELSPKEAAIAAARASLSPEEKRQLIREWLAEEKTARKSGRAACAVSENLKRDGSITSTLRYDAEKALTTRVKRNENSVNARARQRAALQKAKKAKTEKPEADEKAAEAVAAAPTKQAHKEPENYFAATASTNNTNVMSYLNAHQYRCDSSETDWPCSSCVTKRRANFGISVCTMVVTVIAMIVGAVIISNATDSTVAGSSGTGGGGSTQP

SEQ ID NO: 147 - protein, 347 aa, Chlamydia trachomatis
DATKIRWCFFPQSNTLSHASRTLYTVLKVALSLGVLAGVATLVVFLPPSLPFIAVIGVSSLALGMASFLMIRGIKYLLEHSPLNRKQLAKDIQKTISPDVWASMVHYQHQLLSHLHETLLDEAITARWGEPFFIEHANLKAKIEDLTKQYDILNAAFNKSLQQDEALRSQVEKRAYLFPIPNNDENAKTKESQLLDSENDSNSEFQEIINKGLEAANKRRADAKSKFYTEDETSDKKFSIWKPTKNLALEDLWRVHDEACNEEQQALLLEDYMSYKTSECQAALQKVSQELKAAQKSFPVLEKHALDRSYESSLTMMDLARANQETHRLLNILSELQQLAQYLLDNH

SEQ ID NO: 148 - protein, 222 aa, Chlamydia trachomatis
HTPKTFPLKVHHSFSDKHPQIAKAMWITGIALAALSLLAVVACVIAVSAGGAAIPLTVVGGIAAMSGLLSAATIICSAKKALAQRKQKQLEASLPLDNATEHVNYLTSDTPYFNQWESLDALNKQLSQIDLTIQAPEKKLLKEVLGSRYDSINHSIEEISDRFTKMLSLLRLREHFYRGEERYTPYLTPPLLKKNRLLIQITSNMIRMLPKFGGVFSLKAIH

SEQ ID NO: 149 - protein, 151 aa, Chlamydia trachomatis
TKAFSGFIVRKTVIVAMSGGVDSSVVAYLLKKQGEYNVVGLFMKNWGEQDENGECTATKDFRDVERIAEQLSIPYYTVSFSKEYKERVFSRFLREYANGYTPNPDVLCNREIKFDLLQKKVLELKGDFLATGHYCRGGADGTGFVQRKRPQ

SEQ ID NO: 150 - protein, 203 aa, Chlamydia trachomatis
DALSNVLFPLGGMYKTEVRRIAQEAGLATATKKDSTGICFIGKRPFKSFLEQFVADSPGDIIDFDTQQVVGRHEGAHYYTIGQRRGLNIGGMEKPCYVLSKNMEKNIVYIVRGEDHPLLYRQELLAKELNWFVPLQEPMICSAKVRYRSPDEKCSVYPLEDGTVKVIFDVPVKAVTPGQTVAFYQGDICLGGGVIEVPMIHQL

SEQ ID NO: 151 - protein, 431 aa, Chlamydia trachomatis
SWSSCTSQYDGTTSDLMRLEAEIEKTKQAKEQAIGTQEYEKAASLRDEEKKLREKLGNMKQQWESNKEEHQVPVDEEAVAQVVSVQTGIPAARLTEAESEKLLTLETTLQKKVIGQSQAVASICRAIRRSRTGIKDPNRPMGSFLFLGPTGVGKTLLAQQIAIEMFGGEDSLIQVDMSEYMEKFAATKMMGSPPGYVGHEEGGHLTEQVRRRPYCVVLFDEIEKAHPDIMDLMLQILEQGRLTDSFGRKIDFRNTIIIMTSNLGADLIRKSGEIGFGLRSHMDYAVIKEKIDAAVKKHLKPEFINRLDESVIFKPLEKEALSEIIHLEINKLGSRLQNYQMDLNIPDSVISFLVTKGHSPEMGARPLRRVVEQYLEDPLAEMLLKESCRQEARKLRARLTEERVVFEREEEAVSALAIEGDGSEPITADES

SEQ ID NO: 152 - protein, 438 aa, Chlamydia trachomatis
MFEKFTNRAKQVIKLAKKEAQRLNHNYLGTEHILLGLLKLGQGVAVNVLRTLGVDFDTAKHEVERLIGYGPEIQVYGDPALTGRVKKSFESANEEAALLEHNYVGTEHLLLGILNQSDGVALQVLENLHVDPKEIRKEILKELETFNLQLPPSSSITPRNTNSSSSSKSSSPLGGHTLGGDKPEKLSALKAYGYDLTEMFKESRLDPVIGRSAEVERLILILCRRRKNNPVLVGEAGVGKTAIVEGLAQKIVSGEVPEALRKKRLITLDLALMIAGTKYRGQFEERIKAVMDEVRKHGNILLFIDELHTIVGAGAAEGAIDASHILKPALARGEIQCIGATTLDEYRKHIEKDAALERRFQKIVVQPPSVDETVEILRGLKKKYEEHHNVFITDEALVAAAKLSDQYVHGRFLPDKAIDLLDEAGARVRVNTMGQLRT

SEQ ID NO: 153 - protein, 242 aa, Chlamydia trachomatis
IMRTRVIDSIRGTPKDLMQKDRLLLDSLRKGEVILHLYEWEGIFPLTYGCFIKPERFLKANWESLGVSAASRPTGGGVTFHNSDYAFSLLVSSEHPLYQDSILANYHTVNRFVLKTINKLFGLEGSLSPIEVSTDRAESSNFCVALAKTSKYDVLIGNRKVGGAAQRSVKQGFLHQGSIFLSGNSLDFYRNILLPDLVDKIGPEVEKSAFFPLGMEASSTVLKEVRKEVKDSLMRIFMQEGI

SEQ ID NO: 154 - protein, 491 aa, Chlamydia trachomatis
RLFDADLYAGGDLIRMKMAFLRKIFVFVACVVSLNGFAHTIAIPDGDKKAKVLIHDNGYEMYEHLLAAISSAKYTVELCPCLAGGEILSTVLQRLEQRMEEVPALVSYILVQPTCIDDNDRKNLKTLQENYPDRFFYLFSDWPPYCNVFFPNVTESHTKLSIVDGKYIFIGGSNLEDLQCSKGDVDLEVSDSPRAVIGGVLRPSAMRDQDVTIVSEEYGALLRKEFCAHYALWKDFTQKLWLNKKLDDFRGIDPINLSIEKARSSFCAMIETSLCAVSVPLDKMHFIFSGPDESNNTIAEEYVRLINQAQHSIRIAQMFFIPVAKIYDSLMAACWDRGVEIYLVTNGRTDRSPEITRSYAWGNRINYFPLTFGSRPLLWERFLYSPSRASMKFYVSEFYVALANTQLHKKCMLVDDHILVIGSYNFGKKSNDCDYECIVVIDSKEAVSKAQVVFEKDLRLSKSVTHDDIINWYFDPVHYCLGYLEQRYMPS

SEQ ID NO: 155 - protein, 286 aa, Chlamydia trachomatis
FSFFFLKGLFSKKKGLLLAFFNKHQKKFIGLVIAGVCLSGVGVSVGQTVKKTNKLGSGKTVYRTPSGRKYSEKEFLLLKHFLSNEAYPFTGNPREWNFLNEGLLTERFLTNKLGEKLFLSIYKSGFPAFDKERSYEGYRRFDAPFISSEEVWKSSAPQLREAFHIFQQLTDPVSPEGFAVRVRLFLEEKKFPHYVLRQMLEYRRQMFNLPVDNSLVQGRDLRLFGYKNVKDWFGDKYISSVTEAMLCFIDEQKKKVGMPSLKEARQDFYDKAQMHLPDLVNMLSLI

SEQ ID NO: 156 - protein, 437 aa, Chlamydia trachomatis
SADAFARLSKHAEFNLTFEQLVASFYAFMGVEESDFLGMYREILLYKKALLSLEGAVSFDYYPLQKFFSMGKDSVSVELFHLPDSLVFKDKEDLEAFETYLHLTAFPSVHVLDVPTKAFPIERVRSKAECLVGKRFAVSYQSVKLADLEKYVPMAQVYQWYQNPENFEEILLEFPELETSSSLRDILNLKPTIVEKAHSYVRKAILRADPERIQSELAKKERQEEELFLSIGKDHVLPGIQNGVRLANVLMQQDSVASPSYTQDNEHFYSISVISRADKDEVLPYKEVLRKGLKKVLLEKYKAEERISRVLTHLQESFPNSQGQDLYQRRLVRFVKAFQTGKLAQGDLFGGLEKTMKTFSRGDQGAPQEFEDMFALKEGQVSDVLFDLDKGPFYYTAISKSCCDYPVSLDKLLFAKSHLNEEFLRPYLEEVFFHNPS

SEQ ID NO: 157 - protein, 137 aa, Chlamydia trachomatis
  VARIANT (1)...(137): Xaa = Any Amino Acid
DPIWKKFFFTTLVKGLSRTNMKGQKYYSDYHVWIEPIHSRIVKLGLSSQMAGXLGNILHIDLPSVGSFIKEGEELCILESSKSAIEVLSPVSGEVLEVNTALEDDILPVNNATESEGWFVVLQLTEDFRSESFSLEP

SEQ ID NO: 158 - protein, 244 aa, Chlamydia trachomatis
  VARIANT (1)...(244): Xaa = Any Amino Acid
MWLGDYSLLNLLGIFLQATFIQNILLSTFLGMCSYLACSSRLSTANGLGMSVALVLTITGSINWLVHYFITKPGALAWLSPALANIDLSFLELIMFIVVIAAFTQILELLLERFSRNLYLALGIFLPLIAVNCAILGGVLFGITRNYPFLPMVVFSLGSGCGWWLAIVLFATIREKLAYSDVPQHLRGTGISFITTGLMAMAFMGLTGIDISKPTTSKPAXXMNIATDSPQPNTHSSSEEPKAS

SEQ ID NO: 159 - protein, 217 aa, Chlamydia trachomatis
VESLMTTNKSYLTYFTDALWINNQPLIAILGICSALAVTTTVTTALTMGFAVSFVTGCSSFVVSLLRKITPESVRMIAQLIIISLFVILIDQFLKAFFFTISKTLSVFVGLIITNCIVMGRAESMARHVSPIPAFLDGLGSGLGYGWVLVCISIIRELFGFGTILGFRVIPEILYASAAHPDGYENLGLMVLAPSAFFLLGIMIWIVNIIRAPKTKR

SEQ ID NO: 160 - protein, 316 aa, Chlamydia trachomatis
MASKSRHYLNQPWYIILFIFVLSLIAGTLLSSVYYVLAPIQQQAAEFDRNQQMLMAAQVISSDNTFQVYEKGDWHPALYNTKKQLLEISSTPPKVTVTTLSSYFQNFVRVLLTDTQGNLSSFEDHNLNLEEFLSQPTPVIHGLALYVVYAILHNDAASSKLSASQVAKNPTAIESIVLPIEGFGLWGPIYGFLALEKDGNTVLGTSWYQHGETPGLGANIANPQWQKNFRGKKVFLVSASGETDFAKTTLGLEVIKGSVSAALGDSPKAASSIDGISGATLTCNGVTESFSHSLAPYRALLTFFANSKPSGESHDH

SEQ ID NO: 161 - protein, 344 aa, Chlamydia trachomatis
  VARIANT (1)...(344): Xaa = Any Amino Acid
LLRFERVTFSTFLSDTMLEKLVDSLWKICRKSKFQHMTPIADAVDTFCFEPLHTPSSPPFVRDAVDVKRWMMLVVIALMPTIFAAVWNSGLQALVYQSSNPRIMEAXLHISGFKSYFSFVSQEIGIGSVLFAGCKIFLPLLFISYAVGGTCEVLFAIIRKHKIAEGLLVTGMLYPLILPPTIPYWMAALGIAFGVVMGKELFGGTGMNILNPALTGRAFLFFTFPAKMSGDVWVGSNPSRIKESLATMSSLAEKSHFDGFSQSTCLQILNSTPPSVKRVHIDAIASNILNLEHVPTQDVLQTQFATWAESYPGLTVDQLSLEXTSKFCNYSNNRRRFRASSCTL

SEQ ID NO: 162 - protein, 198 aa, Chlamydia trachomatis
VGRGMFKRPAKNFFDEVQTLYEDSGANSTSYSIYPQRTERLENHSNIFEPAKPAETRLLSQEEHSQWTDQQEGLATQESSFPEEPETTLGEGVSFKGELTFERLLRIDGTFEGILVSKGKIIVGPQGYVKANIELEEAVIAGVVEGNITVTGRVSLQGRAMVTGDIQAGSLCVDEGVRLCGYVSIQGAPSNEQEEIDS

SEQ ID NO: 163 - protein, 481 aa, Chlamydia trachomatis
MLHLRFFSRRRVHYRILNSSSDKENAMLTCNDCSTWEQFVNYIKTRCSKTAFENWIAPIQVLEESSEKIRLEIPNIFVQSYLLDNYKKDLCSFVPLDAEGNPALEFVVAEIKRSSPLVTPSIAKPATEVSEENKDFQLKLNGAYRFDNFIEGPSNQFVKSAALGIAARPGRSYNPLFIHGGVGLGKTHLLHAVGHYVREHHKNLRIHCITTEAFINDLVHHLRVKSIDKMKNFYRSLDLLLVDDIQFLQNRQNFEEEFCNTFETLIHLSKQIVVTSDKPPGQLKLSERIIARMEWGLVAHVGVPDLETRVAILQHKAEQKGLNIPNEMAFYIADHVYGNVRQLEGAINKLTAYCLLFNKPLTETTVRDTLKELFRAPSKQKVSVESILKSVATVFQVKIQDLKGSSRAKNVPLARQVAMYLAKTLITDSLVAIGAAFGKTHSTVLYACKTIEQKIEKDALLKNQISLCKNNIAIDSPQHFV

SEQ ID NO: 164 - protein, 134 aa, Chlamydia trachomatis
RNPNGRRRIRDIAKHAQILDMTPKPSALSTLMQTNKKTCWASFSPPTNFHKQRFSTPYLVPSLGSPDKQDQDMEKISSYLKVLTRGKFSYRSTADTLSRKNKRSSDQKRNGQHFEQEELEAEEEVFSTRRHSIA

SEQ ID NO: 165 - protein, 282 aa, Chlamydia trachomatis
LLCRRFPVTDSIPHIPVLVKESLSLFRGRNPVVFCDVTVGAGGHAEAFLTEFPSIERYDGSDRDLSALALSENRLLPFKDRVRLRHASFEEVDTLTSDGTYDGVLADLGVSSMQLNNLERGFSFQGEDHPLDMRMDTSRGMTASEVLNSLREEEIGEIFRNYGEEPLWRSAAAAVVHFRKKKKILTVKDLKDATSGVFPSYRLRKKIHPLTLIFQALRIYVNQEGAQLKVLLDSAFRWLRPGGRLAVISFCSLDDRPVKWAFREAEARGLGKILTKKVIMPS

SEQ ID NO: 166 - protein, 185 aa, Chlamydia trachomatis
LMNHRRQLTLIVVGVLSLYALLIVRYYKIQICDGERWAVEAANQHEFRVKDPFQRGTFFANTSLRKGEKEQFHPLAIDITKFHLCLDAVVIPEEYRDEIARMVVVMVGEGDYQSIRSEFDRKSRYRKLYVSLDVSIRDRILSWWKPYAVKHKIPSNALFFISDYQRSYPFGKLLGQVLHTSGDKR

SEQ ID NO: 167 - protein, 348 aa, Chlamydia trachomatis
DEKSGEAFPTGGLEAYFNRLLEGENGERKLLRSPLNRLDVDKVTKIPRDGSDIYLTIDANVQTIAEQEIALGVLEAKARSGRAIVLNSHTGEILALAQYPFFNPREYREYFNCNDRIEDTKVKAVSDVFEPGSIMKPITVAIALLANEEMQKRAGENLFDPYEPLDVSRRVFPGRQKMPLKDIVSNRYLNMYMAIQKSSNVYMAQLADRIVQKLGADWYEQRLQDFGFGKRTGIELPAEAVGLVPSRKRFHKNGSPEWSLSTPYSLAMGYNLLATSMQMVQAYAVFGNGGFLIRPTLVRKIVSPSGEEKILSSNPKKIRVLSEKIVAGCCSCYAFHNMFRRDGDSCCY

SEQ ID NO: 168 - protein, 138 aa, Chlamydia trachomatis
LQDVVRAMRFTTCLGGTGIRAATKGYSSAGKTGTTEKLVDGKYDKKRHIASFIGLTPIAALSDTAVPLVILVSIDDPAYGVREDRTKNYMGGRCAAPVFSRIASRVLPYLGVPLDEQLHTYREEVSQLKLLYEEWNRK

SEQ ID NO: 169 - protein, 483 aa, Chlamydia trachomatis
MHLDQLLRNIPAKIYGKVESIPVRNLTRDSRCVGVGDIFIARQGQFCNGNDYSSQAVANGAIAVLSSLYNPFLSVVQIIAEDPIALEASLAARFYNNPSKHLDVIGITGTNGKTTVSCLVRELMERSGIRTGLIGTIEHILGENRIVDSFTTPDAILLQKYFAEMVKQNLSAAVMEVSSIGMALGRVRETEFLAGVLTNITSDHLDFHGSLEEYIAAKKQFFASLPEKGIAVVNLDCEYAPSFLNGSQARAVSYAIHQEADYRADRLKLYSSGSSYDIWYQGKVFPCETSLIGEHNVYNVLASLAVVHQFLGGDFADLVRDVRFLSAPKGRLDPILLGPFPVYIDYAHTPDALDNVCRILLQLLPKYGRLIIVFGCGGDRDRVKRPLMAKVSEHYGFSFVTSDNPRTEDPDQIIADICKGFSTDHYVVESDRKLAIEKAISMASDKDIVLVAGKGHEGYQIFKHQTIVFDDREVVCEALAALC

SEQ ID NO: 170 - protein, 190 aa, Chlamydia trachomatis
LRERDMRGIRSSNIRRLSLMIERLCVKPWQPFVNLTLLLLLLTLSSPVSCFADAAGIPKVSRNELIVIDPGHGGKDEGTADKELRYKEKTLALSIALSVQGCLRRMGYKTIMTRATDVYVDLSKRAAIANQNKADVFVSIHCNHSSNTSALGTEIYFYNDKNILRTRKSESLGKRSWLLCKKMELYANVK

SEQ ID NO: 171 - protein, 148 aa, Chlamydia trachomatis
VQLVGRFCAFMEKIKKVLNPKDECILYAYIAVFRDARVTTLTRRQQATMATMTKKKLISTISQDHKIHPNHVRTVIQNFLDKMTDALVQGDRLEFRDFGVLQVVERKPKVGRNPKNAAVPIHIPARRAVKFTPGKRMKRLIETPTKSS

SEQ ID NO: 172 - protein, 432 aa, Chlamydia trachomatis
SSSLFPALLSIVESGFSVSKLDSKFPQDYFLPLDVFLLTMLVESQLGLEDVLEAFSERNFDIQSKSLIESFQDKKLRRTVIQRFLHHPLLHIHDIARAAYLLAALEEGVDLGYQFLCMHQTQSGAALLFRRAGFLWGGLPYPGEHAEMAMLLSRIAEFYDTSYEQVQKMIAFQHALFSHERNIFPALWSQEGSRSNQEKTAVSKLLFCQKEARIEDQFTLTDMSLGFWMRRTPSFSAYVSGSGCKSGVGAFLIGDVGVLNYGPCVGDPGECLGFGLCGQVKEFSCQEKDEEVSISFAGALSQPSSRRTGFSYLQDALFSTNSCYRIDITEQKCHVASSLDRENQDAFFAIFCKGSQCQVCNGPKLRTGSPDSYKGPAYDVLIKGEKETVRILSSSPHMEIFSLQGKDRFWGSNFLINLPYTQNSINILFEKA

SEQ ID NO: 173 - protein, 231 aa, Chlamydia trachomatis
  VARIANT (1)...(231): Xaa = Any Amino Acid
SCSCRRFAKIQXQRFMLIGQEKGCDTKSRMHRNFGMLCPEGFRKALRLAKMAEKFGLPIIFLVDTPGAFPGLTAEERGQGWAIATNLFELARLATPIIVIVIGEGCSGGALGMAIGDVVAMLEHSYYSVISPEGCASILWKDPKKNSDAAAMLKMHGEDLKGFAIVDAVIKEPIGGAHHNPAATYRSVQEYVLQEWVKLKDLPVEELLEKRYQKFRTIGLYETSSESDSEA

SEQ ID NO: 174 - protein, 646 aa, Chlamydia trachomatis
MKLLLKAILRHKKHLVLFGFSLLSILGLTITSQAEIFSLGLIAKTGPDTFLLFGKQEGASLVKRKELSKDQLLEQWDNIVGEGDTLSLPQANAYIAKHSGGSQSITKRLSAYLSGCFDFSRLQCLALFLVVVAILKSTTLFFQRFLAQLIAIRVSCSLRKDYFLALQTLPMTFFHAHDMGNLSSRVIADSSMIALAINALMVNYIQAPITMTLALVVCLSISWKFCACVCLAFPIFILPIVIIAKKVKALAKRIQKSQDHSAAALLDFLLGILTVKVFRTEQFSFSKYCQKNDEIARLEERSAVYSLIPRPLLHTIASLFFALVIMIGLYHFHIPPEELVVFCGLLYLIYDPIKKFADENANIMRGCAAAERFYEVLDLAKQQSNVSEKLNEFQGLQHSIQFCNVSFGYVEDSPVLSDFNLVLKKGEAIGIVGPTGSGKSTIAKLLPRLYEVSHGELLIDSLPIQSYCKNSLRKHIGCVLQHPFLFYDTVWNNLTCGRTFLEEEVFHALKQAHAYEFVSKMPQGVHSLLEESGKNLSGGQQQRLTIARALLHNTSILLLDEATSALDAISENYVKEIVGQLKGRCTQIIIAHKLSTLEYVDRIVYLEQGKKIAEGTKEELLDSCPAFQRMWVLSGAKDWELNAVVK

SEQ ID NO: 175 - protein, 219 aa, Chlamydia trachomatis
QKKPLTSLLSDGKLFLHYGRLVVMFKLLLIFADPAEAARTLSLFPFSLNKENFYTYHTENVLLDVMVLKTWGYRGVVQALSPPPSGYDLWINAGFAGAANPNIPLLKTYTITSVKELTPTTSVEEELEVTPIPRLPLAQLTSVRSPYRDGFHEHLQLVDMEGFFIAKQASLVACPCSMIKVSSDYTTREGQDFLKNNKVKLSQKLAEAIFPIYSSFIDV

SEQ ID NO: 176 - protein, 256 aa, Chlamydia trachomatis
MTFSAAFSPCPNDIFLFRSFLEKHKGFPSLRQIMIADISSLNYYALETRFPLIKISASLYPQIADSYDVLNVGTTLGYKIGPLILSKQLDSPLKSLATPGETTTAHALCRLFYPRAELVPMKYHEIIPAILSNRVDGGAVIHEERFSFPKDLCIVEDLGQLWEKTWHLPLPLGCIVISKKVSDDDSYLLSHALQESLKKSLTDSALAIQKASEYSRDKNPTTIQHFIDTYVTEETFNLSSIGRQAFSTLWTACRNV

SEQ ID NO: 177 - protein, 401 aa, Chlamydia trachomatis
MTTWTLNHNNLTKFLTHAQLEPSLERESGLIYITVPAGEHELPLFFVIRNEGEVLQLVCYFPYQIQQNQRDTTARLLHLVASNRDIDIPGFGMDEEQNIIFYRLVIPCLKGEINEDLLRVYIDTIKLICDSFFHAIGLISTGNMDLDELKKQAKLENNQSDQLEPLEELVPALIFYDTETTGTQIDKDRIVELAAYNGTTSESFQTLVNPEIPIPAEATKIHGITTAEVADAPRFPEAYQKFIEFCGTDNILVAHNNNAFDYPLLVRECRRHGLSEPQLRTIDSLKWAKKYRTDLPQHSLQYLRQVYGFEENQAHRALDDVITLYRVFSALVGDLSPDQIYDLLNETCHPRIFKMPFGKYKGKPLSEVPSSYIAWLQKGDYLLQPENKEIKAAIEAYQQLK

SEQ ID NO: 178 - protein, 254 aa, Chlamydia trachomatis
LGGEGVMIVADFEYFGLSDVGLVRHNNEDFWQVNYDSQLIAIADGMGGHRAGAVASYEAVGNLMQLVDLHKVDLERFGDEQYKESIKTIVSEVNLLIYRQGLSNEEFKGMGTTLSCMQFRRGKAWLFHVGDCRVYRLRNKMLERLTEDHSLANHLASRYGLSKQSVKRYPGRNVLTNVLGSRPHVSLDIREMSYEKEDLFVFCSDGLTSAVSDHDMLDILTQTTTLEEGGNILISLANSRGGRDNATVILVRMR

SEQ ID NO: 179 - protein, 374 aa, Chlamydia trachomatis
MTIYLDTNASALLEPGVLMCLHSLFIGEGGFGNPSSVHSFGKKTKKLVKETSTLIEKALGFSHCRVIYTSGATESLNLAIQNIPTGSHVITSSMEHPAVIEPLKQAKLSVTYLDPIPGECVVSLEQIKEAVQSDTSAIVLGWVNSEVGVRIDLEAIAEFAKERQLLLIVDATAIVGKEVIHIPEGVSMVAFSGHKFHALSGIGVLLTSPKIKISPIISGGGQQGGIRSGTEHIHGIASLRYIFSKLLVEQPAIAQTMRSYRDLFESRIQEAFPECIVHCQDKPRVSNLSAIAFPGLEGEVMQIALDLEGVACGYGSACSSGATTVFKSLTVMKVPQDLAVATLRFSFSYLLSEEEILTAAQRVIRVVKHLQQYA

SEQ ID NO: 180 - protein, 404 aa, Chlamydia trachomatis
METNSPFFWLGVNLLCIFVQGFFSMMEMACVSFNRVRLQYYLTKSNKKASYINFLIRRPYRLFGTVMLGVNIALQIGSESSRTCYKLLGISPEYAPATQIILVVIFAELIPLAISRKIPEKIALKGAPILYFAHYLFYPLIQCVGGITNMIYFILNIKEETIHSTLSRDELQKTLETHHEEHDFNVIATNIFSLSATSVEQVCQYLDQIPILSATASVRDVCQLVRRHRLDFVPVYHKVKKNVVGIAFPKNLINRNPSDPVVPYLSSPWFITAKSKLIHAIQEFRKNSSKIAIVLNNNGEPMGVLGLHTVFKTLFNTRNITQLKPKPTSLIERTFSGNTPLSEIENELDIIFMDNDCTTIEQLMLKLLDTPPEVGASIIINDLLLEVKEISLYGIKTVAIKDTL

SEQ ID NO: 181 - protein, 283 aa, Chlamydia trachomatis
KFRPIFDWAISGINFIVQKMLARQESDFIQPQELKEVLRSCKDFGVVNHEESRLLFGYLSMEEGSIKERMTPKQEIIFYDVLTPIENLYKLFSGPKQSYSKVLVCKGGLQNLLGVCSAKLLLLYKEKLQSAEELLPLLRKPHYIPETVSAKTALYHLAGEDCGLGIIIDEYGSIEGLITQNDLFKIVSDEVAHNRPSFKQFAHSDKNVVIAAGTYELSDFYDLFGVDLPTTANCVTIGGWLTEQLGEIPETGTKFAWGQFVFQILDAAPNCVKRVYIRKTHGN

SEQ ID NO: 182 - protein, 174 aa, Chlamydia trachomatis
SGSAHNNPNRMFSSAIVILTAIFVLCSGFVSLSHIALFSLPSSLIAHYSHSKNRQLRQIANLMAYPNHLLITLVFFDIGINIGVQNCIATLVGDSASLLLTVGVPLALTLVLGEIVPKVIAIPYNARIAKIVTPIIFASTKSSALYLIGLSRVSILSFRKCWPVKKVILFNPKN

SEQ ID NO: 183 - protein, 128 aa, Chlamydia trachomatis
IMEEKGILQLVEISRAMALQGVCPWTNLQSVESMLQYIAGECQELADAVQENKASLEIASEAGDVLTLVLTLCFLLEREGKLKAEEVFVEALAKLRRRSPHVFDPHNQISLEQAEEYWARIKQQEKIS

SEQ ID NO: 184 - protein, 228 aa, Chlamydia trachomatis
  VARIANT (1)...(228): Xaa = Any Amino Acid
GHKIESIFSLSCVMRKFWLLASFGLLSLTTTTLSSCAVSNSGSYNARLYTKGSKAKGVVAMLPVFYRTEKSAELLPWNLQAEFSEEISRRLHSSDKLLLIXXHASAGVAAQFFSPTPNISPELATQLLPAEFVVAAEILEQKTTEDVLNPSISASVRVRVFDIRHNKVSMIYQEILDASQSLASGSNDYHRYGWRSKNFDSTPMGLMHQRLFREIVARVEGYVCANYS

SEQ ID NO: 185 - protein, 220 aa, Chlamydia trachomatis
VIHWDQSRTLLSFPRVGLHLSWYGILFSLGIFLSSFSGIKLATALCKDREEKKELRTSLENFALGALLAIIIGARLAYVLFYGGSFYFENPSEIIKIWKGGLSSHGAVISVVIWAAVFSRLHIRKLPMLSVTYICDLCGAVFGCAALLIRVGNFMNQEILGTPTSMPWGVIFSNGGGQIPRHPVQLYEGLGYLVLSCILCRLWLSWCYIVWVLAIVQQAL

SEQ ID NO: 186 - protein, 92 aa, Chlamydia trachomatis
TSCSALRRPWLFSAFLYSVQALAIVVLYRLGSGYSAAGALIGVAVIRFCAEFFKTHQGAWLGEENILTIGQWLSIPMVFLGVGIIWIASKKK

SEQ ID NO: 187 - protein, 334 aa, Chlamydia trachomatis
ERGFPPHRENPPRMRMNKRTLLFVSLVSAAFLGCQIFFGYRDLKSCQDLAEKQRAISEQILASTEQLSVVPWTASLEESESVNQYAIRLGNRLLLLTKGGSHPEVYSRGTSWSLIEQTSTFGGILVSLYGETGQEVLSKGSSVYLPNQRDAFPVLVAEFRSNQEPLVFLGEYKDGKIANKAGAIYGTSLVFLNTGNEFVPLGIYNSKEECVESLDLPMARAVVFADKENPTASGSYYMLSNEYMQIVVSQESGAIEGINLPFASDQEENKSIVNEIGFDRELAINSPSEASFPGVETIDSQRQNIANVVGGYYPLLRRGTLSDVKKRVPAQYQA

SEQ ID NO: 188 - protein, 225 aa, Chlamydia trachomatis
NIVSGRELASPVATGFRVVSFDNKTLILESGDGGIRKTYSLGEQPYAFELEIQTTQGREDLWITSGVPEVEIMSNAFVPAVKYHAVKKNKSDLFNVKLPKAKDSLLVRNNATPQWILNSNGYFGVILTPRTPIPAGYASSFIPGNVVPTRLSQLPPKDQAYPASKYPGYTAMLPLPKEAGRYQFMVYAGPLADPTLKTLDRLTRILKEKLLSILMRLLSEGSLVL

SEQ ID NO: 189 - protein, 264 aa, Chlamydia trachomatis
TNANSKGETPEYIDAIAFRGFFSFITEPFAALLFVIMKFFKFLTGSWGISIILLTIVLKLLLYPLNAWSIRSMRRMQKLSPYIQEIQQKYKREPKRAQMEIMALYKMNKVNPITGCLPLLIQIPFLIAMFDLLKSSFLLRGASFIPGWIDNLTAPDVLFSWETPIWFIGKEFHLLPILLGVVMFAQQKISAVKRSGPASDQQRQQEAMGTMMALLFTFMFYNFPSGLNIYWFSSMLLGVIQQWVTNKILDEQHLQHEVIINKKR

SEQ ID NO: 190 - protein, 459 aa, Chlamydia trachomatis
  VARIANT (1)...(459): Xaa = Any Amino Acid
DSFMRAWEEFLLLQEKEIGVDTVNKWLRSLKVLCFDACNLYLEAKDSFQVTWFEEHIRHKVKASLINNNGKPIRVRVTSLDKSTPFKDTQIQQEKTAYFTMKYGDIDPNMSFANFLVTPENDLPVRILQEFAKVSEQGKGFPFNPIYLFGPESSGKTHLMQAAVGGLREAGVKTLYVTSELFTEHLVSAIRSGEMQRFRAFYRNVEALFIEDIEVLSGKGATQEEFFHTFXSLHTEGKLIVISSTFAPGDLKAMEERLISRFEWGISIPVSPLTREGLKSFLERRIEKLNIRIEETALDFLIQALSSHVKSLLHALTTLAKRVAYKKLSHQMLYQGDIEALLHDVLQAAESIRLTPSGIVRATAQYYGVSPESVLGRSQSREYVLPRQVAMFLCRQKLSLSYVKIGEVFSRDHSTVISSIRAISQKLEEDDRECDVSCAIQELTKRLSSAYQSLDFIED

SEQ ID NO: 191 - protein, 119 aa, Chlamydia trachomatis
GGFMGIKPHDYGCWGSRGNVFTLQDLNTQQANQSAAASSSSVLKSECAAKVARYALGFLFGLGFILSIVTFIAAAATLPLGTTTILIMVTQIAFAAALAFKLYDLFKHDVPTCSITSKA

SEQ ID NO: 192 - protein, 616 aa, Chlamydia trachomatis
EASMYFDRTKINVESMKQAILERVYCGVVQTPQSASTRDIFIAVAKTVLEWMAKGWLKTQSSYYDNDVKRVYYISMEFLLGRSLKSNLLNLGLLDLVKEALFDLGYDFDQLVEMEHDAGLGNGGLGRLAACFLDSMATLEIPAYGYGLRYDYGIFDQKIENGFQVESPIEWLRYGNPWEICRGEYLYPVHFYGKVKHSIDSRGRDVAELVDSQEVLAMAYDVPVPGFNNDTVNSLRLWQAQSRHGFEFSYFNHGNYIRAIEDIALAGNITRVLYPNDSISEGQELRLKQEYFLVSATIQDILRRYTKTHLSLDKLSEKVSVQLNDTHPALGIAEMMRLLVDREELDWDVAWDATTKIFNYTNHTILPEALERWSLDLFSKVLPRHLEIIYEINARWLAKVSQKYPGDNDKRRALSIIEEGSSKFVNMANLAVVGTNKVNGVSTFHSQLIKSTLFKDFVEFFPDKFINVTNGITPRRWLALSNKKLSSLLNRTIGTEYLTNLTHLHKVIPLAEDSGFREEWRNIKIQNKEELAARIYKELGVTVNPQSIFDCHIKRIHEYKRQLTNILRVIYFYNEIRNGSGEIVPTTVIFGGKAAPGYAMAKLIIKLINNVAAVVK

SEQ ID NO: 193 - protein, 206 aa, Chlamydia trachomatis
  VARIANT (1)...(206): Xaa = Any Amino Acid
QLLLNNDPKVNDQLKVIFWPNYRVSLAEAIIPATDLSEQISTAGMEASGTGNMKFALNGALTIGTMDGANIEMAEHIGKEHMFIFGLLEEEISELRKEYYPQGICNANPTIQEILDMIAQAKFSQEDKDLFKPIVNRLLNEGDPFFVLADLEAYINTQNRVASLFKQPEEWTKKSIYNVGGIGFFSSDRSIAEYASNIWXVSRPTS

SEQ ID NO: 194 - protein, 149 aa, Chlamydia trachomatis
DNVNIQVEPTASSPFKTTGCSSTLPTARIAACGGFKIAVKSEIPVIPRLDTQKEPPLYSSSARDCCLALVASPLISAEIIPIFFLSAQRTIGVITPSGIATAIEISIVENRIILLSTLLNPELISGNSFRAKAQARTIQSLIESLIFCS

SEQ ID NO: 195 - protein, 432 aa, Chlamydia trachomatis
GNVVVSLLKMPKLSPTMEIGILVKWHKKAGDEIHFGDVLLEISTDKAVLEHTASEDGWLLEILVKEGTKTPIGTPIAVFSTEQNAQYDLKQLLPLEETVVTDAATEASPKDSAQTDSQYTSGPSITMMGFRPEPPLATPLTIKHSNDPVLASPLAKKLAKEQNLDLSGVTGSGPGGRIIKKDLEKAPPLRIAGFGYPEAPNVNPGSYIEEPLSPVREVISKRLQAAKTFIPHFYVRQRIYASPLLALLKELQEQNIKLSINDCIVRACALALKEFPEINSGFNSVDNKIIRFSTIDISIAVAIPDGVITPIVRCADRKNIGMISAEIKGLATKAKQQSLAEEEYKGGSFCVSNLGMTGISDFTAILNPPQAAILAVGSVEEQPVVLNGELAVGSTCMLTLSVDHRVIDGYPAAMFMKRLQRLLEAPSVLLLN

SEQ ID NO: 196 - protein, 334 aa, Chlamydia trachomatis
KRGSMPNFVTLEIREAIRQAIDEEMTRDPNVCILGEEVAEYNGAYKVTKNLLDKWGPTRVIDTPISEAAFSGIGIGAALTGLRPIIEFMSWNFSLVALAADQIISHAAKMYYMTGGKFAVPIVFRGANGAAAQVSCQHSHCVEALYANIPGLIVIAPSTPADAKGLLKSAIRDNNPVLFLENELDYNLKGEVPSEEYLIPIGKARIVQEGKDLTIISHSRMVSIVEQAAKTAKQRWGLSIETIDLRTIKPLDVATLLTSVKKTGNCLVVEEGHYFCGISAEVITTITEHIFDYLDHPPLRVCQKETPMPYNKTLEMATLPNINRILDAIEKIMR

SEQ ID NO: 197 - protein, 129 aa, Chlamydia trachomatis
QNPKRFLMVFLSITLNGFDLFNSLIGFREAYHHMQQTGSPIIVEALCSRFRGHSISDPNLYRSKEEMQCLLKRDPILFAKEWLIRANVLSEDDFKDLRQTSKTAVLEAVAQARLDPEPAVATLEEGVYA

SEQ ID NO: 198 - protein, 140 aa, Chlamydia trachomatis
LCCWNIPLRQLAAELLGKETGCALGRGGSMHMCGDRLPGGFGIVGGQIPLAAGAAFSMKYQNSSSISMCFIGDGAVAQGVFHETLNFVALHSLPLMLIIENNGWSMGTALHRAIAKQPIAESQAISYGLSFDHFEWIRFI

SEQ ID NO: 199 - protein, 126 aa, Chlamydia trachomatis
  VARIANT (1)...(126): Xaa = Any Amino Acid
MHPLTLNIASEETTEAXVFHVIENFGNAFCIDLLKKMLLIREFEIRGEEAYLEGLVGGFYHSYIGQEAVATAAIACTGKDHWFFSSYRCHGVALLLEYPFTTTGSRTSRERNRVCFRTRRIYAYVW

SEQ ID NO: 200 - protein, 405 aa, Chlamydia trachomatis
SWFEVLKFHFPCSEGLIRGFSIEFLCCILTDKKIQYPLKNFICVEFIVASNSFFGILPRGIPNVGGLSEVAGENKQSLEEREQDKELKLEKKLLAIRKRIKCFCPQQPEISVQAAPLKHTGTFPCSEEELRDISDLFSSLKSFRQQLAQLFFYTPPLNLEWEDFLKFFFAFEKRELGGILFSAGPFESFDRYLYQVNKARPVPVLIATTVSYALQAYCSYINRAPFQEKENFFQLGEAVGIFLKERKVSIALMYKEILDLDNKQYSELCRGLQKSQIVQGEVFHSSTQERDGLNPISVNYDLMGTIAALSVNIDRSCLRFSGSHIFHDDEMAIETLHKGGDVFTFSSLAEFQFSEKRLLHLVSTGRVCPEIIRKKLIKVLLLKKRALCKPFCRHIQITSETAQLN

SEQ ID NO: 201 - protein, 354 aa, Chlamydia trachomatis
MSQSTYSLEQLADFLKVEFQGNGATLLSGVEEIEEAKTAHITFLDNEKYAKHLKSSEAGAIIISRTQFQKYRDLNKNFLITSESPSLVFQKCLELFITPVDSGFPGIHPTAVIHPTAIIEDHVCIEPYAVVCQHAHVGSACHIGSGSVIGAYSTVGQHSYIHPRVVIRERVSIGKRVIIQPGAVIGSCGFGYVTSAFGQHKHLKHLGKVIIEDDVEIGANTTIDRGRFKHSVVREGSKIDNLVQIAHQVEVGQHSMIVAQAGIAGSTKIGNHVIIGGQAGITGHICIADHVIMMAQTGVTKSITSPGIYGGAPARPYQEIHRQVAKVRNLPRLEERIAALEKLVQKLEALSEQH

SEQ ID NO: 202 - protein, 178 aa, Chlamydia trachomatis
ERIMKKFLLLSLMSLSSLPTFAANSTGTIGIVASNLRRCLEESALGKKESAEFEKMKNQFSNSMGKMEEELSSIYSKLQDDDYMEGLSETAAAELRKKFEDLSAEYNTAQGQYYQILNQSNLKRMQKIMEEVKKASETVRIQEGLSVLLNEDIVLSIDSSADKTDAVIKVLDDSFQNN

SEQ ID NO: 203 - protein, 799 aa, Chlamydia trachomatis
  VARIANT (1)...(799): Xaa = Any Amino Acid
IKEVIMLGIRKKTILQLAVLLLLTFSQSSFCSTSEGRMVVESITITTQGENTQNKRAIPKIKTKQGTLFSQADFDEDLRTLSKNFDRVEPIVEFRNGQAVISLILTAKSVIREINISGNEAIPTHKILKTLELYKNDLFDRELFFKNFDALRTLYLKRGYYDSQLSYSHNHNEKEGFIDISIEIKEGRHGRIKKLTISGITRTEASDLGDIVLTKQYSTTTSWFTGAGVYHPDMVEQDLFAITNYFQNKGYADAKVSKEVSTDAKGNITLLIVVDKGPLYTLGHVHIEGFTALSKRLLDKQLLVGPNSLYCPDKIWTGAQKIRSAYARYGYVNTNVASPVSFSAHPTLPVYDVTYRVSEGSPYKIGLIKIKGNTHTKHDVILHETSLFPGDTFYRLKLEDTETRLRNTGYFKSVSVYTVRSQLDPLDSNDLYRDVFIEVKETETGNLGLFLGFSSIDHLFGGAEIAESNFDLFGARNFLKKGFKSLRGGGEYLFLKANLGDKVTDYTVKWTKPHFLNTPWILGVELDKSINKALSKDYSVDTYGGNISTTYILNDKLKYGMYYRGSQTSLSLRKKTSSSNRLGPDLDSNKGFVSAAGLNVLYDSIDNPRKPTMGIRSFLNXELSGLGGTYQFTKLTASGSIYRLLTKKGVLKXRAEAXFIKPFGTTTAQGIPVSERFFLGGETTVRGYKPFIIGPKFSPTEPQGGLSSLLLTEEFQYPLISQPCINAFVFLDSGFIGIEEHTIRLKDLCSSAGFGLRFDMMNNVPIMLGWGWPFRPTEILNNEKIDVSQRFFFALGGVF

SEQ ID NO: 204 - protein, 205 aa, Chlamydia trachomatis
IGLKDMLKYPDYISKLISFLKKLPGIGFKSAEKIAFELLEWDPSQIEAMALALQEFSTSHATCSNCFCLKISQTSPCNFCSESRDSSSLCIVATPKDVFALEKSKIFKGHYFVLGNLLSPITGKHLSLEKLAILKQRIEACSPKEMIIALDATLEGDATALFLKQEFSYLPIKISRLALGMPVGLSFDFVDANTLARAFSGRNCF

SEQ ID NO: 205 - protein, 345 aa, Chlamydia trachomatis
LVFSFCLRVRVKKDVRASIWGTGSYLPKKILTNADLEKIVETSDEWISTRTGIKERRIASAEEFSSFMGAKAAEKAIEAAKISKSQVDCIVFSTAAPDYIFPSSAALAQAYLGIKEIPAFDCLAACTGFLYGLSIAKAYVESGMYQCVLVIAADKLSSFVASNYQDRNTCVLFGDGGSACIVGHSRPGALEISKVNLGADGKQGDLLRLPAGGSRCPASQDTVQNHQHFITMEGKEVFKHAVARGRMEFAAKTCITEAGLQEKDIDWLVPHQANERIIDAIAKRFAVKDSRVFKTLAKYGNTAASSVGIALDELLRTHDIHVAERLLLVAFGGGLSWGAVILQQV

SEQ ID NO: 206 - protein, 309 aa, Chlamydia trachomatis
  VARIANT (1)...(309): Xaa = Any Amino Acid
VMDRVGLLFPGQGSQFVGMGRDLYQQSSEVARLFSQADEFLGFSLSSIMFEGPEEVLLKTSNSQLAIYLHSLAVLEVLSTHCPFEPILVSGLSLGEYTALTASKRISLEDGLRIVQKRAELMNAACEESSGAMAAVLGLTADVVLPALESLGEGIWVANYNAPKQIVIAGIRNKVEEASVILRELGAKKVVMLKVAGAFHTPLMQTAQDELAPYLYQLAIKDSNVAFASNVIGELVYESEAIRSLXVRQMTSPTLWYQTCFQIDPKVDLFLELGPGNVLTGLSRSIGLSSPCKHLGSMEDIENFCRXCE

SEQ ID NO: 207 - protein, 250 aa, Chlamydia trachomatis
  VARIANT (1)...(250): Xaa = Any Amino Acid
MXGLLVNKTAIVTGGSRGIGFSIAKLFAEQGANVQIWGINGEAGQAAAQTLSEQTGRQVSFALVASPVSKNDMVSAQVQNFLSEYNTIDVIVNNAGITRDALLMRMSEEEWSSVINTNLGSIYNVCSAVIRPMIKARSGAIINISSIVGLRGSPGQTNYAAAKAGIIGFSKALSKEVGSKNIRVNCIAPGFIDTDMTKSLNDNLKNEWLKGVPLGRVGMPEEIAKAALFLXSDGSSYITGQVLSVDGGMA

SEQ ID NO: 208 - protein, 77 aa, Chlamydia trachomatis
MSLEDDVKAIIVDQLGVSPEDVKVDSSFIEDLNADSLDLTELIMTLEEKFAFEISEDDAEQLRTVGDVIKYIQEHQN

SEQ ID NO: 209 - protein, 150 aa, Chlamydia trachomatis
  VARIANT (1)...(150): Xaa = Any Amino Acid
LVPSFKSLVGGTSLNLIDKAFLLKKTXLFASLDMDVLLSIADKSEVMLFKAGSEIFSEGQPSFSLYVIAEGCVRIFAKEPTINVRLKPLDCFGEESFFNNKVREYSAEAITLVKTLILNKGQFLSIIEECPSVSLVLLEFYSKQIVFRDQ

SEQ ID NO: 210 - protein, 535 aa, Chlamydia trachomatis
  VARIANT (1)...(535): Xaa = Any Amino Acid
NLLLSCGDVHLRTTMFIHPAPIRTLYYHFRRVYSFSNIXRTHYSKAILRNLSLESIHRRRSIREWFADMNDTEKRQAEILSVTHLKNPQERNQMFAFQHLLNLKNRAVLPNLLLHMNKLGLSGKLKTLNMLKNSVWAKDFLTLELLKRWSSLPQHPTIAAALHLYFVEHDFLYVSDIADDLYDQSGDRLFTAVLIVRKHKPGGEYQALAEKHLSEILESEDPELIIKGLSILALERSPSNFPIILPFLTHPNEQVFLQACLSLETCADKQYAQYGRTVLNTLKKTKDTQAAQALLNTLAALLDASLVYEFVLASVQLKSVLRKLAETIDASLPKECIPILIEMVADHSLHNSCRIMAAKALSHIDSRQLKRLALKILKSKAAKALFYDYHKNFIQKRYPRYDLHLLIESLEANYQAEVNFMLAFLAIVGSSDYADVLIRSLTGKNLKARAQALESLEKDCENHLFTLVTPFVYRDKHTSDEKYYMKKGVEPLAIEELLNRLEQTPFLFSKLIAQQLKEGAFSLRCRVLFCSTKLC

SEQ ID NO: 211 - protein, 420 aa, Chlamydia trachomatis
  VARIANT (1)...(420): Xaa = Any Amino Acid
LKLTIKSISMLLFCKGSGSLRALRFLLSLRRGEEKRALLFLLLGLIWSVACYGSLALGESXFLEEIGAEKLPFAYLGASFFLCFISCLILYNLSRKRVSPKALFLSFISCVLICNLYLFWHLAIHKGVSGTPTFLYRILIWGLTILCYANFWGFIDQFFNIQDAKRHFCIFNAITFCGDFLGARIVNQIQYLGAELILLAFIVVITFIFPLVHYISSSLKELSEDHDLFLDTGYPPSTKQTLKLCLKDKYTFYLVSFYFLMQLLVVFTEFNYLKIFDAQFGNAETCELTENFTKYSSWISLGNMFFALFAYSRVITRFGINNIILFAPICFFSLFCCWSIKTSVFIATMGMIAREGLAYALDDNNLQLLIYGIPNKIRNQVRIAIESFVELRGCSSAHYYVYSSRTNTYSVLSFPPCVFF

SEQ ID NO: 212 - protein, 181 aa, Chlamydia trachomatis
GNVMTYSMSDIAHKFDISNPTSPAPSRKRGSFPPQSPSAVGSLEGANFSTWGPGPFFTVPVYPQQLAAMQNNLFTLQTEVSALKKKLVQSSQTRGSLGLGPQFLAACLVAATILAVAVIVLASLGLGGVLPFVLVCLAGSTNAIWAIVSASITTLICCVSIACIFLAKCDKGSDPQTLYVS

SEQ ID NO: 213 - protein, 130 aa, Chlamydia trachomatis
FTEGNMVHSVYNSLAPEGFSQVSIQPSQIPTSKKVMIAIMTLFALTAIAAIVLSIVTVCGGFPFLLAALNTVTIGACVSLPIFTCIATTLLLLCLRNIELLGQTASIDPLHSIQPNKTSRNRVVAQQKMS

SEQ ID NO: 214 - protein, 490 aa, Chlamydia trachomatis
MNKKNTVFSSRLGFILSMMGVAIGAGNIWRFPRMVAQNGGGTFILLWLLFLIIWSIPLIIVELSIGKLTRKAPIGALIRTAGPKSAWLGGFIVLVATCILGYYSNIVGWGFSYFFYSLSGKIVPGNHFPQLWAHHCQSWMPLSCHCLALFLAYCIIRKGIVNGIETCNKILIPFFFICALVLLARAVSLPHAWEGIRLLFVFNKASLCDYKVWIEALTQNAWDTGAGWGLLLVYAGFASKQTSLVTNGAITAITNNFISFLMAVIVFSACASLDSTEMLGLREGVGASNIGMAFIYLPELFTRLPHAHILSTFFSAIFFLAFSMAALSSMISMLFLLSQTLTEFGIKKHIAESSATIAAFLIGVPSALNLQFFDNQDIVWGIALILNGMIFIYSALSYGIKRLRQDVINSVPGDYKLKTYFDMLVKFLLPLEGVLLLAWYFYEGAMLPQAYWWNPFVSYNISSLLMQWGLGGGVLFLLNRKLYTKFYLNN

SEQ ID NO: 215 - protein, 342 aa, Chlamydia trachomatis
KSMVSVVRSSLYYTLLTTLISAAIALVLFIFIKPSVPLSGFNAATETNATGYLSVLSKTIPGNILEPFLESNVIAAAFLSALLATFSLSLPENERLFVRNAFNTLFSLLLSISKGILKMLPLATFAFSLLFVREMRTGNLELSSFGEYLFCIVTANCLQGFLVLPLLLKMKGISPLRTFKLMSRPLATAFFSKSSAVTLPLTMEVAEENLHIRPTISRFVFPLCSVINMNACAAFILTTVLFVGVSNGIVFSPLSLISWVFIATLAAVGNAGVPMGCYFLTSSLLASMNVPLGLLGLILPAYALLDMLETLINVWSDCCIVSVINKKFSETEDLPPCSYTNE

SEQ ID NO: 216 - protein, 118 aa, Chlamydia trachomatis
HPIGTPAFPTAAKVAIKTQLISDKGEKTIPLETPTNSTVVRMNAAQAFILITEHRGKTKREIVGRMCKFSSATSMVKGRVTAEDLEKNAVARGRDMSLNVRKGEIPFILRRRGRTRNP

SEQ ID NO: 217 - protein, 113 aa, Chlamydia trachomatis
MSCSNVNSGAPATLFAKGAAAISSRVDTMRQMCSARVGSKTCGIALIIIGLLVATAGVVIAAVGIGTPASLAAGMILVMVGSLLLGLGLARARSRRVEIERQLEVVSMQIEEL

SEQ ID NO: 218 - protein, 105 aa, Chlamydia trachomatis
RSFEEEYKALSEVYRANLEARRAVSKYCQELEEKILDLCKRHAATICSIEEDAKQEIRHQTERFKQRLQQNQNTCSQITAELCKLRSENKALSERLQVQASRRKK

SEQ ID NO: 219 - protein, 190 aa, Chlamydia trachomatis
RRRFFFTVANSFLRRDKIYFVFNKREYLFQNFGYSFSYRRRFSCCRWGISFGFVRYNVIFTVIGIPALIIGSACVGAGISRLMYRSSYASLEAKNVLAEQRLRNLSEEKDALASVSFINKMFLRGLTDDLQALEAKVMEFEIDCLDRLEKNEQALLSDVRLVLSSYTRWLDSAEKEKAALKASIDANQAS

SEQ ID NO: 220 - protein, 182 aa, Chlamydia trachomatis
TEPCFRILFYTLVSRDERRVKVFYVKNICVFLPSRVLSRPFFGPESTMSYLFCSSCAPTLESPAELCLYKTHIYCKRRGNIEFAVSLGIFAILSCVALALLCLLCRGSSLVFAGLGIGAIMIGSVALGVGLTFLYWSCSRGLQNRIRTNILASSDSSSLSSSKSDFSLEFELNEADVTISVS

SEQ ID NO: 221 - protein, 194 aa, Chlamydia trachomatis
LPLKYIKIFTLISFPVALACRPFLRNRGAMFNISFCCNSSKPLRADHTETIGAQTTTSRKEQLLAIGALVLGVLAVLGGALLLLFSGSVLSLFAPILSLLAMTLGSACIGGSLVYMYGFSLKPTRLPSESSGLAPEAVTPGLVLSYQELLYEAEEDLKEVEGLLAQKSKDLELAQKKIEQLQSGLKCVLEESLR

SEQ ID NO: 222 - protein, 135 aa, Chlamydia trachomatis
GIVVQQKLRYSENVANNSFIHRSKRYQLFVVVLTSLLAALGGVFLCLGGVYSSLVLGVVGGAAIIGSCIGAFGLVSYLLSVIRNSDQLLQEAKESDRKISSHYRVLETQKNREIGLLEERVNMLDGFYAKFHGWD

SEQ ID NO: 223 - protein, 164 aa, Chlamydia trachomatis
RKASLLITDLFYLKWDAMSFVGDSVPLRSYMPEAPLVDSASKARVSCCSERIAVLALGILSILFIVTGAALFIGAGWTTLPMINVVVTLVVFGSVMLGAVLTRISGYGGEPKKVSLDRFVLENERQGFLDKQRLADISKEEIALAKQQIEEEKEAILHSIFPND

SEQ ID NO: 224 - protein, 273 aa, Chlamydia trachomatis
RKGGKMVSLALGTSNRVEANNGINDLSPAPEAKKTGFGLCYKISAVAALVLGLLAAAGGAVVLALFCTFTPPLFFYAGVALVALGAVILGVGVSNTCSCCLRSKRIEAREQLLLQQKEEISQLEQQLAKALGELDTKCASLLERRDLRENLKAWQAYCLNLEEDVRDLLKKLEGYQERLKVLPAKEKQIEELKAMLEHYSRICYERGDLIRMLKTANKKLSKECEKLLLNYKAHLDVCLGEKVLAKSVNLIDLDLKSDSSDGDDYDFNYGSRV

SEQ ID NO: 225 - protein, 132 aa, Chlamydia trachomatis
LRSDMRCCCVRTNCEEVRSSSTGDQVVSAVKERKCDSSLRRKIASVAFTLIGALLLGIGMVLSFALLGSSAGLIGVGVLSALGAVCLSLGLYKLFLRMKRVSLDKAEQKMLEDQVELLRQENQELKAISVFH

SEQ ID NO: 226 - protein, 298 aa, Chlamydia trachomatis
MAHTIRFTKFSFPLYFSKTLSWFIIGGFLAACVVHMILAPNDLIDGGIVGLSMIAAHSFGHQFLPVFLVLFNLPFIILAYKRIGKYFVVQMITAVIIFSCWLWLIEVLPEWLGIQPFIFDGSEIETIVLGGVVLGAGGGLIIRHGGATDGTEILGIIVNKKRGYTVGQVILFVNFFIFSLGGIVYRNWHTAFMSLLTYAVAIKVMDMVILGFEDTKSVTIITSSPRKLGNILMETLGVGLTYLHAEGGFSGEPRNLLYIVVERLQLSQLKEIVHREDPSAFIAIENLHEVINEKRTSH

SEQ ID NO: 227 - protein, 194 aa, Chlamydia trachomatis
  VARIANT (1)...(194): Xaa = Any Amino Acid
MKRYVVGISGASGIXLAVTLVSELARLGHHIDVIISPSAQKTLYYELDTKSFLSTIPQNFHNQIVLHHISSIESSVSSGSNTVDATIIVPCSVATVALAAISCGLADNLLRRVADVALKEKRPLILVPREAPLSAIHLENLLKLAQNGAVILPPMPIWYFKPQTAEDISNDIVGKILAILQLDSPLIKRWENPR

SEQ ID NO: 228 - protein, 72 aa, Chlamydia trachomatis
KFSKCIADRGASRGTRIRGLFSFRATSATLLKRLSAKPHEIAATVATLQGTIIVASTVFEPDDTELSIEDIW

SEQ ID NO: 229 - protein, 302 aa, Chlamydia trachomatis
  VARIANT (1)...(302): Xaa = Any Amino Acid
MSRIVLIQQLIKCKYALFAALFLASSTLFCFSLPCTPFSLFSLGSIKTISLGGSAFFIARALGMIVNQVVDCAIDKRNPRTQSRVLPAELLSIKHSMLLLTLCLILFLSTCWLFNPLCFSLAVLSTLIMIIYPYTKRFTFLCHWILGLVYYLAILMNFFAIIETPSFSLFCMSSLLGISFGMIIAANDIIYALQDVEFDQKEGLFSIPARFGTKQAITIASANLIXSAIAYLLIGYFVPNKTIFYLCSLVPLTGILRTIKHYSLIDPRAKSTLQQNFFLGNLSLGIAFFANMIGLFLLRGIL

SEQ ID NO: 230 - protein, 177 aa, Chlamydia trachomatis
WEKFRTLPLLLCHCRSYKRSESPWNSCDSLSQSENIAFFQEAHMASLIRSLCEFTVAYKHTDPLGLNVNFPASADDSPWKGIRFTLSGNEFLFGIPRLVRTEGNRRYYTLYDMRDKVSEEFSEEYLALANNYISAAPLVSKNTPRATLSEEELAFLKDSFEQSVLWKASLNLEEDLA

SEQ ID NO: 231 - protein, 162 aa, Chlamydia trachomatis
MRNEKYKRGLMTETRRLRILITNDDGIKAKGISLLISLLREADFADLYVVAPLEEQSGRSMAFSLVEPTALEPFDYPQRVQEAWAVTGTPVDCVKLAIGELFKENALDLILSGINNGKNSGRCLYYSATVGAIREANLHGIPAIVFLKVRISLFSKKLIWPP

SEQ ID NO: 232 - protein, 236 aa, Chlamydia trachomatis
KFSAQSVYTHAMLQKHTRIAVALSGGKDSLSLLLMLKAISGRGFPELTIHAIHIGGKYSCGAAVSGNYLSSICDKIQVPLISIPSPYETENPECYTCSRIRRRLLFDTAKAVGATAVAFGHHRDDVVQTTLMNLLHKAEFAGMLPVVDMVNFGITILRPLIFIPEDLIRKFAKESGFARITCRCPVISLRTKTEEALKTLETIFPQARHNIALAVRETGLSKANRVEQYDSLLTET

SEQ ID NO: 233 - protein, 465 aa, Chlamydia trachomatis
ASSQIFYPIGYFYCRDVIPCSSYQFTKPSFNSKTWLIYSILLSVAVACFMIPYALIAAELASFKPQGIYVWTRDALGKRWGFFAIWMQWFHNMTWYPAMLAFIASTLVYQISPDLANNRLYLSSVILLGFWGLTFFNFLGIGTSALFSSICVIVGTLIPGAILVAFAAYWIQGGNPIAINFSWSELLPDFSSPSSFVLLSGMLLALCGLEANANLASDMEDPKRNYPKAVFIGAVSTLAILVLGSLAIAIVIPKEEISLVSGLIRAFSLFFEKYNLSWMTGIIVAMTIAGSLGELNAWMFAGTKGLFISTQNDCLPKIFKKTNSRDVPTNLMLFQAIVVTLFTFIFVYVDSADLAYWILSALSLQMYLVMYICLFIVGPVLRIKEPKAQRLYSVPGKLVGMCVLSTLGILSCLFALGISFLPPQEVVSFSTMGGNFGYTALLLLAFVINCCIPFGMYYSHKKLIK

SEQ ID NO: 234 - protein, 310 aa, Chlamydia trachomatis
EHLRMTTIFDLLGKDADYLLNHKCVIKKEALTLPSGDFVSRVFAESDRNNRVLRSLQQMFSYGRLGGTGYLSILPVDQGVEHTAGASFAKNPMYFDPENIVRLAMEAGCSAVALASSYGVLSILARRYAHKIPFLLKLNHNELLSYPTTYHQIFFSQVEDAYNMGAVAVGATIYFGSESSSEEIVAVAEAFARARELGLATVLWCYLRNPHFVVNNVDYHTAADLTGQADHLGATLGADIVKQKLPTLQGGFKTINFSKTDDLVYSELSSNHPIDLCRYQVLNSYCGKVGLINSGALLGKMTLLKQLKQQ

SEQ ID NO: 235 - protein, 555 aa, Chlamydia trachomatis
  VARIANT (1)...(555): Xaa = Any Amino Acid
KEKIVFMRTDSPLNPPDSTRGVFQFLETQCDRAMARSRQSQFIGLVSAVAAAALLLLLVVALSVPGFPVAASIVVGVLFALSIVALTASFLVYIANAKLVAIRIKFLSSGLQDHFSESPILGTLRKGRGASIPLISGQADDSLPNRIGIKKSAEMRVLQKGIGTDYKKYKQHLDRVASNNDFTFVCEGISALIPTEKDAPFPIEPSHLAGVFLVSFSPDKNPILKITRHAEKMLQPPQGGFPNGLVWLCGALSDPKKFAAPFLSLIEKTHQGILVSKDLKDNKERKLALEASLLSLNIFFSGWCLGNPEYNQYITTAVAEKYKDVSVRNRIYDFLDTGNVISALALASXYSQDSAWAAGLQKVLREEDKKTKKKSREEVSCLYRDIDPGCCLRALPKRFESKSSGSQGSPKEQLSSLLKALDQKIPSGVLGLIAKASSADLKADFAGMLEVIKQLQALFDSYPPLCEDNILLWLSASLEQVGLQKKLRTFLPSSEKKLLERVLSTFLLGLYTRGVFSVGQVNQLATICNTQDSTEFCQRVSDLSLIKRALPALFG

SEQ ID NO: 236 - protein, 257 aa, Chlamydia trachomatis
LRNRSPPFLDSFERFMSKQPENSFSSDKFFPIKQKLALEAVALVEPGMCVGLGSGSTAREFILALGDRVRTERLVITAVASSRISQLLAEAVGIPLLDHSLLQDVDLVVDGADEVDPCLRMIKGGGGALFREKILLQSGKRNVILVDERKLVPTLGKFSLPIEIAPFGCSSVQRILNKQGYFGEWRETSAGERFITDNGNYIYDVRTPDSYANPEEDMIRLLQIRGIIDVGFVIAKAEVWVGYADGSIVRKKEHNEY

SEQ ID NO: 237 - protein, 155 aa, Chlamydia trachomatis
LSEKKNIMNIDREIISDTSLILINFYKLVSFRNYAGIILGTDEKQFAIYGHASMDTAFKKREDLAAEEERSRPSTHDVLNFVLTSFDLSVVRVVITEYKDNVFYSRLFLEQKRGDRLYIADIDARPSDSIPLAIKYQVPILCVKSIFDEAIPYED

SEQ ID NO: 238 - protein, 191 aa, Chlamydia trachomatis
DVMTKLPYALLDKGSLLVASPDVNGGIFSRSVVLLCEHSPNGSFGLILNKILEIDSPEEIFPLDHFDESKVRFCMGGPLQANQIMLLHTSPDSANSSIEICPSVFLGGDFSFAGEKEGRTRDDKMLLCFGYSGWQGGQLEKEFLEGLWFLAPSSQEIIFTDAPERMWSDVLQHLGGRFASLSTIPENLLLN

SEQ ID NO: 239 - protein, 358 aa, Chlamydia trachomatis
LLFLRFSLLTTALHLERNKRQTYTMSEIEIKSSPVCESIIFFLMRSWYTLPFPQSLQRSLLMSHLFSKACQYFPGGVNSPVRACRAVNITPPIVARASKEVFIDSLDKTFIDFCGSWGSLIHGHSHPKICAAIRQGLERGSSYGLTSEQEILFAEEIFSYLGLETNYKIRFMSTGSEATMTAVRLARGITGRPIIIKFLGCYHGHADTFLQEKPFSHTSLDTLDLAHPLTLSLPFNDFPLFQTVMNSLGHKVAGVIFEPVCANMGVILPVPDFIEGVIQTCQQTGSFSIMDEVVTGFRVAQGGAAALYHVKPDILVFGKILGGGLPASAVVAPKDIMDHLAPEEKSSKLEHFQEILWL

SEQ ID NO: 240 - protein, 634 aa, Chlamydia trachomatis
MRYDPGLIEEKWQKFWKNEQVFKAEEDETKTKYYVLDMFPYPSGAGLHVGHLIGYTATDIVARCKRAQGFSVLHPMGWDSFGLPAEQYAIRTGTHPRETTEKNIANFKKQLTAMGFSYDESREFATSDPEYYKWTQKLFLILYEKGLAYMADMAVNYCPELGTVLSNEEIENGFSVASPGGYPVERRMLRQWVLRITAFADQLLEGLDELDWPESVKQLQKNWIGKSSGASVNFATEHGAIEVFTTRPDTLIGVSFLALAPEHPLVDLLTSDEQKAVVAQYIKETQSKSERDRISEMKTKSGVFTGSYAKHPVTHELIPIWIADYVLMGFGSGAVMGVPAHDERDLLFAEQFNLPVVSVLNEEGVCINSCCEGFHLDGLSGEEAKQYVINFLEENHLGAAKIAYKLRDWLFSRQRYWGEPIPIIHFEDGSCRPLRDDELPLLPPEIQDYRPEGVGQGPLAKVREWVQVFDTETQRAGKRETHTMPQWAGSCWYYLRFCDAHNSAAPWAKEKEQYWMPVDLYIGGAEHAVLHLLYARFWHQVFYEAGIVSTPEPFKKLVNQGLVLATSYRIPGKGYIYPETAKEENGKWVAPSGEELDVRQEKMSKSKLNGVDPQILIDEFGLTLFGCTQCFQGL

SEQ ID NO: 241 - protein, 202 aa, Chlamydia trachomatis
IWTDAVRMYAMFSGPLDKNKLWSNQGVAGCRRFLNRFYEMVSSDRVKEDNNFEGLSLAHKLVQRVTDAIEKLSLNTIPSSFMEFINDFVKLAVYPKSAVEMAVRALAPIAPHISEELWVLLGNSPGVQKSGWPSVLPEYLEEQTVTIVVQVNGKLRARLDIMKDASKEEVLALARESASKYLEGCEVKKAIFVPARLVNFVV

SEQ ID NO: 242 - protein, 431 aa, Chlamydia trachomatis
MIRRWLTSRLYDAFLVCAFFVSAPRIFYKVFFHGKYIDSWKIRFGVQKPFVKGEGPLVWFHGASVGEVSLLAPLLNRWREEFPEWRFVVTTCSEAGVHTARRLYESLGATVFVLPLDLSCIIKSVVRKLAPDIVIFSEGDCWLHFLTESKRLGAKAFLINGKLSEHSCKRFSFLKRLGRNYFAPLDLLILQDELYKQRFMQIGISSDKIHVTGNMKTFIESSLATNRRDFWRAKLQISSQDRLIVLGSMHPKDVEVWAEVVSHFHNSSTKILWVPRHLEKLKEHAKLLEKAGILFGLWSQGASFRQYNSLIMDAMGVLKDIYSAADIAFVGGTFDPSVGGHNLLEPLQKEAPLMFGPYIYSQSVLAERLREKEAGLSVNKETLLDVVTDLLQNEKNRQAYIEKGKSFLKQEENSFQQTWEILKSQITCMKI

SEQ ID NO: 243 - protein, 570 aa, Chlamydia trachomatis
LHILRSFSRPCRLAKTSIIGHTMELLSVNKSYFELQRLHYRPDTLSLLNSLCSMHIQEKPSSEPASDLLAKHIPHLCALPDLTLQKDAPSSSEPLRIGVLLSGGQAPGGHNVVIGLFEGLRAFNKETKLFGFIKGPLGLIRGLYKDLDISVIYDYYNAGGFDMLSSSREKIKTKEQKSAILATVKKMKLHGLLIVGGDNSNTDTAMLAEYFIEHNCPTAVIGVPKTIDGDLKNAWIETPLGFHTSCRTYSEMIGNLEKDVLSTRKYHHFVKLMGEQASHSTLECGLQTLPNITLIGEEVAVQHASLQSLSLSIAQGLIERFHRGKDYSTILIPEGLIKQIPDTKRLIQELNTLIAEEQFSVHNLDQQLSPMAIETFSSLPENIRDQLLLDRDSYGNIRVSKIAIEELLASLVSKEISKLEPTMSFSPVTHFLGYESRASFPSNFDSNYGLALGIAASLFLVRGKTGYMVTIGNLAETYTEWTIAATPLYKMMHLEKRFNQETPVIKTDSVSPDAPMAKYLHKMKEICLLEDSYRFPGPLQYFEEQALVDQRPLTLLWEKGKLSENNATKF

SEQ ID NO: 244 - protein, 304 aa, Chlamydia trachomatis
MAKTLFYLFRNPRSGLLTISMDITKELPFIMMQQPHYFPHSKKIFEIPLLDNVTSLGVLHIPHSQEKTFPLVIVLHGLASSKIGTKRSYLHLANQLVQEGIGVLRVDLPGHGDSEGFIHEFSLTDYIQASQKIIQFGLSLPQANHSVALFGSSLGGSLSLLNLPYFPEIQHAAIWTPTIQGALWLEDTMQSMSPSLQLPPDNFSYQGIPLGKKFCSQFIELDTVASPALSKITQEVSILYLQGEDDAVVSLRHQALFAKTFTGKASYRTYPKMTHQLCIYSEAFQDLVDWLKHQLLGTPWSYSL

SEQ ID NO: 245 - protein, 561 aa, Chlamydia trachomatis
  VARIANT (1)...(561): Xaa = Any Amino Acid
ANVFEQKLMSSNKHASLCQKTPSLCRELQKAPALLLTEDIRFKALLNERIDSVAELFPCTYNSPYYKFISKSDLSAETFPLKVGVMLSGGPAPGGHNVILGLLHSIKKLHPDSQLLGFIRNGEGLLNNNTVEITDEFIEEFRNSGGFNCIGTGRTNIITEENKARCLQTANELDLDGLVIIGGDGSNTATAILAEYFAKHQAKTVLVGVPKTIDGDLQHLFLDLTFGFDTATKFYSSIISNISRDALSCKGHYHFIKLMGRSSSHITLECALQTHPNIALIGEEIAEKSISLETLIHDICEIIADRAAMGKYHGVILIPEGVIEFIPEIQSLVKEIESIPEQENLYQALSLSSQQLLCQFPEDICHQLLYNRDAHGNVYVSKISVDKLLIHLVRQHLETHFRQVPFNXSAHFLGYEGRSGTPTHFDNVYSYNLGYGAGVLVFNRCNGYLSTIEGLTSPIEKWRLRALPIVRMLTTKQGKDSKHYPLIKKRLVDIASPVFNKFSLYRKIWALEDSYRFVGPLQIHSPEDAHSDDFPPLILFLNHNEWQKRCSICLEIPDQDY

SEQ ID NO: 246 - protein, 473 aa, Chlamydia trachomatis
GAMNKHKRFLSLVLLTFILLGIWFCPHSDLIDSKAWHLFAIFTTTIIGIIVQPAPMGAIVIMGISLLLVTKTLTLDQALSGFHSPIAWLVFLSFSIAKGVIKTGLGERVAYFFVKILGKSPLGLSYGLVLTDFLLAPAIPSLTARAGGILFPVVMGLSESFGSSVEKGTEKLLGSFLIKVAYQSSVITSAMFLTAMAGNPIISALASHSGVTLTWAIWAKAAILPGIISLACMPFVLFKLFPPQITSCEEAVATAKTRLKEMGPLNQGERIILLIFSLLISLWTFGDSIGISATTTTFIGLSLLILTNILDWQKDVLSNTTAWETFVWFGALIMMASFLSAFGFIHFVGDSVIGSVQGLSWKIGFPILFLIYFYSHYLFASNTAHIAAMYPIFLTVSISLGANPMFAALALAFASNLFGGLTHYGSGPAPLYFGSHFVSVQEWWRSGFILSIVNLTIWLGLGSWWWYCLGLIR

SEQ ID NO: 247 - protein, 318 aa, Chlamydia trachomatis
CGLDSPYLLRLRAPWSLLATACSFSESPSFRERLEGLHSYRVVDRRFLACYDQETIDYSQIFRTGVTLTMEISHILEDLVYDNGVLPREAIEAAIVKHHQITPYLLKILEEGIDHVSDIIDDDCYQGHLYAMYLLAQFRETRALPLIIKLFSFEQDIPHAIAGDVLTEDLSRILASVCDDVALIQELIETPHVNPYVQAAAISSLVALVGVHKLSRETAIRYFGELLNYRLEKKPSFAWDSLVASICALYPKELFYPISKAFSAGLIDTSFISMEDVETIIHEESIDSCLKEVFSSTDLINDTLEEMEKWLERFPFES

SEQ ID NO: 248 - protein, 249 aa, Chlamydia trachomatis
  VARIANT (1)...(249): Xaa = Any Amino Acid
LAMSTLVSIKDLSLTIRKQPILRNVHLEICRGECLTIVGASGSGKTSLALAILGLLPPDAQDSIDFHLPPKTPRTKAVQMIWQDVYSSLNPMMTIQEIIAEPLHIMGGLSKSXQQEEIAHALKLVHLPKSFLSLRPIKLSGGQRQRIAIAKALVCKPELIICDEPLSALDTMNQKLILDLFQTIKNQYNNAFLFITHDMSAAYTLADKIAVMDRGYLVEIASKQEIFSSPKHIKTRELLDAIPAFTFSF

SEQ ID NO: 249 - protein, 281 aa, Chlamydia trachomatis
RKIPLSEDLLKIDNLVVSVKNSNQRLVNHLSLTIKRCQSMALVGENGSGKTTVSKAVLGFLPDNCYIQSGRILYSSTDITRLSRRQLQTIRGKKIATIFQNAMGTLTPSMRVGAQIVETLRHHFDMSKEEAFSKARELLESVHIESPDRCLQLYPFELSGGMCQRVSIAIALATNPELIIADEPSTALDSISQAQVLRVLTQIHQNHSTALLLITHNLALVSELCEEMAIIRYGEIVEQGPVQELLHSPSHPYTQQLIRAIPRIPSPSYLSPTEPLATTAY

SEQ ID NO: 250 - protein, 284 aa, Chlamydia trachomatis
  VARIANT (1)...(284): Xaa = Any Amino Acid
NKLMFRSSSSHTWRYIRTNKMLVLGCLTLAVLVLAATFLPYLYPDYERTFPEHALQSPSKAFPFGTDNLGRCMLARTLQGIRLSLLIAVSATIIDVCLGLLWSTLALASGKKVADIMSRITEILFSIPRIPVIILLLVIFNHGILPLILAMTITGWIPIARIIYGQFLLLENKEFVLSARALQASTFHILRKHLLPNSLGPIISTLIFTIPNAVYTEAFISFLGLGXQPPYASLGTLVKEGIHSLAYHPWLFFIPSFFMIIVSVSFNCIGEGLQTKLLEENTLV

SEQ ID NO: 251 - protein, 206 aa, Chlamydia trachomatis
  VARIANT (1)...(206): Xaa = Any Amino Acid
MLSYIKRRLLFNLLSLWVVVTLTFFIIKTIPGDPFNDENGNILSPETLALLKNRYGLDKPLFTQYLIYLKCLLTLDFGESLIYKDRTVISIIAAALPSSAILGLESLCLSLFGGITLGILAAFYKKSCGRTIFFSSVIQISVPAFVIGAFLQYVFAIKYSCLPIACWGNFSHTLLPSIALAITPMAFITQLTYASVSANLKKXTSY

SEQ ID NO: 252 - protein, 214 aa, Chlamydia trachomatis
  VARIANT (1)...(214): Xaa = Any Amino Acid
TKKLLPPWLLXXPAKHLLPAHLHTYPEQPSYKQQEAITLAKSLLEEALTELNMTIKDLEKYPLTFSATSTVNSQIAQMLRDQWRRSLGITFPICGKEYALLQNDLIGNTFFMSIGGWFADFSDPLAFLSIFSSKGVKPYALQDPQFDQLILSIETEKNPQKRSALISEASLYIERQNVIEPLYHDVFHYTTNNKLSFVRLHPSGLVDMRYAKNS

SEQ ID NO: 253 - protein, 339 aa, Chlamydia trachomatis
  VARIANT (1)...(339): Xaa = Any Amino Acid
GGHSMRKISVGICLLLALATSGCSKSSSNATHRSPATHTVAVSVKDDPRTFDPREVRLLSDINLIHHLYEGLVQETPSGEVFPALAESFFLSEDKKTYTFNLKKAFWSNGDLITAHDFVRSWNDVLQNRVASIYSFAFLPIDVNKDSGFFAKDDHTLVINLLTPTPHFLKLLTLPVFYPVHSQHQIWKEEKSLPISTGAFFLKEKKDRRWLKLEKSPYYYNKDQVAVQEICIHIIPDQQTASALFNQGKLDWQGLPWGHSIPQETLATANKRRAPQSFDISGTSWLTFNTAKKPFSHSKLRQALSLVLNKEALASLAFVXXCKTSPSCTFAHLPRAAFL

SEQ ID NO: 254 - protein, 341 aa, Chlamydia trachomatis
VFAMLTLGLESSCDETSCSLVQNGKILANKIASQDIHASYGGVIPELASRAHLQTFPELLTAATQSAGVSLEDIELISVANTPGLIGALSIGVNFAKGLASGLKRPLIGVNHVEAHLYAACMEAPATQFPALGLAISGAHTSLFLMPDATTFLLIGKTRDDAIGETFDKVARFLGLPYPGGQKLEELAREGDADAFAFSPARVSGYDFSFSGLKTAVLYALKGNNSSAKAPFPEVSETQKRNIAASFQKAVFMTIAQKLPDIVKAFSCESLIVGGGVANNSYFRRLLNQICSLPIYFPSSQLCSDNAAMIAGLGERLFCNRTHVSKEVIPCARYQWESACS

SEQ ID NO: 255 - protein, 522 aa, Chlamydia trachomatis
  VARIANT (1)...(522): Xaa = Any Amino Acid
MXXXRRAWKEXNXNEEKLDVALTSGNLMDSKTSHLDDELCFKLEEAFDTLTAGEHSQDLTSIVSVYNPIDLAYAVSCLPSDSRSILYKNLDSIASKIAFIINTDSASRWAIFRNLSDGEICALIEQMPPDEAIWVLDDIPDRRYRRILDLIDVKKALKIRDLQKHGRNTAGRLMTNEFFAFLMETTVKEVATCIRNNPGIDLTRLVFVLDFKGELQGFVTDRSLIIASPEMPLKQIMRPIEHKVLADTTREEVVDLVERYKVAVLPVVDEENFLIGAITYEDVVETIEDIADETIARMAGTTEDVGYHDCHVVQRFLLRAPWLLITLCAGLVSASVMAYFQKIAPTLLAMVIFFIPLVNGLSGNVGVQCSTILVRSMATGTLSFGRRRETILKEMSIGLLTGVALGILCGLVVCCMGCLGLGLFATGGVQLGVTVSVGILGASLTATTLGVLSPFFFAKIGVDPALASGPIVTALNDIVSMVIFLLITGTLNVLFLQIVGESEDKGFLRAFFTMSFLPLSLE

SEQ ID NO: 256 - protein, 361 aa, Chlamydia trachomatis
RSGFVALRFEILHQSKKSRARVGRIETAHGYIDTPAFVPVATNGALKGVLDHSNIPLMFCNTYHLIVHPGAEAIAAMGGLHQFIGRNAPIITDSGGFQIFSLAYGSVAEEIKSCGKKKGGNTIIKVNDDGVHFKSYRDGRKLFLSPEISVQAQKDLGADIILPLDELLPFHADPTYFHQSSQRTYVWEKRSLDYHLKNPGIQSMYGVIHGGTFPDQRKLGCKFVEDLPFDGSAIGGSLGKNLQDIVEVVGVTAANLSAERPRHLLGIGDLPSIWATVGFGIDSFDSSYPTKAARHGSGILTSQGPLKINNQRYSSDLNPIEPGCSCLACSQGITRAYLRHLFKVHEPNAGIWASIHNMHHM

SEQ ID NO: 257 - protein, 260 aa, Chlamydia trachomatis
DSFCVFIGFSIKPFAVYLFDLKKTGKEEFVQSVGQEASQNTLSWTIRPRIPSIIQGSKEVSLALFVLGTVLAIVGACAAAVGGAFSVCLGALFLGGVVLATGLLLAVLEFCHIRSSREKYVILTKQDLFKEPVIQEEQATPLIEEASYTCEPGIPLSGPEEVQQERPVILQKDLDLSHVPKYIAVGSHVVELVKAGKIGRNGELLLEEGIDTDQNFVRRAKEAGSIRQRREVVRLDGFCCKVLPKTSKSESINDLVSNDC

SEQ ID NO: 258 - protein, 136 aa, Chlamydia trachomatis
  VARIANT (1)...(136): Xaa = Any Amino Acid
EPSSXAFCEGRCACAYRRSVVSFYPQNLPSFRRRKPSRTDSPIKHAKHFLRDHLSHLRKILAGKPQEVIEAWYEILGKKYNGMTQAIGLKDGILSIKVRNASLYAVLKQSSQKELISRIHSAVPGAKVKEIRFLLG

SEQ ID NO: 259 - protein, 804 aa, Chlamydia trachomatis
  VARIANT (1)...(804): Xaa = Any Amino Acid
MDAQEKKYDASAITVLEGLQAVRERPGMYIGDTGVTGLHHLVYEVVDNSIDEAMAGFCTEVVVRILEDGGISISDNGRGIPIQIHEKESAKQGREISALEVVLTVLHAGGKFDKDSYKVSGGLXGVGVSCVNALSEKFIAKVFKDGQAYSMEFSRGAPLTTLQVLGPTDKRGTEVLFYPDPAIFSTCVFDRAILMKRLRELAFLNRGATIVFEDDRDTGFDKVVFFYEGGIQSFVSYLNQNKEILFPNPIYIQGSRPGDDGDIEFEAALQWNSGYSELIYSYANNIPTRQGGTHLTGFSTALTRAVNSYIKAHNLSKSDKLSLTGEDIKEGLVAIVSVKVPNPQFEGQTKQKLGNSDVGSVSQQISGEVLTTFFEENTQIAKTIVDKVFVAAQAREAAKRARELTFRKSALDSARLPGKLIDCLEKDPEKCEMYIVEGDSAGGSAKQGRDRRFQAILPIRGKILNVEKARLQKVFQNQEIGSIIAALGCGIGKDNFNLSKLRYKRIIIMTDADVDGSHIRTLLLTFFYRHMSALIENECVYIAQPPLYRVSKKKDFRYILSEKEMDGYLLNLGTKESQIVFDDTLRDLRGEALETFVNLILEVESFIVSLEKKAIPFSEFLDMFRDGAYPLYYYPPESGKQGGSYLYSHEEKEAAIAANEESASRILELYKGSVLEELQRDLGDYGYDIRNYLHPKGSGITVSTEDPKISPYVCYTLKEVIDYLKGLGRKGIEIQRYKGLGEMNADQLWDTTMNPEQRTLVRVSLKDAVEADHIFTMLMGEEVPPRREFIKSHALSIRMNNLDI

SEQ ID NO: 260 - protein, 836 aa, Chlamydia trachomatis
MLNKEEIIVPKNLEEEMKESYLRYSMSVIISRALPDARDGLKPSQRRILYAMKQLNLTPGVKHRKCAKICGDTSGDYHPHGESVIYPTLVRMAQDWAMRYPLVDGQGNFGSIDGDPAAAMRYTEARLTHSAIFLLEDLDKDTVDMVPNYDETKYEPVVFPSKFPNLLCNGSSGIAVGMATNIPPHNLGELIEATLLVLANSQTSIEDILEVMPGPDFPTGGIICGTEGIRSTYYTGRGKLRLRARMHVEENSDKQRENIILTEMPYNVNKSPLIEQIAELINEKTLTGISDVRDESDKDGNRVVLELKKGESSEVVINRLYKFTDVQVTFGANMLALDKNLPRTMNIHRMISAWIRHRMDVIRRRTRYELNKAEARAHILEGFLKALSCMDEVVKTIRESSNKEHAKQQLVELFSFSEAQALAILELRLYQLTGLEADKVQKEYSELLEKITYYRKVLAEEELVKDIIREELQELHKVHKTPRRTKIEMDTGDVRDIEDIISDESVIITISGDDYVKRMPVKVFREQKRGGQGVTGFDMKKGSDFLKAVYSASTKDYLLIFTNFGQCYWLKVWQLPEGERRAKGKPIINFLEGIRPGEQVAAVLNVKRFEQGEYLFLATKKGVVKKVSLDAFGSPRKKGIRALEIDDGDELIAARHIANDEEKVMLFTRLGMAVRFPHDKVRPMGRAARGVRGVSLKNEQDFVVSCQVVTEDQSVLVVCDNGFGKRSLVCDFRETNRGSVGVRSIVINQRNGDVLGAISVTDCDSILLMSAQGQAIRINMQDVRVMGRATQGVRLVNLREGDTLVAMEKLSINTESVETEENLAASVQSGQDTIEE

SEQ ID NO: 261 - protein, 206 aa, Chlamydia trachomatis
RNSVFIVVEGGEGAGKTQFIQALSKRLIEEGREIVTTREPGGCSLGDSVRGLLLDPEQKISPYAELLLFLAARAQHIQEKIIPALKSGKTVISDRFHDSTIVYQGIAGGLGESFVTNLCYHVVGDKPFLPDIIFLLDIPAREGLLRKARQKHLDKFEQKPQIFHQSVREGFLALAEKAPDRYKVLDALLPTEASVDQALLQIRALI

SEQ ID NO: 262 - protein, 296 aa, Chlamydia trachomatis
YRQGEVMESAAWEALIQRVRDQKLPSAIILHGQDLSNLSARAYEYASLIIKETLPEAAYKLANKLHPDIHEYSPQGKGRLHTIETPRAIRKDIWIHPYESPYKIYIIYEADRITLDAISAFLKLLEDPPQYGMFILVSALPQRLPPTIRSRCVSFHIPMEEKTLVSKKDIAFLIGLAQGKESVTRIGSQVKGTADEDKQVLRDKTKAMLTVLLQLFRDRFLLAKKVPVSLLAYPDLLNEIKTMPVYPLEEVLSIITRAVQALDSYSSAPSCLEWICLQLWSFKNRQQMAIRNRRRS

SEQ ID NO: 263 - protein, 262 aa, Chlamydia trachomatis
LQEVIYMATLISLNDANRMLIADSQEEFLQIACYDWISTANKAIHKRGAFYVALSGGKTPLQIFQEIVKKRAAISDCSKIVVFWGDERANEDVEAGSNYLKAMDILKGLRIPEDQIFRMDTADPKGDEAYEALIQKYVPDAIFDMVMLGVGEDGHTLSLFPETQALEEKERFVVFNEVPQLHTRRMTLTFPIVRQARHLVAYVQGENKQDLFHKLVHPLGRDTFPIERVGTPLNPVQWVLSSDSCRKTDLADIPADCKLEMF

SEQ ID NO: 264 - protein, 171 aa, Chlamydia trachomatis
KLFIDNPRWKGVPFYLQAGKRLPKRTTDIAVIFKKSSYNLFNAENCPLCPLDNDLLIIRIQPDEGVALQFNCKVPGTNKLVRPVKMDFRYDSYFNTVTPEAYERLLCDCILGDRTLFTSNEEVLASWELFSPLLEKWSQVHPIFPNYMAGSLRPQEADELLSRDGKAWRPY

SEQ ID NO: 265 - protein, 340 aa, Chlamydia trachomatis
ILGCTLEEIKDFGPTLPACPPCIVVIFGATGDLTSRKLFPALYNLTKEGRLSENFVCVGFARRPKSHEQFREEMKLAVQHFSHSSEIDIRVWESLENRIFYHQANFSDAEGYSALKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFSSEEIKKEKIKILKKILPIREEDAVRGQYGEGIVQDVSVLGYREEENVDPNSSVETYVA

SEQ ID NO: 266 - protein, 85 aa, Chlamydia trachomatis
FSGNPLPMQKAYASSVQSEIQELAALIQEMTAIEVILWDERLSSAQAERMLKSDCGLNRKQRKNSSDSLAATLILSSFLDSRKLY

SEQ ID NO: 267 - protein, 102 aa, Chlamydia trachomatis
MNIAKQQQAFLGIDYGKKRIGLAFASSPLLIPLPIGNVEARSSLTLTAQALVSIIKERAVTTVVFGESITYAKSLCFKRAIRNSRTSRTHPRNDCYRSHSLG

SEQ ID NO: 268 - protein, 539 aa, Chlamydia trachomatis
MSFKSIFLTGGVVSSLGKGLTAASLALLLERQDLKVAMLKLDPYLNVDPGTMNPYEHGEVYVTDDGVETDLDLGHYHRFSSVQLSKYSIATSGQIYTKVLTKERNGEFLGSTVQVIPHVTNEIINVIQSCADHHKPDILIVEIGGTIGDIESLPFLEAVRQFRCEHPQDCLSIHMTYVPYLRAAKEIKTKPTQHSVQNLRSIGISPDVILCRSEAPLSTEVKRKISLFCNVPEHAVFNAIDLERSIYEMPLLLAKENISDFLLNKLGFSPKPLDLSDWQDLVEALCDKERQHVRIGLVGKYLEHKDAYKSVFEALFHASVPANCSLELVPIAPESEDLLEQLSQCDGCLIPGGFGTRSWEGKISAARYCREQNIPCFGICLGMQALVVEYARNVLDKPLANSMEMNPETPDPVVCMMEGQDSVVKGGTMRLGAYPCRIAPGSLASAAYKTDLVQERHRHRYEVNPSYIERLEEHGLKIAGVCPLGELCEIVEIPNHRWMLGVQFHPEFLSKLAKPHPLFIEFIRAAKAYSLEKANHEHR

SEQ ID NO: 269 - protein, 266 aa, Chlamydia trachomatis
LLLRWDVINGGAMFAFLTSKKVGILPSRWGSSRFPGKPLAKILGKTLVQRSYENALSSQSLDCVVVATDDQRIFDHVVEFGGLCVMTSTSCANGTERVEEVVSRHFPQAEIVVNIQGDEPCLSPTVIDGLVSTLENNPAADMVTPVTETTDPEAILTDHKVKCVFDKNGKALYFSRSAIPHNFKHPTPIYLHIGVYAFRKAFLSEYVKIPPSSLSLAEDLEQLRVLETGRSIYVHVVQNATGPSVDYPEDITKVEQYLLCLSKASF

SEQ ID NO: 270 - protein, 141 aa, Chlamydia trachomatis
SNEKLLYFIIIMLSKFCKLSLSAILLINTLAPSEAFSEEGTSGFLGRMKSWILKDKTILSTTEESQTSAIEKVSDLLSWKRYDYTQESGFAIQFPESPEHSEQVIEVPQSDLAIRYDTYVAETPSDSTVYVVSVLGISREN

SEQ ID NO: 271 - protein, 238 aa, Chlamydia trachomatis
  VARIANT (1)...(238): Xaa = Any Amino Acid
FLFRSCFPMLDVKSLYYSHASHSVFEDASAGFASGQISMVLGASGSGKTTLFRIIVGLLSCSLGEILWKGQPIQQEQIAYMQQKEALLPWRTVRKNILLLTELGSRKQKTTIEEECFYNVVHSFGLSSLLDRFPDELSGGQRQRVVFAMQSLSPKPILLLDEPFTSLDPITKXILYQDVKRLAKEEGKTIILASHDVQDCLGVGEAFFAIKNQKLHSIALNKEQGIAGLLQQMKDHLV

SEQ ID NO: 272 - protein, 235 aa, Chlamydia trachomatis
  VARIANT (1)...(235): Xaa = Any Amino Acid
RTRNRWVIAANEGPPSLTIPPLKLVQAARPLYDQQLHKLSREEKLSLQGEIRTHEVRSVPLVFFAMLAAVGAFLALCIGGVLCCIDNVVFLSEIFLPFILPGILSLLPIALLLRLAWKEQKLAAQKQQRIAASCYFESLALCRTYKSGAPSVKGLVNFIQSEILPSGFSKRFKFAVLTQAKPSLLTKKIQLTKTPFDETIETAFSHIREGLYLSESEQRDHDKKLXXEANTSPKG

SEQ ID NO: 273 - protein, 407 aa, Chlamydia trachomatis
SWCMEKDFLENVYRHFRYRFFKLSILPALLGLWLFFTPNILNYLDSSVILSDKICGVLLILLSALSFYNPVILQLGIFIGLWVSFFSCSSDLLPLVFAHDSLLGFATLAIIFLIPNRPEDLEVGPTIPETCHYNPSSGGKRAAVLIFAFVGWLQSRYLTSAALNIADADTSCSLFFSSTLMVIYSMLIVLSLTGGERRWHTQPKVVFITAILLFIAIGLTLAAILLSQLFLTNYEGVCLTVAPVFSLAFFYDEIRATWNYLSQNYSNRKQLAITAFYGSEYYKESLFWEERSVLPFSQACKQAFAGLSFPLNLIFACIFSIFFVQLNVNLSIPDTCRFFVNSACWFILVLSIFSFAESLRHLRWLSLLFAAGIILSPVIFHLPLEASTLLSIIVSGIAFIILSMGRL

SEQ ID NO: 274 - protein, 282 aa, Chlamydia trachomatis
LSFLTHKKSERKEKVFFNKEASFISARKRFRFFYFCLISILNGRMDTRTPLRKKILIISTALGFVLCVGLMIHTKRSIMPPKTHIPTTAKYFPTIGDPYAPINITVFEEPSCSACEEFSSEVFPLIKKHFVDTGEASLTLVPVCFIRGSMPAAQALLCVYHHDPKRPDPEAYMEYFHRILTYKKTKGSHWATPEVLAKLAEKIPTHSGREINPKGLIQCINSQRFTEQLKKNNIYGSQIMGGQLATPTAVVGDYLIEDPTFDEIERVITQLRHLQAIEEEVR

SEQ ID NO: 275 - protein, 529 aa, Chlamydia trachomatis
MHHRKFLAVSIAFVSLAFGLTSCYHQKEEPKDVLRIAICHDPMSLDPRQVFLSKDVSIVKALYEGLVREKEAAFQLALAERYHQSDDGCVYTFFLKNTFWSNGDVVTAYDFEESIKQIYFREIDNPSLRSLALIKNSHAVLTGALPVEDLGVRALNAKSLEIVLENPFPYFLEILAHPVFYPVHTSLREYYKDKRNKRVFPMISNGPFAIQCYEPQRYLLINKNPLYHAKHDVLLNSVCLQIVPDIHTAMQLFQKNHIDLVGLPWSSSFSLEEQRNLPREKLFDYPVLSCSVLFCNIHQTPLNNPSLRTALSLAINRETLLKLAGKGCSATSFVHPQLSQIPATTLSQDERIALAKGYLTEALKTLSQEDLEKITLIYPIESVCLRAVVQEIRQQLFDVLGFKISTLGLEYHCFLDKRSRGEFSLATGNWIADYHQASAFLSVLGNGTRYKDFQLINWQNQKYTNIVAQLLIQESSDLQLMAEQLLLKESPLIPLYHLDYVYAKQPRVSDLQTSSLGEIDLKRVSLAEG

SEQ ID NO: 276 - protein, 183 aa, Chlamydia trachomatis
IITTLFVKTSMFFLAKRLVQLNKNPFLLKKFSETTVLFIFERQLKMWEGYSIDENNYISDYNMEFGRPLLQKLANPVCKALLQKQLEAEQAMTLSNQVTVGDIVLMRSPIFEKSVLLEALINEIIYQESLFLFKKPENCSMSEDEFRARCTRNLVEDLFDGLMNLWVQIKLIKGYDSMQDYQE

SEQ ID NO: 277 - protein, 253 aa, Chlamydia trachomatis
MSKLTQVFKQTKPCIGYLTAGDGGTSYTIEAAKALIQGGVDILELGFPFSDPVADNPEIQVSHDRALAENLTSETLLEIVEGIRAFNQEVPLILYSYYNPLLQRDLDYLRRLKDAGINGVCVIDLPAPLSHGEKSPFFEDLLAVGLDPILLISAGTTPERMSLIQEYARGFLYYIPYEATRDSEVGIKEEFRKVREHFDLPIVDRRDICDKKEAAHVLNYSDGFIVKTAFVHQTTMDSSVETLTALAQTVIPG

SEQ ID NO: 278 - protein, 339 aa, Chlamydia trachomatis
LKLRILLGAIDGPRVFLKREDLLHTGAHKLNNALGQCLLAKYLGKTRVVAETGAGQHGVATATACAYLGLDCVVYMGAKDVERQKPNVEKMRFLGAEVVSVTKGSCGLKDAVASNQALQDWATTHSFTHYCLGSALGPLPYPDIVRFFQSVISAEVKEQIHAVAGRDPDILIACIGGGSNAIGFFHHFIPNPKVQLIGVEGGGLGISSGKHAARFATGRPGVFHGFYSYLLQDDDGQVLQTHSISAGLDYPSVGPDHAEMHESGRAFYTLATDEEALRAFFLLTRNEGIIPALESSHALAHLVSIAPSLPKEQIVIVNLSGRGDKDLPQIIRRNRGIYE

SEQ ID NO: 279 - protein, 103 aa, Chlamydia trachomatis
YYSITKRCDMKNQEESGWQAFLTLCSKMQKEKFLQDLFSLFLSFGERKDVASRYHIIRALLEGELTQREIAEKYGVSIAQITRGSNALKGSDPQFKEFLQKEI

SEQ ID NO: 280 - protein, 106 aa, Chlamydia trachomatis
LPSEACMSLDTAGKPHWKIPEGFLQFAFAYYRSWVEHWVKKSLRRGSLIQLPARSIQVSLITTQTGYFARQNRRGGFQVFYSIYGLEGKVQPHQAPGDMLCDITED

SEQ ID NO: 281 - protein, 514 aa, Chlamydia trachomatis
SEGLEMFVSFDKSRCRADVPDFFERTGNFLLHCVARGINVLYRVKQIPNYPSCYFSHKEISCCRRIANIVICILTGPLMLLATVLGLLAYRFSSTYQTSLQERFRYKYEQKQALDEYRDREEKVITLQKFCRGFLVRNHLLNQETLTTCKQWGQKLLEGEKFPRVPEGRSLVYISKQFPSLVENFLFEEKLPVSRISVDSMCLYKENPQAFDEAIKELLFLFKEVHFRDFVVETESPTDDFPLAVKVHNYWVCPRYDNLPLFIQEGKDGSPEGRIGLVDLETFSWSPHPCPVEELAVMFPMSKELLMTEAKKLQIPFSTKEVERSVEKGLAFFEHMLGHPDFCSQKSVTPLRNCAPYLHLEVWRFSLKIFDILKAAIRLNGALNVLLSPDIRERLSAISDKQWLAISSQVTSSLLEQVSTNIYQSHTEEAKRVNSSGTFIMCRSPIFRKSIFIKNLPELLNKKLQLLPEEKEISEALASLCLRAVMEELVATGNIYSYDSMDDFFEGQYCRIRY

SEQ ID NO: 282 - protein, 112 aa, Chlamydia trachomatis
KIHKKIKKCLTTTLLPNLFSLFTNRNRETLMIVTFDKYLAPELGPDPLERLGNVLLYPIIRGFGSLVSVKTLGEKRFLCFSDKVVSLCVNAFFVWYAIFSQHLLRVCSLCEG

SEQ ID NO: 283 - protein, 286 aa, Chlamydia trachomatis
RPIKLHELFLIVLLKRETRLRSLSKNNAPPLSLYKNIYVARKPLVDRDHFPKYRTICDAIMEGNLENIRFSDKTGESVYSSKELPSVLFKRIGQKNAKQRVLNNIALNAYLAKTGVDGLQVLSASTYKDFLIEDKPFGKGALDTLIAYRLNPSLFDRAVKSLCKLFSFYHCPDLFVKSGDLLKDSPHSKLLLGFKENNESLAAESATLQPILYLTGIQCILEEPTPDLEAKLSSLFPYHKTLIQQELSKLRVSKPKVEASKEPTPPSTYDERLKSSPPTEMENFYD

SEQ ID NO: 284 - protein, 167 aa, Chlamydia trachomatis
KALPLQKWKIFMTEQPHRLSEEARSIANEAKERLLKLNDKPELSRPYLVKGFLSKISRGISDKEAASKFSKAIVTSLLGYLWNHILQNKERILSADARDLEAHSALLDTKEILALCKYFAINRCTWLSSSSTQEEENLICQDIAKEMFSSLYMLLWNNSGSEDMIFQ

SEQ ID NO: 285 - protein, 107 aa, Chlamydia trachomatis
SKTFRRRKKSFFFSMSVNRNHNNFPPYGENETPPPESQPTDGPEDPSMQGAYYIAPEDLPQHQLAAAVEGLHIGSTLNPTAPEFTPGAVSHHFETFTPSFPPAPQQP

SEQ ID NO: 286 - protein, 406 aa, Chlamydia trachomatis
AVLDPYATYPYGVQSPYLEYAPPAVVQEPYTTTGQQGLSSYPEAAPQPPALQQPESLPQATARDRGDLEKEANNTNSFATQAIETTPSNISPCFNLHGEAIQLFSTESGPSPLRAILQAIKQAKYHIYIQIYRFTSEEIAAALLERANNGVRIHYNINTSAAQKPLFDILTCKFKATNQARLHCKNIVVDGSLVITGSANFSDAAFSRDINLVAIIRNPSLGQLVVSQQSGWITGGSQQIEYCSLYCHNHQGVDEVVKAVQSAVKTIRVAMLVLSHEEVLHALHQAAQRGVEVTVLVNPHNKAVLFYALQDLNSKVKLRDVVVEENALLHCKVGLIDTNLLITGSANWTVRGLQYNIEDLIFIHQPTPSQLSAFFNLWEQAMSLSREVTAKKIKKSARAQHKYDDE

SEQ ID NO: 287 - protein, 369 aa, Chlamydia trachomatis
SLILEDAVALDPPPPPPHTSQNTPSPKDSSLVALARTDKAATDIFNSAKHKAIETTKRSDQQSRSLPILHLLAADPEPIVFHSTHQTNHNDPQRMLCDAILQANRIITMRIFNIGSPEIIRALIRAVRRNIPVIVSAWNFPNLSNWDRESKLYVELRGNPQICLHKKTTLIDNQLTIIGTANYTKSSFFKDINLTALIQNPALYSLILSGTRGSVSIGSQTISYYPLPFPQSNTKTLPIIQEIQKAQRTIKIAMNIFSHPEIFLALEQARLRGVTITIVINKKESAHTLDILHRISALLLLKSVTTVDSLHAKICLIDDQTLIFGSPNWTYHGMHKNLEDLLIVTPLTPKQIHSIQEIWAFLLKNSSPV

SEQ ID NO: 288 - protein, 312 aa, Chlamydia trachomatis
MLAGSKRKHKTPEDTSSSSSKRARSSSSQVVPRLLQHHELIQLYSAHQQRNNEPVKMICETILQAKRSVLLKVFNIGSPRILAALAEASNRAPVSVHYQMGPFSKHCTEGNVQFRPRRGCSLLHRKTLLIDNNIVVTGTANYTEASLEKDVNLTAKIFSEHLYRWAFRHDRGEVRVGSQQVSYYSLSQIRRDLCVKAILEANGIVLRERTCEGILHTKVCCIDSSTLIIGSVNWSRGGLTLNLEEFLIINPLTETQLECYNELWAYIETNSRLMTKELIQLHEKRKKSITDPKQTSSSTQDEENASTSAEQQ

SEQ ID NO: 289 - protein, 236 aa, Chlamydia trachomatis
LFSSASPRTFTSPFFCRIISYSSVRFKSLSIFTAFRQSSESRNSPLRETTGSSSRHRYHRHGETSSSSRIETVGSRHFSSRRESSRTGSRSSRHSERARHHESRSHRHSSSSRHHVTRSQSSALPQLQERPVPHPLAERELITFHSVHQQQNNNPLRMICDTIRQAQRGIFMRIYAISSDDIIQSLIQTSHHVPVEVKYHCGESLPVACQNSRVVLRPTNGRTLQHKKLCWLISKQ

SEQ ID NO: 290 - protein, 239 aa, Chlamydia trachomatis
MLADFQTVVTGSANYTDLSLNHDVNVTACIESSELHDAVFSERPQLVHVGPQLLNYIPIQRLIPNAASKMILNAINQATDSIFVLMYIFLSPEFFLALAQAMRRGVRVKVIIDNHSKQDTCKLLSKLGIQLPLYERKTEGILHTKICCIDNKTPIFGSANWSGAGMIKNFEDLFILRPITETQLQAFMDVWSLLETNSSYLSPESVLTAPTPSSRPTQQDTDSDDEQPSTSQQAIRMRK

SEQ ID NO: 291 - protein, 241 aa, Chlamydia trachomatis
  VARIANT (1)...(241): Xaa = Any Amino Acid
RLSSSSVSLLFFKASSFHYRVSITVQPGEFLMTKPSXLYVIQPFSVFNPRLGRFSIDSDTYIEEENRLASFIESLPLEIFDIPSFMETAISNSPYILSWETTKDGALFTILEPKLSACAATCLVAPSIQMKSDAELLEEIKQALLRSSHDGVKYRITRESFSPEKKTPKVALVDNDIELIRNVDFLGRAVDIVKLDPINILNTVSEENILDYSFTRETAQLSADGRFGIPPGTKLFSKPSF

SEQ ID NO: 292 - protein, 508 aa, Chlamydia trachomatis
  VARIANT (1)...(508): Xaa = Any Amino Acid
KPNPHRGKRPSRLTRIHRIEVQLPDSSRIPYDCSCINRYGIFPRFNPNQNKLNVIRKIKSGFQRSLDDYHIYQIERKXXFSFSPKHRSLSSTSHSEDSDLDLSEAAAFSGSLTCEFVKKSTQHAKNTVTCSTAAHSLYTLKEDDSSNPSEKRLENCFRNWIDNKLSANSPDSWSAFIQKFGTHYIASATFGGIGFQVLKLSFEQVEDLHSKKISLETAAANSLLKGSVSSSTESGYSSYSSTSSSHTVFLGGTVLPSVHDERLDFKDWSESVHLEPVPIQVSLQPITNLLVPLHFPNIGAAELSNKRESLQQAIRVYLKEHKVDERGERTTFTSGIDNPSSWFTLEAAHSPLVVSTPYVASWSTLPYLFPTLRERSSATPIVFYFCVDNNEHASQKILNQSYCFLGSLPIRQKIFGSEFASFPYLSFYGNAKEAYFDNTYYPTRCGWIVEKLNTTQDQFLRDGDEVRLKHVSSGKYLATTPLKDTHGTLTRTTNCEDAIFIIKKSSGY

SEQ ID NO: 293 - protein, 225 aa, Chlamydia trachomatis
MVILVEAKHISKVIQQQDVCIPILKDVSFQLHAGEVVAITGASGSGKSSLLHLLGTLDQPSSGQILFFGKQVRREELPIFRNCRIGFIFQNFYLLEDDSVINNVLMPAQIARKDTGQKSKARERALALLESVGLVDRRDEKGSLLSGGEKQRVAIARALMNDPEIVLADEPSGNLDHRTADTIHELLLALAEKHRGVLIVTHDRELAEKCHREEILRDGTLMQRQ

SEQ ID NO: 294 - protein, 215 aa, Chlamydia trachomatis
GIGCIHPLGIRRLGMHNGWQVFLPSVQDIPVMKQSIQKIFKESEVSSYWEISSLYDYEFFKPILDQLQSDQVLFSIVSFIVLIVACSNIVTMSILLVNNKKKEIGILKAMGVSSSRLQLVFGLCGACSGLVGALLGSILAALTLKNLGVLTHWLSKLQGREAFNPSFFGEQLPQDFHLPTVICLSLGALVLAAISGAIPAQHVARMQVSDILKSE

SEQ ID NO: 295 - protein, 332 aa, Chlamydia trachomatis
VGFYLASKIPKGVMKLELLLAFKYLIPKRKRLSSSIVSAFSIGIVALVVWLSVVFMSVIHGLQQRWVGDLASLHSSIRIEPSDKYYESYYYQIDSHAEASQYIYKTIGEKLLCEQTDPYDPDVDFLLPEAFPDPEFSDNGEMIDPVRTANERMLSLFSSRKGSFVEFEEGMGHVHMDRAFRGHKGEPRALSQYIAYSSDILYQQRVLPFEETDYSTEVLNRFNASSEGWLADFLVLQEKFRGMSVILPVVYRDQGYRVGDTASLSVFSVKKEGEVRFPLRVIGFYNPGVSPFGGKTIFIDKELAASIRSESEGLVCIMAGRYFFLVFKISLS

SEQ ID NO: 296 - protein, 315 aa, Chlamydia trachomatis
  VARIANT (1)...(315): Xaa = Any Amino Acid
MKKFATFLCVLLSGSGFAAPVEAPGFPSIPETYITINDKELGLQEHCRGVNVLSCGYNLVGMFHTPTTPMPLGGYPTVIFFHGFRGNCTGKDGVYRDLARLLTANGIAVARFDMAGCGNSEGICDQIPARTYLRNGEDILATVAKYPEVNPHRIGIAGVSLGCHTTIHLASTYRPRDYTVQAISVWAPIADGVILLKEICATIGLTMTQFSDMGEVGKAFGFKQLPLKLCRDDIDFFLGIQDHILLLSLPRRIPVLHQQGLEDRVVSTAHQRLFLGAAPAQMLSKSYPETPHEIALSPYRQEVLQEILTHFQSXL

SEQ ID NO: 297 - protein, 518 aa, Chlamydia trachomatis
EKSTFLLVRITMIDVLIMGANPSGLILASILQQHRARIKVIDSRDSITASLPLPLHSLPVVLSSSSLELLDNINLLGDLLDKGRKIFGARYHWKQRTVLFKFNQSSASRCPFSLLISYNELVTHLLEEFERLGGVVNWATRPVTQVEQNLFIESTKSSSQVYEGREIFTPKWIIACEMDADPDLKDLLKTQIKTKKIHKEALFVDCEEGEPFEESHIHLLPVTKSFVNFVFYNPYRGSRQLYLANTSGSLSSKFKNKLLYTYSLALAEDPLSISSSLLQYPFCHDRYIFLGSIANNLSFSYLSGVNSNIHDAFNLGWKLLPVIKKAASSQLILSKELKTSHVLPHFNEVHQKRATKLLFSNMYTPALMYYYLKGCKQLDAAEGELYYPSHRASKYEASDIIKVSPNDKEIQGPRPGSRALDIRLDTGNYLLDSLKNAKHLLVFFKERPDLVHALLEEYGEWVDVIVTEDPKVHKLYHANPESLFIIRPDRYIGYRTHTFKLHELISYLLRIFAAENAN

SEQ ID NO: 298 - protein, 542 aa, Chlamydia trachomatis
GCLFSEELVSDGRKLPYPDLGDQNIKHLEKIRDVYGLDGVAELRVAEAALLGVQKLPEEQKQESLKSAVKALRADAKVLNKKFKKLPESYQPQHSEVTGVQGVTEQESRDDVLVAQDMAAIEELQDQYHAACLQFESVSMRFLAEQRKAKFLEKLLIQKRRDVSHLSHQEAHYTQVVSHLKERISMRKGASTQHASKEEISTKMRELLSLDDQLLKAHTAQDVNWDNSINGQLQQQFKKLSEEGSLQKVKALLELNMCLGNAGQTLYHSRLKREVFEASCSNTSQQLLQYGEDLFASYDGSDRSALLRFVLGSGYEMISEASSELKSLRKRWKRSASQAAIAPEDYEKVCRVLERFLKARDSLRPKLGLPLGKSSDATVGLQHQIRDNQRVKARVTACYQESCRNVLQHLEDWVRKTRQESAECQKVETKIREFCQKAGSKENLAESTEMLFSSLEEDLNKIPLDVLRAILRSLSSKVLHIRDQKLELEKLEEQFAKTNIIVKAKEAEFEKNGEVWHNQYQMLKSQMEKLESQKRRLTDKKE

SEQ ID NO: 299 - protein, 949 aa, Chlamydia trachomatis
EYGIILPSKIVFQESMANPSTPPSNHSGLSLQGRLRASSQQCTQAGQGDPQPLSPESRGLTSNFSTRRDLIDVVEESIETAKGSELKKLRIYEIALKILTIIGAAILFAVPLCMLLGVPLWIPIVTCIGVGIAFSIAKGCLQKRCQQIREEYRALHLYHRYLLSNKDSIDGTLLSRFDIRFRKAEEKLHGLDLDKREANHPLEADKRYDFAGLAHQRYQVDAALGISSSQDAFWRGVAQQVKSVKDDVVLGDKASTDLYPIAQQALQAAGVGFSGAAGKESLLDLAKSLSSLFAWGSQVGKDSHEALQRYQMRFLSSPILATWCGAGFSTSAQDFVLKGKNVLDIASENHTKMQNAIKCVQLVSVLGKMRNWKEKIDTLIQNKNLDQDSLRKLYQDIEKAMHKVCIEDGVSASIQARVRKVTQKYLRQDLQELLNKKAPLNESDLSKMQKGISSCANLVVTLLESQLGISEQTSIKEVEESIYRDLIDTILQMGSAAGGVTPLVDGVHKAIREGKTLRSELSRAMSLHPRQSFLGVQSAVEKLQAFIRDPKWGASAVHTSAEETLAQKQKFVSDLTRIQTSLADWRERYGLFEETKLNHIVSTDFVSRTEAFLDTLKNVAEACSLEQAVAELKDCEDAMKADLTHVEQKMNPTEIESAREEFKQLMEELAGIQEQLEQIARPIYEEGVSGKRLLLNTVFSHPEALRKKVQAKETLLEALTKGEQPSPTKKKTLKQLSEGCEYFSSLVSKINAVKTILEGSRGKKIASQDIRQLIGLTDELALKLSSFQQDSLESLLYGLEGLSIPAASIEQKKGSPKSSSIAEKVVYASHQRVYNGVKAKVNRTLEAFSQLIKGLRGSLRNAMITKAVVAAILSVAFSCLAIALFSVQLTWLPIMLCVLALVLEAIPSALSIWVEKRNWKYEVASLAKSWFRMEESFLIQIWGIKISSI

SEQ ID NO: 300 - protein, 395 aa, Chlamydia trachomatis
RRCGAVLRMAIDGVVIKVDNIAHQDRLGLTSKHYRWAIAYKYAPERAETILEDIVFQVGKTGILTPVAELAPVFLSGSRVSRASLYNQDEIEKKDIRIGDSVYVEKGGEVIPKIVGINLAKRSLESEPWKMPSLCPVCHEPVVKEKVSVRCINPLCSGGMLEKICFFASKSALNIDHLGEKVVTKLFEVGLISSCSDIFALTEEDLKQVPGFKDRSIQNLLASIAGAKKVALDRLLTALSIPFVGSSGAIALADHFGTLDKVIEASLDELMSIEGIGPKVAASIVAFFSKHENREEIRRMQELGVQVLSKQSDKEAPLQGKVFVLTGTLQQMTRTQAEERIRSLGGKVSSSVSKSTYAVIAGSEAGGKLKKAQDLGLSIWNESKLSRILDAKSVS

SEQ ID NO: 301 - protein, 128 aa, Chlamydia trachomatis
DSLKKAPEDLEVRGEVFLSYEAFEELNACQREQGKLEFANPRNAAGGTLKLLSSKEAAKRKLDLSVYGLITDQKKRSHFENLQLCSQWGFFVAGMPKQCRSRQEVVERIREIEEMRRSAPDGYRWSRH

SEQ ID NO: 302 - protein, 176 aa, Chlamydia trachomatis
MGAVSRDDYIALCTELVEHDRRYYALNQPTISDYSYDMKMRELQEIEVQHPEWKVSWSPTMYLGDRPSGQFPVVPHSSPMLSIANVYSLQELEEFFSRTEKLLGYSPGYSLELKIDGIAVAIRYEKRLFAQALSRGNGVKGEDITANVSTIRSLPMRLPQEGSRGSRSARRSVSFI

SEQ ID NO: 303 - protein, 599 aa, Chlamydia trachomatis
SQNSDMDLWSRDVLAEHRFIKKRYILKILPSELSSSENFMRVFQEVIVQLAAIRHASLVAIENVSREGDRYFVVTEENGGTISLAQYLSGRKLSEEEVVHLIQQLCDALELVHSIGLAHGQIHLHSVHVSFFNGIANIYLPEVGFASLLRERMFSTIMQSGSARESITRIRDLLMFEAPEEQEVFGREADVYSVGVLAYYLLVGSFPWGSFPKPSLCMPDSWYDWDGFILSCLQQQREARPKCLREALRRKTSGEQLQVTLDSCREPLREMEIEDTPTELGPPSALIREGERLCEVKEEQHAFVLVEAKSIDEAMVTTVDSEEELESSEGYANPLQSLLAREPVVSRYVEVEREEIKPQPLLTEMIFIEGGEFSRGSGDGQRDELPVHNITLPGFFLDIHPVTNEQFVRFLECVGSEQDEHYNELIRLKDSRIQRRSGRLIIEPGYAKHPVVGVTWYGASSYACWIGKRLPSEAEWEVAASGGKLGLRYPTGEEIDKSKANFFSSDTTPVMSYPSSILGLYDMAGNVYEWCQDWYSYDFYESSALDPDAPLGPPQGVYRVLRGGCWKSLKDDLRCAHRHRNNPGAINSTYGFRCAKDVK

SEQ ID NO: 304 - protein, 202 aa, Chlamydia trachomatis
GGRLMTTPDNNTIDVSFPTFVRLNVATTDLADGNKSNAVTITETATANYVNVTQDLTSSTAKLECTQDLIAQGKLIVTNPKSDISFGGRVNLADNTITYNPYNNGGGEVAFTDINSRQGKQYVPYGLYKNGAPKISMRSALSGGHVGSGDTRGWGAEVLWDAYTQQREDLEDKAVTFSPANRGKLYFEASLRLPFCSVSPSL

SEQ ID NO: 305 - protein, 283 aa, Chlamydia trachomatis
EDNMKKPVFTGGAPIPGISTEEGTGVKDQNLWMRNATLKVEGDATIDDTLTSRDLKVTGPTIHTDLDLSVGGDVKGGRTVLGETVLEGDFNIKCNQGQVPQFTNLSDPLSARDAITFDYYRDRSTQAYNCATHRNGALVKGNRFIDLRMHNIDDSESYTPMYQNRFYWKDNDQKKLYLKSPGIYQVAFQIFRSGGYHSGNEDPTIFLRLYTSAYEYTNLCTGDTRGFNPEHTTNTSLYSIFSIPSIGNEHPFIQVFTKIHVNIAYSMINVIWFPFGSSYKEAD

SEQ ID NO: 306 - protein, 285 aa, Chlamydia trachomatis
MSDSDKIINDCRFDFNTTVHGDLLASNLTTEGDVTVKSISAKESFSVKRKVDVNENDIIVNGFTGAAGYDLTTRGKISINLNGNRLSNVKCPEKDSQPVPANYIRTPEYYFCSLQDGARIEWKRGQKLPLIGPSRLVYQSSRINEFIRFVSFEENKTRTQVKINLSGTTGLQMLAKGVYIINVGVGKRWGWNNGYGGDYCLAVPLGKEYSESSTFSRGGYYASTAVGTAIHIRKESTNPDGPFSSSDTELMKTLLEVRYKGGDYVDKSALSTLYFGVLVYPEIGG

SEQ ID NO: 307 - protein, 160 aa, Chlamydia trachomatis
  VARIANT (1)...(160): Xaa = Any Amino Acid
LILRMRRDRKELMLKKPNRNDPCPCGSGKKYKQCCLKXQALTARHTPEGKFKFSITASPAAGASTEGFTKLFRQSVDSYTSEQKEGMSRFLITKNKEPIGKRAIRKAKAKEERIISEKLSQHEFQVMDTEVSGEDIQSSLDYEQFLPTEEDYRVQKEEDS

SEQ ID NO: 308 - protein, 312 aa, Chlamydia trachomatis
FYRNTQKYFMYVRSIFFSIIAFLTVGCSFSPPESGLIIAIHDDPRSLSPEKGENAFHFSLSKALFATLFREELSGLTPALVSSYQISEDGRFYRFCIRKDAKWSDGSLLLAEDVIAAWEHTKQAGRYSLLFEKLSFRASSSSEILIELKEPEPQLLAILASPFFAVYRPENPFLSSGPFMPKTYVQGQTLVLQKNPYYYDHAHVELHSIDFRIIPNIYTALHLLRRGDVDWVGQPWHQGIPFELRTTSALYTHYPVASPGTFWLILNPKDPVLSSLSNRQRLIAAIQKEKLVKQALGTQYRVAESLHLQRES

SEQ ID NO: 309 - protein, 133 aa, Chlamydia trachomatis
KSPSPEGIIAHQEASTPFPGKITLIYPNNITRCQRLAEVLQEQCRDAGIQLTLEGLEYHVFVQKRATQDFSVSTATSIAFHPLAKSKFDQTALDNFTCLPLYHIEYDYILSRPLDQIVHYPSGSVDLTYAHFH

SEQ ID NO: 310 - protein, 262 aa, Chlamydia trachomatis
TKPIFFSLIEQDERLTPLSYEPQVESSLQVVRSIENASGLGSDAQPLQELFRKLLLLHEQGPLAYIGLVWNFANRFGGGILEPKRLSRDGKNLLELLHALAIPVDLSHCSDPLADDILDFTADKMPDMFVLACHSNFRAVQDIERNLLDVHAKEIFARDGVIGLNGVNYFVGASLEDIKKHIAHAQELGILDSLVLGTDFFYTEEEKFFPNFSTAKDHPKLHALIKEAIPIDKAQSLLEERAQRFLNRVVSAQKKVVNHIAF

SEQ ID NO: 311 - protein, 283 aa, Chlamydia trachomatis
VFSQQIEESIKAGQVFAFPTDTVYGLGVSFHILDADQRLFALKHRSSQKALSVYVSSLEELEAVALAQQSLGASSRKIIQKFLPGPLTLITKHNNPRFPQKTLGFRIVNHPIVQQIIQKVGPFLATSANLSGFPSAVSADEVKQDFPEEDIVMISGECSIGLESTVIDPEERIVYREGAISIAEIETVLGAPCANLSKELGFREKIGIHVVKTPADLCSFLLSRPHFKGVICHQPHPHTFYSVLRQALRSPTQEIIFVYDLCNTEYPILSRFLGVSYDSGYAL

SEQ ID NO: 312 - protein, 252 aa, Chlamydia trachomatis
VLPKALDQLLGRYMSYSFFRRKLAGIEFIECPGDPEAPVIIFCHGYGASADHLTFFPTMCVCANLRPTWVFPHGIEQLPYQLGGGRAWFPLDTVLFEKLISSQEITPDTDRLYQQLLDVDFEKPKQALEGLIHELERDRSEVIIGGFSQGAMMTTHLMLSSRLPYRGALICSGAAVPNQSWEENASLCGKTPYIQSHGYDDPILPYFLGERLYKVLTASLKGEMVSFHGGHEIPVVMMQKIQESIALWSQST

SEQ ID NO: 313 - protein, 87 aa, Chlamydia trachomatis
SRTARCIQRGALYALVLEKMQRFPKEFLKDGVALAKSVVAIQAGESLDTGELAWEEMPSITACLGREGIDAQAYSFLSVSPLDARIE

SEQ ID NO: 314 - protein, 324 aa, Chlamydia trachomatis
NSLKKIWGNEIKEVKLLKMVSFDLNDPVRNTDNHYRNINRMLNSATCAAGGIGLLTPVVCSPMGAFCFAQGPSSAEDLGHRIQHFVACLGPAAGFYSLSNERIMFEEAAVPSVLEAVEATFWISAFARLRGNKPSTCDTVMMSCLIGCISLVCGAMFVAIVSCAVKISRIVRTMTQAHALRETIQRQLAARATDMRSAYSKLKGIIAIRALNEVERGHRKLRNKMITAFVANALITLAFCALLASAVIAAFFLGAASAGLASVFFGCLWGGIGALAVGVLVGIVSGICQRNYKVELRGVFSEVLFMRLFLRKCSDSLKNSLKMV

SEQ ID NO: 315 - protein, 92 aa, Chlamydia trachomatis
LRWQIPETMPTKTPTAKAPMPPHKHPKKTLASPALAAPKKNAAITAEANKAQKASVMSAFATKAVIILFLNFRWPLSTSLRALMAIMPLSLE

SEQ ID NO: 316 - protein, 161 aa, Chlamydia trachomatis
LGETEASIESKEICGGRRAVMACCACVYGYDEICCREETAEKVVAVAVASPCVLFHIAAAITTAVSAVWLLIRLIACAIHNYCSPASERVNFFPITESRAEWFSLIPVLGPMVVALAAVVYFKAREEGYGHLDSLVCAMQSPWMLLDSLRLNRSELKIVMV

SEQ ID NO: 317 - protein, 269 aa, Chlamydia trachomatis
  VARIANT (1)...(269): Xaa = Any Amino Acid
MSRKPASNSSRNTKRSSDTSWEVIAQDYNKAVASPRDGHFYHKEVILPNLLSKLHISRSSSLVDVGCGQGILEKHLPKYLPYLGIDLSPSLLRFAKKSASSKSRRFLHHDMTQPVPADHHEQFSHATAILSXQXMESPEQAIAHTANLLAPQGRLFIVLNHPCFRIPRLSSWLYDEPKKLLSRKIDRYLSPVAVPIVVHPGEKHSETTYSFHFPLSYWVQALSNHNLLIDSMEEWISPKKSSGKRARAENLSRKEFPLFLFISALKISK

SEQ ID NO: 318 - protein, 318 aa, Chlamydia trachomatis
FLCLLLGRYSDATIFRSGLNKIFCSGITQASLKRLISYLVITLVSPMIFIIVCGSWIYITQILPINYPQLFSFSHSMAFIYIVSRLLPYALLYGILFCCYAFLSRVPTKKSAAFFAATIAGSAWILSQKIFFCLQLHLFNYSFTYGALVALPSFLLLLYLYAIIYLFGGALTFLFQNKGFSILIPKEEIFPSSYFKFILCVYVLSLITEHFDNALPPPSANYLANKAKASIGETSQCLDILEREGMILKYKEGYKPSHNIANLHINTIFDQLTKSPAFSKICSPSLIPIQDALTHILTEIKKNSHNLSLSEIAKKVNS

SEQ ID NO: 319 - protein, 151 aa, Chlamydia trachomatis
KSEFMKRSPWYKIFGYYLLVGVPLALLALLPKFLSSESGKYLFLSVLNKETGLQCEIEQLHLSWFGSQTAKKIRIRGIDSESEIFAAEKIIVKGSLPRLLLYRFPKALTLTGWSLQIDESLSMNSPSLYHLDPGVLLSKIERRLSLQNLDP

SEQ ID NO: 320 - protein, 154 aa, Chlamydia trachomatis
NRAQVITSELGSITMKTINGSTLSVSGFYVKKTAEQLLIRALTKENDVPGSVAVEGALSPNFVLNVELSSVPASLFKLFIASPSLDRILSTENLINLTAKAHQEKDSTLITLTAEGNQISAKLRGYVRDRVFLITQGGASFCALTAYNNFSNSL

SEQ ID NO: 321 - protein, 280 aa, Chlamydia trachomatis
SHKAEPPSVLLQPTITSRILSELSPLDTPIRSQEAYLFISEAKLPLSISKWSASDFSLQANLPQISVDTLDPNLSIRTENTKISIRKSDHLTVMRSSSSAILGGASPSYIHSTLSMDNHKHVAEFHIQHSLLPHTYLRALLPKPIEINTPLEVPYYTLDIKGKYRNTQLSCEALLDNPLLRLSCNLSGPLYALQFSGEGAYTLSERWKERLAPHFLQIQAIFSGKMHFSQKHVFFPKLSGKLIAGDNEIFIHGKCGRASEEMKPSNSSLLVYGNTLLSSF

SEQ ID NO: 322 - protein, 590 aa, Chlamydia trachomatis
  VARIANT (1)...(590): Xaa = Any Amino Acid
IYYPPKFAPLQMTXSSFSLHSDGGKALLKGNVKLFITDPESPHXEXTKILIPDIVIXSLDPSAPWTADNXSVQASGELLQLPVDRLIRLQHKDLSLSRYIGETSEASFQLLYSPDKEETVDISSRFKTDALTGDFRFVMNKELSLTEKAHGSLQWEISPERYSSFFEKASCPPSCILHRPTTFRLDLSKISCLDKKTGYSCLSLLSQGGIEGKLSSTPLVFYDHLSKENFIVNNIGGSVYAQNVNDLIQYQLNGNCLAPNQDNKTPVSFIIEGEARNIFSDETRACSQTATWVNIPTSFITGIFPISPGVRSKLTSLAGPKIHVSIHNDFSRGEGPVTIKVDSENLTAYFPLVLTEQAILLEDDLTASLHINEEINKAFLREFNPLIAEGGAYSKHPVSLRVNKQNFYLPIKPYSFENFRIQSASLDFGKIEIANTGTMQDLFQFLDVEAEQQRVESWFTPIFFSVQKGQIICKRFDALIDGRIRLALWGKTDIVRERLAMTLGIDPELIKKLFRNTMLKTKNFFLIKIRGPISSPEIDWSSAYARIALLKSYTIAGPLNSLADKLFSSLGEPTPTQTVSPLPWEVSETE

SEQ ID NO: 323 - protein, 215 aa, Chlamydia trachomatis
MTVEVKDLTVAVKGKEILSNVSFSLVPGRITLFIGRSGSGKTTILRSLVGLTPISSGSISVVGDPPGFVFQQPELFPHMTVLDNCAHPQMIVKKRGEREAKDKALDLLGMLELREYASSYPHQLSGGQRQRVAIARALALDMRAILFDEPTSALDPFSASKFLQIVLSLKEQGMTIAISTHDMLFINQCLDRVYLVDKGQIIDAYDSLHDDPQGK

SEQ ID NO: 324 - protein, 216 aa, Chlamydia trachomatis
GIVEHYLLTAKLLLRGCGYTLLITAISLVCGFVLGWGIGTVNSRYFPCRISKFLGNFYVVAVRGTPLFIQILIVYFGLPSLIKVNLSPLVAGLIALTLNSAAYLAENVRAGINALPVQQWEAAKVLGYTGPQIFLHILYPQVFKNILPSLANEFVSLIKESSILMVVGVPELTKVTKDIVARELNPMEMYLICAGLYLIMTSAFSYFARLSEKESA

SEQ ID NO: 325 - protein, 245 aa, Chlamydia trachomatis
MDRSPLFLIIMGAPGSGKGTQSKLLASQLSLLHISSGDLLRGAVSKDTPLSQEIKSYLDQGKLLPDTLVWKLVHEKLDEFQQDTLLRRLSFLSRSENSAILDGFPRTVTQAKLLHEFLSSYFPNYKVILLDISDEEVLNRLTSRYICPACQGIYNEQQGFSSCPKCSVELIRRSDDTLEVILDRIQTYKQETQPVLDYYTEKQKLITIDANAPTQQVFQSILDSLSASLVYQERDCCNCDCDDED

SEQ ID NO: 326 - protein, 290 aa, Chlamydia trachomatis
CLYRGSPMPHQVLLSPVCDLLSNAEGIETQVLFGERICNHNHRHYAYSQLVFSSIWKPYPGDSLQNIPLFSSQLQPPNAVVCSQEAFLDPWHIPLPFAAPLHIDNQNQVSLSPASIALLNSNSRSNYAKAFCSTKEIRFLNSSFSLRDLVSFAEQLIDTPYVWGGRCIHKQLPRNGVDCSGYIQLLYQVTGRNIPRNARDQYRDCSPVKDFSSLPIGGLIFLKKASTGQINHVMMKISEHEFIHAAEKIGKVEKVILGNRAFFKGNLFCSLGEPPIEAVFGVPKNRKAFF

SEQ ID NO: 327 - protein, 134 aa, Chlamydia trachomatis
FVTKNMIQESVATGRRKQAVSSVRLRSGNGKIDVNGKTLEQYFPLEVQRATILAPLRMLGDVNSFDLIIRVSGGGVQGQVIATRLGLARAVLQEKEDIKQELKAQGFLTRDPRKKERKKYGRKKARKSFQFSKR

SEQ ID NO: 328 - protein, 111 aa, Chlamydia trachomatis
MEKRKDTKTTLAKASDDRNKAWYVVNAEGKTLGRLSSEVAKILRGKHKVTFTPHVAMGDGVIVINAEKVRLTGAKRAQKVYHYYTGFISGMREVPFENMIARNCLCYRACC

SEQ ID NO: 329 - protein, 126 aa, Chlamydia trachomatis
FNAESMQRIQVITFTPSPGRLDYYLPPAGPAVARGVDGACYSGYAIPPYYDSMIAKVITKGKNREEAIAIMKRALKEFHIGGVHSTIPFHQFMLDNPKFLLSDYDINYVDQLLASGSTFLNLADGS

SEQ ID NO: 330 - protein, 355 aa, Chlamydia trachomatis
LMKEVLIANRGEIAVRIIRACHDLGLATVAVYSMADQEALHVLLADEAVCIGEAQAAKSYLKIANILAACEITGADAVHPGYGFLSENANFASICESCGLTFIGPSAESIATMGDKVAAKQLAKKIKCPVIPGSEGVVKDEVEGIRIAEKIGFPIVIKAVALAGGGGRGIRIVREKDEFYRAFTAARAEAEAGFNNPDVYIEKFIENPRHLEVQVIGDKHGNYVYLGERDCTVQRRRQKLIEETPSPILTPEMQAKVGKVAVDLARSAGYFSVGTVEFLLDKEKRFYFMEMNTRIQVEHTITEEVTGIDLLKAQISVAKGEKLPWKQKNIEFKGHVIQCRINAEDPSNNFYSFPW

SEQ ID NO: 331 - protein, 164 aa, Chlamydia trachomatis
MDLKQIEKLMIAMGRNKMKRIVIKREGLELELERDTVPSIQEPVFYDNRLFAGFSQERPIPTDQNLGNPIVKESIEKKESEAPAQGDFIVSPLVGTFYGSPSPEAPAFIKPGDTVSEDTVVCIVEAMKVMNEVKAGMSGRVEEILITNGDPVQFGSKLFRIVKA

SEQ ID NO: 332 - protein, 185 aa, Chlamydia trachomatis
MVLSSQLSVGMFISTKDGLYKVVSVSKVSGNKGDTFIKVSLQAAGSDVIVERNFKAGQEVKEAQFEPRNLEYLYLEEDKYLFLDLGNYDKIYIPKEIMKDNAMFLKAGVTVFALVHEGTVFSMELPHFLELMVAKTDFPGDSLSLSGGAKKALLETGVEVLVPPFVEIGDVIKVDTRTCEYIQRV

SEQ ID NO: 333 - protein, 228 aa, Chlamydia trachomatis
MKKQGVLVAPSIMGADLACIGREARNIEESGADLIHIDVMDGHFVPNITFGPGVVAAINRSTELFLEVHAMIYTPFEFVEAFVKAGADRIIVHFEAAENIKEIISYIQKCGVQAGVAFSPETSIEFVTSFIPLCDVILLMSVHPGFCGQKFIPDTIERIQFVKQAIQVLGREGSCLIEVDGGIDKESARACREAGADILVAASYFFEKDSINMKEKVLLLQGEEHGAK

SEQ ID NO: 334 - protein, 81 aa, Chlamydia trachomatis
SPRIWFQRTLNEKVPMTTPTLIVTPPSPPAPSYSANRVPQPSLMDKIKKIAAIASLILIGTIGFLALLGHLVGFLIAPQIH

SEQ ID NO: 335 - protein, 195 aa, Chlamydia trachomatis
  VARIANT (1)...(195): Xaa = Any Amino Acid
SLHKFTNVLLALFITSLAGNALYLQKTANLHLYQDLQREVGSLKEINFMLSVLQKEFLHLSKEFATTSKDLSAVSQDFYSCLQGXRDNYKGFESLLDEYKNSTEEMRKLFSQEIIADLKGSVASLREEIRFLTPLAEEVRRLAHNQESLTAAIEELKTIRDSLRDEIGQLSQLSKTLTSAKLHYNEKRAQICVPR

SEQ ID NO: 336 - protein, 184 aa, Chlamydia trachomatis
  VARIANT (1)...(184): Xaa = Any Amino Acid
QETKFDKGIGGYMICCDKVLSSVQSMPVIDKCSVTKCLQTAKQAVVLALSLFAVFASGSLSILSAAVLFSGTAAVLPYLLILTTALLGCVYAVIVLLRSLSAVVQSCKKRSPEEIEGAARPSDQQESGGRLSXESASPQASPTSSTLRLESAFRSIGDSVSGAFDDINKDNSRSRFTLLLRDDM

SEQ ID NO: 337 - protein, 91 aa, Chlamydia trachomatis
THPRRAVVNISRYGRTAAVPLNSTAADNMDKLPEANTANKDNARTTACLAVCKHFVTEHLSITGIDCTLDKTLSQQIMYPPIPLSNFVSCH

SEQ ID NO: 338 - protein, 138 aa, Chlamydia trachomatis
EFLGGSMECVKQLCRNHLRLDNLTDPVRSVLTKGTTAEKVQLAACCLGVVCSIICLALGIAAAAVGVSCGGFALGLGIIAILLGIVLFATSALDVLENHGLVGCPFKLPCKSSPANEPAVQFFKGKNGSADQVILVTQ

SEQ ID NO: 339 - protein, 136 aa, Chlamydia trachomatis
LAPFLLTEFSSLSLLLAFALALEIFCSTSAVLQHKLFHIKVCDRCNRSLVTASVVSTPPTKAPPKRKAPTPKNKDAATTETGLQSTPENNKPATTRRAMANIVATATAANLFAVGNELLRSKHLSKRAILSTTLSC

SEQ ID NO: 340 - protein, 160 aa, Chlamydia trachomatis
VRNEIWLKSVEVRFMTKVYAHSIQQERVVDRIALLERCLDLSNSLPTAKRLAAVAVATILAIALLVVAGLLFSGVLCSPVSVVAASLFFGVGAFLLGGALVGGVLTTEAVTRERLHRSQTLMWNNLCCKTAEVEQKISRASANAKSNDKLENSVSKKGAS

SEQ ID NO: 341 - protein, 144 aa, Chlamydia trachomatis
KAAGEALLKKSAEKTRRGSSIYDYFQGYISPEILGVLFADSGVTYQETLEYRKKLVMLSKKYPKSGSLRLRLATTALELGLVKEGVQLLEESVKDAPEDLSLRLQFCKILCNRHDYVRAKYHFDQAQVFSLKRGCFPKKLPILS

SEQ ID NO: 342 - protein, 349 aa, Chlamydia trachomatis
LCLKLKQIQLCRTFVCLRHWMCFIGIGSLLLPTALRATERMRKEPIPLLDKQQSFWNVDPYCLESICACFVAHRDPLSAKRLMYLFPQLSEEDVSVFARCILSSKRPEYLFSKSEEELFAKLILPRVSLGVHRDDDLARVLVLAEPSAEEQKARYYSLYLDVLALRAYVERERLASAAHGDPERIDLATIEAINTILFQEERWRYPSKQEMFESRFSELAAVTDSKFGVCLGTVVLYQAVALAQRLDLSLDPVTPPGHIYLRYKDKVNIETTSGGRHLPTERYCECIKESQLKVRSQMELIGLTFMNRGAFFLQKGEFLQASLAYEQAQSYLSDEQISDLLGITYVLLG

SEQ ID NO: 343 - protein, 869 aa, Chlamydia trachomatis
  VARIANT (1)...(869): Xaa = Any Amino Acid
MEKFSDAVSEALEKAFELAKNSKHSYVTENHLLKSLLQNPGSLFCLVIKDVHGNLGLLTSAVDDALRREPTVVEGTAVASPSPSLHQLLLNAHQEARSMGDEYLSGDHLLLAFWRSTKEPFASWRKTVKTTSEALKELITKLRQGSRMDSPSAEENLKGLEKYCKNLTVLAREGKLDPVIGRDEEIRRTIQVLSRRTKNNPMLIGEPGVGKTAIAEGLALRIVQGDVPESLKEKHLYVLDMGALIAGAKYRGEFEERLKSVLKSVEASEGECILFIDEVHTLVGAGATDGAMDAANLLKPALARGTLHCIGATTLNEYQKYIEKDAALERRFQPIFVTEPSLEDAVFILRGLREKYEIFHGVRITEGALNAAVVLSYRYITDRFLPDKAIDLIDEAASLIRMQIGSLPLPIDEKERELSALIVKQEAIKREQAPAYQEEAEDMXXAIDRVKEELAALRLRWDEEKGLIAGLKEKKNALENLKFAEEEAERTADYNRVAELRYSLIPSLEEEIHLAEEALNQRDGRLLQEEVDERLIAQVVANWTGIPVQKMLEGESEKLLVLEESLEERVVGQPFAIAAVSDSIRAARVGLSDPQRPLGVFLFLGPTGVGKTELAKALAELLFNKEEAMIRFDMTEYMEKHSVSKLIGSPPGYVGYEEGGSLSEALRRRPYSVVLFDEIEKADKEVFNILLQIFDDGILTDSKKRKVNCKNALFIMTSNIGSQELADYCTKKGTIVASPKEAVLSVVAPALKNYFSPEFINRIDDILPFVPLTTEDIVKIVGIQMNRVALRLLERKISLTWDDSLVLFLSEQGYDSAFGARPLKRLIQQKVVTMLSKALLKGDIKPGMAVELTMAKDVVVFKIKTNPAV

SEQ ID NO: 344 - protein, 447 aa, Chlamydia trachomatis
AHLTHDEDIANQETAADLKSITFLLTSFVEEISWIQPALIALPQQVANMLLASPELQEYHFYLKKLFRLAPHTGTSREEKILASSFPALEVAYKTFCSLTDSEIPFGEAVDSEGKSHPLSHALASLYMQSTDRELRKNTYQKQCQRHHGYRLSLANLLNGKIQAHLFNAKARDYDSCLEAALFQNDISTSVVTTLIDTVKQHTHLITKYFQLKQKALGLSDFHFYDVYAPLVASEASRHYSYQEAVTLICDSLSPLGNDYVETLRKGLTSDGWVDKYENTNKRSGAYSSGCYNSKPYILLNYTGTLYDVSVVAHEGGHSMHSFLSHKHQSYHEAQYPIFLAEIASTLNETLLMEFLLKQAPSKEEKIAILSRSLDTVFATLFRQTLFAAFELEMHSAAEQGLPLTEEFFSQSYEKLQRLFYGDCITFDEHSCIESARIPHFYYNFYV

SEQ ID NO: 345 - protein, 80 aa, Chlamydia trachomatis
LLMNIAVSNRLAFLISTTTSMFNQYATGIIASLCFSERILSGEEGAQEAYLTFLRSGGSDFPIEILKKSGLDMTSISSYA

SEQ ID NO: 346 - protein, 76 aa, Chlamydia trachomatis
MSDQATTLKIKPLGDRILVKREEEASTARGGIILPDTAKKKQDRAEVVALALGTGKKDDKGQQLPFEVQVGDIVLI

SEQ ID NO: 347 - protein, 262 aa, Chlamydia trachomatis
MVAKNIKYNEEARKKIQKGVKTLAEAVKVTLGPKGRHVVIDKSFGSPQVTKDGVTVAKEVELADKHENMGAQMVKEVASKTADKAGDGTTTATVLAEAIYTEGLRNVTAGANPMDLKRGIDKAVKVVVASPQVKKISKPVQHHKEIAQVATISANNDAEIGNLIAKAMEKVGKNGSITVEEAKGFETVLDVVEGMNFNRGYLSSYFATNPETQECVLEDALVLIYDKKISGIKDFLPVLQQVALAESGRPLLIIAEDIEGEL

SEQ ID NO: 348 - protein, 224 aa, Chlamydia trachomatis
RRTLATLVVNRIRGGFRVCAVKAPGFGDRRKAMLEDIAILTGGQLISEELGMKLENANLAMLGKAKKVIVSKEDTTIVEGMGEKEALEARCESIKKQIEDSSSDYDKEKLQERLAKLSGGVAVIRVGAATEIEMKEKKDRVDDAQHATIAAVEEGILPGGGTALIRCIPTLEAFLPMLTNEDEQIGARIVLKALSAPLKQIAANAGKEGAIIFQQVMSFCERRI

SEQ ID NO: 349 - protein, 90 aa, Chlamydia trachomatis
NKLLQTQEKKVLSSSNKLCPSANEGYDALRDAYTDMLEAGILDPAKVTRSALESAASVAGLLLTTEALIAEIPEEKPAAAPAMPGAGMDY

SEQ ID NO: 350 - protein, 262 aa, Chlamydia trachomatis
MFKLIKSAFLIACCIVGYFWIKKESIVEQWLSQQLHAQVTVGNISPGLSKTKIRHLCIHNPLSSDKYPYAVEIEYVSLKYSIVTMILSKKIDISDVILQGTSLTVFPCEGSSKTNWSFFWDSFINHSNELTKFHSSQFESSVDTIPVFIKRCLCTNTRVSGIKNNYKEIPTTPVPSLEFRGSLSCSPLPTLGETARALLYLIVEESFYHANVSGDIARPLSKQARAYFNSSLSDYSYLKKRGAFPSNLTNELEGFMKELLFR

SEQ ID NO: 351 - protein, 260 aa, Chlamydia trachomatis
LQQRFFYMNVSDLLNILNELLHPEYFSDYGPNGLQVGNTQTAIRKVAVALAVTADLATIEKAIACEANVLLVHHGIFWKGMPYPITGILYQRMQRLMEGNIQLIAYHLPLDAHTTIGNNWKVARDLGWEQLESFGSSQPSLGVKGVFPEMEVHDFISQLSAYYQTPVLAKALGGKKRVSSAALISGGAYREISEAKNQQVDCFITGNFDEPAWSLAHELAIHFLAFGHTATEKVGPKALAQYLKGAGLESVVFLDTDNPF

SEQ ID NO: 352 - protein, 341 aa, Chlamydia trachomatis
  VARIANT (1)...(341): Xaa = Any Amino Acid
VCWYDFTRISMIRTAFFQDKECFPLEALRSWFLESKRSFPWRDSPTPYRVWVSEVMLQQTRAEVVVPYFLKWMERFPTLQDLAQARESDVVQLWEGLGYYSRARNLLAGARVITEIFGGEIPNDLALLSSIKGIGSYTANAILAFAFKQKNPAVDGNVLRVMSRLFAIEESIDRMNTRREITGLCESLLPDQDPQVIAESFIELGARICKKQPLCEQCPLRSFCTAYRQGTMEQYPVRNTRAAISRLFRAVVIVLYKDQVLMTKREEKEIMAGLYEFPYYQLPKEDCCDIEKIIHLVQKDYGETLHFVSSLPSQKQVFTXIALHYSHMFSTXNIVYRIATR

SEQ ID NO: 353 - protein, 278 aa, Chlamydia trachomatis
WIMQEFIGTADRHIRLSSFLRTSLPHLPKKTILESVRYHGCRVNGRIERFESYKLQPGDRVSLQIIEHSSPQLLWEDEHLCIYNKPAKQTSEDLAHQLNVHLVHRLDRDTSGCILFAKHAKASSLITQLFKNREIDKRYIALVFGQPRQESGIITTYTAPCYRRTGAVLFGNTDQNSGKITITKWEILTRYPKYTLLLCRPVTGRTHQIRLHMKTIGHPIVGDVASPYGNQEQPKNVVRTLLHAASLAFISPFSNEKIEISSLTPSQDPYPFYADFRP

SEQ ID NO: 354 - protein, 675 aa, Chlamydia trachomatis
NFLLKIKNPYKNPGVKGMSFGIGSACSSLWSRLCGSSGSEGNSEEGVTSSGSDAASGSGAASAVCQQPTSSASTEGNGPSVQIPMVGTYSANVQSLVNQGHGGRGFVNRCYQKYSASGVSLTSISIGAGDSVDGPLPSVVITQQPQGSGSSARGAGSLQMGAVLSGMSTLTGNSIFDLFGESQITNLIGDAVASPGTSTSSSPLRDATKGASTADLIALFLALGGSGSQGVNSPLVATLLSRYSLSGSLDAKKLQELLEALKKLQNDAPTSDGARPGLGECCTHLCGALSSSPNPIVSAVGIAGTGLTELLMLAAQSQRVRKCALLCHDACKPCCASACGYPSCGCADGEGGCGSFGALVCSCAELWCCQESPAEEANLEEYARKLKDLEMAVGSTTFMLGLHNLGISFSDLVKGNFTNLPTPEQLETACKDAVSSLGKLMMRITHEKWLGRLCSCAGILDNPFWKRALCSGLAGGTHMLSLQDLTSRVKVITSSGNKQEAENLDLELLLPALSSLQVTGTEEDCDDEGQGLNTDQLTMLLCKFCSVLSAAIGNDRRPIWLTPKQITEILCVCMVMSGISIVGGPSNQSAEYQEFQNTVMQESLTHLQSSLRVSKRTNNRTRAEVRKLVVKYEAQSSFLSLLEGLRDPNSKESKDLMRECFASWAQKAGVQSSSI

SEQ ID NO: 355 - protein, 287 aa, Chlamydia trachomatis
LMLKIDLTGKIAFIAGIGDDNGYGWGIAKMLAEAGATILVGTWVPIYKIFSQSWELGKFNASRELSNGELLTFAKIYPMDASFDTPEDIPQEILENKRYKDLSGYTVSEVVEQVKKDFGHIDILVHSLANSPEIAKPLLDTSRKGYLAALSTSSYSFISLLSHFGPIMNAGASTISLTYLASMRAVPGYGGGMKPAKAALESDTKVLAWEAGRRWGVRVNTISAGPLASRAGKAIGFIERMVDYYQDWAPLPSPMEAEQVGAAAAFLVSPLLAQLREKLSMWITEPM

SEQ ID NO: 356 - protein, 298 aa, Chlamydia trachomatis
MSLQKLLVTDIDGTITHQSHLLHDRVVKALHQYYDSGWQLFFLTGRYFSYAYPLFQNFSVPFLLGSQNGSSVWSSTDKEFIYFRSLSRDFLCVLEKYFEDLDLIACIESGASNRDVYFRKGLGKTSQELKAILDAVYFPTPEAARLLVDVQGHLSEEFSYEDFAIAKFFGEREEVKKIMDRFIQSPEVSSQVTMNYMRWPFDFKYAVLLLTLKDVSKGFAVDQVVQTFYKENKPFIMASGDDVNDIDLLSRGDFKIVIQTAPEEMHGLADFLAPPAKDLGILSAWEAGELRYKQLVNP

SEQ ID NO: 357 - protein, 163 aa, Chlamydia trachomatis
DPARKRSFMLRLFQHILCFLEEVPSFVDVLQELSFVNEAFSGSMRWEVGKMLGSLLLLLGIFGGGCLLFRRFLRSRGHLPSGNSSIKILDQRVLASKTSIYVIKVANKTLVVALAERGERVTLLSEFPPNTDLNELIQKDQKKPSTSRGEMLSGFLKQFKEKK

SEQ ID NO: 358 - protein, 135 aa, Chlamydia trachomatis
VHGSFRCRTIFRKLSIMFGVGIDIIEIDRIRKSYQTYGDRFLKKIFTEGERVYCFSKSNPYASLAARFAAKEAVAKALGTGIGKLLKWKEIEMRRDSRQPQVVVPEALLCSLGVKRVLLSVSHSREYATAVAIAE

SEQ ID NO: 359 - protein, 183 aa, Chlamydia trachomatis
VLAKGRNTCAVCDGASPIFRDKDLFVVGGGDSALEEAMFLTRYGKRVFVVHRRDTLRASKVMVNKAQANEKIFFLWNSEIVKISGDTLVRSIDIYNNVDKTTTTMEAAGVFFAIGHQPNTAFLGGQVALDENGYIITEKGSSRTSVPGVFAAGDVQDKYYRQAITSAGSGCMAALDVERFLEN

SEQ ID NO: 360 - protein, 194 aa, Chlamydia trachomatis
MNVVCGKSRVGYSSFFCKSREPFSCVFKALLSKFILGVLMTHAKLVIIGSGPAGYTAAIYASRALLTPVLFEGFFSGIAGGQLMTTTEVENFPGFPEGVLGHQLMDLMKTQAQRFGTQVLSKDITAVDFSVRPFVLKSGEETFTCDACIIATGASAKRLSIPGAGDNEFWQKGVTLALFVTEPLPFFVTKICLL

SEQ ID NO: 361 - protein, 569 aa, Chlamydia trachomatis
MPKQADYTWGAKKNLDTIACLPEDVKQFKDLLYAIHGFTATEEEPTSEVHPGAILKGTVVDISKDFVVVDVGLKSEGVIPMSEFIDSSEGLTVGAEVEVYLDQTEDDEGKVVLSREKATRQRQWEYILAHCEEGSIVKGQITRKVKGGLIVDIGMEAFLPGSQIDNKKIKNLDDYVGKVCEFKILKINVDRRNVVVSRRELLEAERISKKAELIEQITIGERRKGIVKNITDFGVFLDLDGIDGLLHITDMTWKRIRHPSEMVELNQELEVIILSVDKEKGRVALGLKQKEHNPWEDIEKKYPPGKRVRGKIVKLLPYGAFIEIEEGIEGLIHVSEMSWVKNIVDPNEVVNKGDEVEVVVLSIQKDEGKISLGLKQTKHNPWDNIEEKYPIGLRVTAEIKNLTNYGAFVELEPGIEGLIHISDMSWIKKVSHPSELFKKGNTVEAVILSVDKESKKITLGVKQLTPNPWDEIEAMFPVGSDISGVVTKITAFGAFVELQNGIEGLIHVSELSEKPFAKIEDVLSIGDKVSAKVIKLDPDHKKVSLSIKEFLAHGGDAGHDAEEESSDRD

SEQ ID NO: 362 - protein, 226 aa, Chlamydia trachomatis
VKSKHKSRALGLCSVSIIFFAFFPLPIRGVLMNKDLVAIFDYMEREKGIQRSTIVGAIESALKIAAKKTLRDDANVSVSINPRTGDIEVFCEKQIVEKCQNPSKEIPLDKAREYDPDCQIGQYMDVPFISDQFGRIAAHAARQIIGQKLRHAERDVIYEEYRHRKNEIISGVVKSFARGANLVVDLGKVEGLLPARFYPKTEKHKVGDKIYALLYEYRNLKMVELK

SEQ ID NO: 363 - protein, 256 aa, Chlamydia trachomatis
DLCASLRVQESENGGAEVILSRSHPEFVKQLFVQEVPELEEGSVEIVKIAREAGYRTKMAVRSSDPQTDAVGAFVGMRGSRIKNIIRELNDEKIDVVNYSPVSTELLQNLLYPVEIQKIAILEDDKVIAIIVQDSDYATVIGKRGINARLISQILGYELEVQRMSEYNKLLEIQRLQLAEFEDPRLDQPLEVEGINTLIVQNLEHAGYDTIRKILLASASELASVPGISLELAYKILEQVSKYGEGKVDEKPQVED

SEQ ID NO: 364 - protein, 903 aa, Chlamydia trachomatis
  VARIANT (1)...(903): Xaa = Any Amino Acid
LNRSANMEKAKLTKNLKXKIKNAQLTKAXGLDKLKQKLAQAGSSDTKNSPASKAQTKEKSSKKTAGTPAPAPEVDLGATESTARRIRAKDRSSFAAEPTVTTALPGDASHLTLDAIPAIKAPEITSVTQKEQTLRECTDTSSVQQEEKKESSEETSPETPERIEETPIIRTRTEPKSVVSIKPKFGPTGKHINHLLAKTFKAPAKETKAASTEETTQQQPRQNDAASHNNKQQPSGTSSRPASSAPSYRRESTSNNNNNAKRGSERDRSKRSDESVKAFTGRDRYGLNEGSSEEDKWRKKRVHKTKKQAEEHVVQCPAHIKIALPITVKDLAAEMKLKASELIQKLFIHGMTYVVNDVLDSQTVVEYIGLEFGCTIEIDSSAKEKLCLVENTVRDEVNATDPEKLIIRSPIVAFMGHVDHGKTTIIDALRQSNMAASEAGAITQHTGAFKCTTPVGEITVLDTPGHEAFSAMRARGAEVCDIVVLVVAGDEGIKEQTIEAIEHAKGANITIVVAINKCDKPKLQCRNSVPSVSRIRSLLPEAWGGSIATINTSAKTGEGLQDLLEMLALQAEVLELKADPSARARGLVIESELHKGLGAVATVLVQNGTLHLGEALVFNDCYGKVKTMHDEHNQLLQSATPSTPVLITGLSAIPKAGDPFIVVKNEKVAKEIISARLAGQQRSAALQKKRPNFDAVLQNKKTLKLIIKADVQGSIEALAHSILNIRSEKVDVEILSSGVGDISESDIRLASASKATVIGFHTSVESHAEPLIKNLNVKVCLFDIIYHAVDAIKEIMTGLLDPIAEEKNLGAAEIKATFKSSQLGTIYGCLVTEGTVVRNQKIRIIRDKEVLWKGSLSSLKRLKEDVKEVKKGMECGILLDNYQQAQVGDILQCYEVIYHPQTL

SEQ ID NO: 365 - protein, 123 aa, Chlamydia trachomatis
MAENRRMKKVNAMLREAIAKVILKDVKHPKISNRWITITRVSLSRDLQSACVYVSIMPHENSQEETLAALKASAGFIAFQASKDLVLKYFPDLNFYVEDIFSPQDHIESLLLKIAEQDKKTNP

SEQ ID NO: 366 - protein, 241 aa, Chlamydia trachomatis
MELATESIEGVLLVDKPQGRTSFSLIRSLVRLIGVKKIGHAGTLDPFATGVMVMLIGRKFTRLSDIMLFEDKEYAAVAHLGTTTDTYDCDGKIVGRSKKVPTMDEVLTCTSYFQGEIQQVPPMFSAKKVQGKKLYEYARQGLSIERRFATVTVNLRLVKYEYPRLHFVVQCSKGTYIRSIAHELGNMLGCGAYLEELRRLRSGSFSIDQCIDGNLLDEPEFNVSPYLRDANGLILQPAPVL

SEQ ID NO: 367 - protein, 307 aa, Chlamydia trachomatis
  VARIANT (1)...(307): Xaa = Any Amino Acid
MYLLIYVMQMDLFYSLLPSSNPIESVTIGFFDGCXLXHQALLSFLTKFPGKSGVITFSQHPEHTLSNSPPETITSLEERIQLLAGCGIDYLAVLPFNQEIANQEAELFIQSIYKTLHPSRIVLGYDSRLGKGGLGTAQTLRPFAASLGISLEEVPPLQIEGTIVSSRKIRQFLREKDLCSAEKFLGRPFAYTGKVAHGRGIGTSFGYATINLPLTHSLLPLGVYTCTIVIEGFSYAGVMNLGMAPTMQRHQLCLEAHILDFSEDLYDKSITVILEQFLREEKLFSSKDELVLAIQEDIRQARLNKNR

SEQ ID NO: 368 - protein, 348 aa, Chlamydia trachomatis
MKMGQTECGIVGLPNVGKSGLFNALTGAQVASCNYPFCTIDPNVGIVPVIDPRLETLARISQSQKIIYADMKFVDIAGLVKGAASGAGLGNRFLSHIRETHAIAHVVRCFDNDDITHVSGKIDPEEDIAVINLELVLADFSSATSVREKLGKQAKGKKDIGQLLPLLDRVVDHLESGNPVRTLSLSLEEKVLLKPYPFLTGKPMLYIANIDEDSLTDLDNPYVQKVREIAKREEANVVPICVKLEEEILSLPLEERQDFLHSLGLQESGLNRLVASAYHTLGLISYFTTGPQETRAWTISKGVTAAEAAGEIHSDIQRGFIRAEVVTMEDIVAYDGRAGAREAGKLRA

SEQ ID NO: 369 - protein, 362 aa, Chlamydia trachomatis
MGEKTEKATPKRLRDARKKGQVAKSQDFPSAITFIVSMFLTFSLASFFAEHLGSFLVSIFKTAPQNHDPHLAIYYLKNCLILILTVSLPLLGAVGFVGLLIGFLIVGPTFSTEVFKPDLKKFNPIDNLKQKFKVKTFIELLKSIFKISGAALILYIVLKNRVELVIETAGVPPLVTAQVFKEILYKAVTSIGLFFLVVAVIDLVYQRHSFAKELKMEKFEVKQEFKDTEGNPEIKGRRRQIAQEIAYEDTSSQIKHASAVVSNPKDIAVAIGYMPEKYKAPWIIAMGVASNLRAKRIIAEAEKYGVPIMRNVPLAHQLLDEGKELKFIPETTYEAVGEILLYITSLNAQNLENKNINQFDNL

SEQ ID NO: 370 - protein, 130 aa, Chlamydia trachomatis
MNKLLNFVSRTFGGDAALNMINKSSDLILAMWMLGVVLMIILPLPPAMVDFMITINLAISVFLLMVALYIPSALQLSVFPSLLLITTMFRLGINISSSRQILLHAYAGHVIQASETSSLEETMSLDLLSS

SEQ ID NO: 371 - protein, 616 aa, Chlamydia trachomatis
HFFLPTNSPSCLCWSRDPSFGDFVVGGNYVVGFIIFLIITIIQFIVVTKGAERVAEVAARFRLDAMPGKQMAIDADLRAGMIDATQARDKRSQIQKESELYGAMDGAMKFIKGDVIAGIVISLINIVGGLVIGVTMKGMTMAQAAHIYTLITIGDGLVSQIPSLLISLTAGIVTTRVSSDKDTNLGKEISSQLVKEPRALLLSAGATLGIGFFKGFPLWSFALMAVLFAVLGILLITKKNSPGKKGGASSTTTVGAADGAAASGENSDDYALTLPVILELGKDLSKLIQQRTKSGQSFVDDMIPKMRQALYQDIGIRYPGIHVRTDSPSLEGNDYMILLNEVPYVRGKIPPNHVLTNEVEENLSRYNLPFITYKNAAGLPSTWVSTDALTILEKAAIKYWSPLEVIILHLSYFFHRNSQEFLGIQEVRSMIEFMERSFPDLVKEVTRLIPLQKLTEIFKRLVQEQISIKDLRTILESLSEWAQTEKDTVLLTEYVRSSLKLYISFKFSQGQSAISVYLLDPEIEEMIRGAIKQTSAGSYLALDPDSVNLILKSMRMTITPTPPGGQPPVLLTAIDVARGRYVRKLIETEFPDIAVISYQEVLPEIRIQPLGRIQIF

SEQ ID NO: 372 - protein, 423 aa, Chlamydia trachomatis
  VARIANT (1)...(423): Xaa = Any Amino Acid
MTASGGAGGLGSTQTVASPVARAQAAAATQDAQEVIGSQEASEASMLKECEDLINPAAATRIXKKEEKFESLEARRKXTADKAEKKSESTEEKGDTPLEDRFTEDLSEVSGEDFRGLKNSFDDDSSSDEILDALTSKFSDPTIKDLALDYLIQIAPSDGKLKSALIQAKHQLMSQNPQAIVGGRNVLLASETFASRANTSPSSLRSLYFQVTSSPSNCANLHQMLASYSPSEKTAVMEFLVNGMVADLKSEGPSIPPAKLQVYMTELSNLQALHSVDSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDAINADNEDYPKPGDFPRSSFSSTPPHAPVPQSEIPTSPTSTQPPSP

SEQ ID NO: 373 - protein, 146 aa, Chlamydia trachomatis
MQNQFEQLLTELGTQINSPLTPDSNNACIVRFGYNNVAVQIEEDGNSGFLVAGVMLGKLPENTFRQKIFKAALSINGSPQSNIKGTLGYGEISNQLYLCDRLNMTYLNGEKLARYLVLFSQHANIWMQSISKGELPDLHALGMYHL

SEQ ID NO: 374 - protein, 388 aa, Chlamydia trachomatis
MPSLSQSRRIIQQSSIRKIWNQIDTSPKHGVCVPLFSLHTQESCGIGEFLDLIPMIDWCISCGFQILQILPINDTGSCSSPYNSISSIALNPLHLSISALPYKEEVPAAETRIREMQQLSQLPQVHYEKVRSMKRDFFQEYYRVCKQKKLTDHPDFYAFCEQEKYWLHPYALFRSIREHLDNLPINHWPTTYTDLSQITEHERTFAEDIQFHSYLQYLCFQQMTQVREHANCKSCLIKGDIPILISKDSCDVWFYRHYFSSSESVGAPPDLYNAEGQNWHLPIYNMKTLQQDNYLWWKERLRYAENFYSLYRLDHIVGLFRFWVWDESGCGRFEPHDPKDYLAQGQDILSHLLTSSSMLPIGEDLGTIPSDVKRMLESFAVCGTRIPR

SEQ ID NO: 375 - protein, 106 aa, Chlamydia trachomatis
LLQLPCREIAASEYRKVMSKKCALTGRKPRRGYSYAIRGISKKKKGIGLKVTGRTKRRFFPNMMTKRLWSTEENRFLKLKISAAALRLVDKLGLDQVVARAKSKGF

SEQ ID NO: 376 - protein, 538 aa, Chlamydia trachomatis
YDVFSLRSLVDYLRSQHELIDIHVPVDPHLEIAEIHRRVVEREGPALLFHQVKGSPFPVLTNLFGTRRRVDLLFPDLSSDLFEQIIHLLSSPPSFSSLWKHRSLFKRGISALGMRKRHLRSSPFLYQDAPNLSQLPMLTSWPEDGGPFLTLPLVYTQSPENGVPNLGMYRMQRFDKETLGLHFQIQKGGGAHFFEAEQKKQNLPVTVFLSGNPFLILSAIAPLPENVPELLFCSFLQNKKLSFVEKHPQSGHPLLCDSEFILTGEAVAGERRPEGPFGDHFGYYSLTHDFPIFKCNCLYHKKDAIYPATVVGKPFQEDFFLGNKLQELLSPLFPLIMPGVQDLKSYGEAGFHALAAAIVKERYWKEALRSALRILGEGQLSLTKFLWITDQSVDLENFSSLLECVLERMNFDRDLLILSETANDTLDYTGSGFNKGSKGIFLGVGAPIRSLPRRYRGPSLPGISQIGVFCRGCLVLETSLQQLDIPALLKDPHLADWPLVILVEDLSSALSSTKEFIWENIYTIFSCNRFTHPCKSNH

SEQ ID NO: 377 - protein, 137 aa, Chlamydia trachomatis
  VARIANT (1)...(137): Xaa = Any Amino Acid
NEKNKTLISKIMFSLVSLFVGGFLLKAPAPTQSADTFQTLIESKEPVIFTKQCGDNVTQILCDAIDSAKKDIFLXIYDLSAPAITTSLKKQVSARIPVCIHYQRISKNAEFSQSPYLTPWENILPCTENSCIKKLWQ

SEQ ID NO: 378 - protein, 197 aa, Chlamydia trachomatis
KAQKFVILLKRKPLVGALLTINSSSIVSFDGGSSAALETVLHHIRSAKESIQVGMFALTLPQIIAELNAAQNCGVDVVILVDKGYKSFTVQQIKQLEHPSLSIYEKVTPYQLHHKFGIFDKKTLITGSVNWSENGFLINTEDMIVIENLTEKQQSKIQAIWEGLVRECALYYSPDQEEKEKDPLIIPFPPSEKKQAA

SEQ ID NO: 379 - protein, 171 aa, Chlamydia trachomatis
NERNRGCRRRFMRIIPFDPYGSMAFQAIAKDPQERKNGSISEKISEEIARNEALRMALLAIADQEDKEKKQKHRFKILTKKQTRMLLGQLRHFRLDFQKLQAGVVIEWSWDDKSKRSKSLGSRITRKSKKTICISAAAAQAIAHAAEAWVIARNEGILEMTLSLFQHKDNE

SEQ ID NO: 380 - protein, 565 aa, Chlamydia trachomatis
EKIMSISGSGNVSPATPDFDPSILMGRQAASAHAAKEASGASKATETSAAEQQALISSGTELDYVTDLQQSEGKYKKTLDKTSKSPKTKLKGNFSKVRAGTKGFLTGFGTRASRISARKAENNGEGMSMIPSQMEYVKKKGNRVSPEMQNFYLGASGLWSPTSDVSSKTENRLGATALSTTPSLTTMQDPVSIEHLSSGEITALASFNPNVRAASLNEQTINAWTEARLGGEMVSTLLDPNIETSSLLRRAPTVSNEGMVDVSDMGNQTTSLSMEGLVNTVVDDPASAEEEKKTGELSLEEMAAMAKMMAALLSSGQGMAVFIASSTPSSGSTQFPEPKFSGTIPHHFSKKEDNETIWGLDSQIGSIAFDTRRENNASPLPTTSLHEEASYRFPVGEAPLDVNEIPFAVQHSTVFSEETANTEQALIQNESLGEIPVSAEVVGQDTVSSAYQFPSHLGMAVLASVPLSTEDYKTAVEHRKGPGGPPDPLIYQYRNVALAVDPAIIFQSPSPFSVSSRFSVQGKPEAVAVYNDDQEEAAGGNRDSDEGKDQEQDKTRETEDAGGDS

SEQ ID NO: 381 - protein, 105 aa, Chlamydia trachomatis
NKLFWFLLMKKRSSRKLAQVIGRKTGNYFPASIEGETKKEHKRYYSTASKEKESLRKRAKEFDVLVHSLLDKHVPQNSDQVLIFTYQNGFVETDFHNFGRYSVKL

SEQ ID NO: 382 - protein, 295 aa, Chlamydia trachomatis
NHLTKYLCMLLKGAPAADHILATIKENIRACSKAPGLAVVLIGNNPASEIYVNMKIKRATDLGMVSKSYRKPSDATLSDILALIHQLNNDENIHGILVQLPLPKHLDAQAILSTITPDKDVDGLHPVNVGKLLLGETDGFIPCTPAGIVELCKYYEIPLHGKHVVILGRSNIVGKPLAALLMQRHADTNASVTLLHSQSEHLTEITRTADILISAIGVPLFVNKEMIAEKTVIMDVGTSRIPAANPKGYILVGDVDFNNVVPVCRAITPVPGGVGPMTVAMLMRNTWESFLRHTS

SEQ ID NO: 383 - protein, 141 aa, Chlamydia trachomatis
QCCTCLPSHYSCPWWSRPNDRRYANEKYMGKFFASYLLILAPFFLQSCSAPSRTTLEGVRMTIPYRIVFGEALSPDAFQQAQKEIDRVFDHIDQTFNNWNPLSEISRINRTTKQTPIPLSPALFAFLCEIDHFHAFSDGRF

SEQ ID NO: 384 - protein, 129 aa, Chlamydia trachomatis
TISTPSLMAVFDPTLGALKSLWLLHLKSHTIPSQELQHLYKHSSGWHLISLDKTQQTLRKLSPLVQLDLCGTVKGFAVDLLGTACAQFCQNYYVEWGGEIKTRGKHPSGRSWLSLHQLPQRFFICMIML

SEQ ID NO: 385 - protein, 123 aa, Chlamydia trachomatis
QEQKLNSLRDHGGNLGDAYVTISKGEAWLLQSSIAPYRFGNINNHEERRKRKLLLHKYEIHKLDARISQKGLTVVPLSFFFSKGFVKVRIGCCRGKKAHDKRQSIIEREKNRELAAAMKRSCR

SEQ ID NO: 386 - protein, 428 aa, Chlamydia trachomatis
LSLIIILISKYHVNFRLHGAFSNPSFVKIFFTKASPERRLTCFHVTKHGYSFQTDLHDYRKIMKFVISRNELGNLIKKVQNVVPQSTPIPVLTHVLIESCNDELVFTATDLTVSTRCVVKAKVYESGSVTIPSRRFFQLIRELTEANIEVAAHSGEMATITSGSSCFRLLSMGKEDFPMLPDMQNALRFTLDSERLKDMFQRTSFAVSREESRYVLTGVLLSIANGTMTVVGTDGKRLAKIDTEISLDPSFSGDYIIPIKAVEEIIRMSSEDVQSTIFLDQTKIAVECGNTLLVTKLLSGEFPDFSPVISTHSSVQLDLHREELISLLKQVALFTNESSHSVKFSFSPGELTLTANCTKVGEGKVSMAVNYTGETLEIAFNPFFFLDILKHSRDELVQLGISDSYNPGIITDSTRSLFVIMPMRLHDD

SEQ ID NO: 387 - protein, 365 aa, Chlamydia trachomatis
MRVLSLFLKDFRNYTDLRLELGPEMNSIFGLNAQGKTNLLEALYILSLGRSFRTSRLTDAIRFGASHFFIEAVFSHKEVFHTLSIQVDKKGKKILFDGAPITKLSELVGLFPVILFSIKDIAIIEGSPSERRRFLDLLLAQASDKYTEHISLYHKALDQRNASIKAQNQKAISAWNSPLIAYGSLVAFLRNECTKKLNTIFQTLWDNTLKETLSLRYESSLITEESPTLNDIASNYYEQLRIANTKDLDLGYTMVGPHRDELLLTINDLPVAKFSSEGQKHSLLAVLRFAECVYLQEEFCIHPLLCMDDIHACLDQQRLDQLLQLSNSLGQVVTTSTICPDHRSTTSCIFHVTQAQVSLVAPQSL

SEQ ID NO: 388 - protein, 335 aa, Chlamydia trachomatis
NNINRCCEMKNFLLTILFLLMGTSLLADPSVIQTLTSGVAGVNSIREEKESVVCVHAFLRSYGSLKPIGRVLEKENYDVFIWNYETRKFTLEKHAEHLVRLLNKIAELKPGIPINFVTHSVGGVIVRVALALAHPDCPEEAKKGKAVLMAPPNAGSTLARRYSRSSLVQFVFGRKLGMQLLTYSPEHMLNIAKMPSSVDVLVLSGTKKSKFLLFQLEEDNDGKVCVTETRLDTPHQNYIIDANHTYIITNKTSLFLMREFLRNGSRSSALTQVPEEIEASIQQSPKAKVNKEKSKDIYVIHCLGAHPYSLYGFPKSRTSPNENSRKVLEGQEYKK

SEQ ID NO: 389 - protein, 99 aa, Chlamydia trachomatis
WLSGPVGIVRILHTGWSVGIPEALAWIGLISVASNLAVLNLLPIPVLDGGYILLCLWEILSRRRLNMRLVEKALVPFMILLVLFFVFLTLQDLSRVFVG

SEQ ID NO: 390 - protein, 422 aa, Chlamydia trachomatis
VALEADFCFSRRPLANLLVAIFVFGILYFSGGRTKSFSEHTSIVGWVHPSLEQQGLHAGDQIFFCNGQPYSGHKMAFSSSLLERKLSLQGQHPAYFSESEAFSLEAPFNPDMEGVPCLGASYLLYRGSDPLPEKSPLVDAGLSEGDRLVWMDGLLVFSGAQVSQMLNEKQSFLRVERQGKVVFVRQARVLAGDLTLTPYFKNELIDCQYEAGLKGKWASLYMLPYIINGDGFVESKVKLLNERVSLDYNLELGDKIVAVDGIPVMSNADILRLVQDHRVSLIFQRMSPEQLTVLEQKAADQAFINSYDMDDLLRVAESVGEEREVSRLGDYRLVTRVQPRPWAHIYSEALLDKQRALASKFRDEQERRYYLERIEAENQRISLGIPLRSSRSVQSGSLGIDGGIRFRQLKDCESLGDGAGEP

SEQ ID NO: 391 - protein, 110 aa, Chlamydia trachomatis
MTIIYFVLAALALGFLILIHELGHLLAAKAVGMSVESFSIGFGPALVRKKIGSVEYRIGAIPFGGYVRIKGMDRNDKDNSGDKEKTVYDIPEGFFSKSPWKRIFVLAAGL

SEQ ID NO: 392 - protein, 384 aa, Chlamydia trachomatis
LLKHLALIGSTGSIGRQVLQVVRSIPDTFIIETLAAYGRNQEALISQIREFNPRVVAVREETTYKELRKLFPHIEILLGEEGLVSVATEPSVTITIVASSGIDALPAVIAAIRQKKTIALANKESLVAAGELVTTLARENGVQILPIDSEHNALFQCLEGRDSSTIKKLLLTASGGPLRNKSKEELQKVSLQEVLRHPVWNMGPKITVASPSSTLVNKGLEIIEAFWLFGLEAVEIEAVIHPQSLVHGMVEFCDGTILSVMKPPSMLFPIQHVLTFPERSPAIGPGFDFLSNRTLEFFPIDEDRFPSVHLAKRVLLEKGSMGCFFNGANEALVHRFLAGEISWHQIVPKLQALVASPQHRVQSCLSLEEILSVDAEARARAQEC

SEQ ID NO: 393 - protein, 167 aa, Chlamydia trachomatis
GWITASISTASSPNSQKASIISKPLFTKVEESTVILGPIFQTGCRKTSCKETFCNSSFDLFLNGPPEAVNNNFLMVEESLPSKHWKSALCSLSMGRICTPFSLAKVVTNSPAATNDSLLAKAIVFFCRIAAMTAGKASIPDEATMVIVTEGSVATETNPSSPKRISI

SEQ ID NO: 394 - protein, 167 aa, Chlamydia trachomatis
  VARIANT (1)...(167): Xaa = Any Amino Acid
GPSLSLVMRXFTKTDILPIFLVLLINLGISYCFFSSFVCVSFDTIFAFSLGIRVRLVDYLVMLLLSASIVGAFKAVGVLMSLAFLLIPGLIAKLIASSVQEMMVYSMVFGGLAALIAPALSRSILSVYGIGLSTSGLAVGLLLVFYVVMLVFVCSKRAIMLRQKLDK

SEQ ID NO: 395 - protein, 162 aa, Chlamydia trachomatis
  VARIANT (1)...(162): Xaa = Any Amino Acid
MVASISPYYGVSFLEFFLVFFSRLFSGKLFYDHLYIDDIQVIVFFAIAVSCSVVGTFLVLKKMAMYANVVSHTILFGLVCVCLFTHQLIHLSMQALTIAAVSTTLLTGASIHFLRNVFKVAEEASTALVFSLLFSASLLLLVFLTRNAHVGTELVIGNADXY

SEQ ID NO: 396 - protein, 145 aa, Chlamydia trachomatis
LFSRDEEHLLKIFWYLREQNTYQVGVRDFVRSRKYQEYFGDKVFPRFRMFLLCKKGLVSCSEHQWSLTDKGLARAAKLVRAHRLWESYLVSQLGFNKNEVHHFAEEMEHVLTDELDSTLSQMLQDPDYDPHQREIPKRTRKSDGC

SEQ ID NO: 397 - protein, 311 aa, Chlamydia trachomatis
MLSCIFQDTIFLSSFLAVSLICMTTALWGTILLVERQPLLSESLSHACYPGLLIGALLSYKVPAFSDSLWVIIFFGCLASVLGCLGISFLEKKLAMHKDSALCLVLVSFFGVGVILVSYVKDCCPLLYNKINAYLYGQAATLGYTEAKLALIIFCLSAVVLWWWYRQISVAIFDREFAYSCGLRTRTAELVVLVFISLVIVSGVRSVGILLISAMFVAPPLSARQLSDRLSTILILSSIFGGICGALGCYFSVAFTCQTVVEGKPISIILPTGPLVVFFAGVLVFLCLIFSWKTGWITRYFRRKMVLIFSR

SEQ ID NO: 398 - protein, 261 aa, Chlamydia trachomatis
LFLNRDNAIAWSVEDLCVNYDHSDVLCHITFSLPAGDLAAIIGPNGAGKSTLLKASLGLIRASSGQSLFFGQRFSKAHHRIAYMPQRASVDWDFPMTVLDLVLMGCYGYKGIWNRISTDDRQEAMRILERVGLEAFANRQIGKLSGGQQQRAFLARSLMQKADLYLMDELFSAIDMASYQMVVDVLQELKSEGKTIVVIHHDLSNVRKLFDHVILLNKHLVCSGSVEECLTKEAIFQAYGCELELLDYTLKLSRGKYQGSC

SEQ ID NO: 399 - protein, 348 aa, Chlamydia trachomatis
LSLRGSYTFSKYGPRIDYLEALMSFFHTRKYKLILRGLLCLAGCFLMNSCSSSRGNQPADESIYVLSMNRMICDCVSRITGDRVKNIVLIDGAIDPHSYEMVKGDEDRMAMSQLIFCNGLGLEHSASLRKHLEGNPKVFDFGQRLLNKNCFDLLSEEGFPDPHIWTDMRVWGAAVKEVAAALIQQFPQYEEDFQKNADQILSEMEELDRWAVRSLSTIPEKNRYLVTGHNAFSYFTRRYLSSDAERVSGEWRSRCISPEGLSPEAQISIRDIMRVVEYISANDVEVVFLEDTLNQDALRKIVSCSKSGQKIRLAKSPLYSDNVCDNYFSTFQHNVRTITEELGGTVLE

SEQ ID NO: 400 - protein, 99 aa, Chlamydia trachomatis
LTITINKAKTTICRTRLPTKELFMATAQITIQEEIEQLITKAISKVGGSKENDLCRYLPGPTGGYMHHFTLKKMKNSAPEQLLKNVKDVCDRFYHSQIH

SEQ ID NO: 401 - protein, 529 aa, Chlamydia trachomatis
  VARIANT (1)...(529): Xaa = Any Amino Acid
NMTQTAEKPFGKLRSFLWPIHMHELKKVLPMFLMFFCISFNYTILRDTKDTLIVTAPGSGAEAIPFIKLWLVVPSAVVFMLIYAKLSNILNKQALFFAVLSPFVVFFALFPVVIYPCRHILHPTAFADTLQSILPSGFMGFIAMLRNWTFAVFYVLSELWGSVMLSLMFWGFANEITKISEAKRFYALFGVGANVALLISGPAIIWSSKLRASLGEGVDPWGVSLYFLMAMFLCSCAIIAACYWWMNRYVLTDPRFYNPAELKAKKSKPKMSMGESFSYLLRSPYMLLLALLVICYGICINLVEVTWKSQLKMQFPNPNDYSAFMGNFSFWTGVVSVFVMLFIGGNVIRRFGWLTGALVTPIMVLVTGAVFFALVIFRDHATGLVAALGTTPLMLAVVVGAIQNILSKSTKYALFDATKELAYIPLDQEQKVKGKAAIDVVAARFGKSGGSLIQQGLLVVCGSIGAMTPFLAVALFAIIMVWLTSATKLNKLFLAASAAKEQELXEAAAAEKEASSAAKESAPAIEGVS

SEQ ID NO: 402 - protein, 395 aa, Chlamydia trachomatis
TRLKTLKPYKIENIRNFSIIAHIDHGKSTIADRLLESTSTIEQREMREQLLDSMDLERERGITIKAHPVTMTYEYEGETYELNLIDTPGHVDFSYEVSRSLAACEGALLIVDAAQGVQAQSLANVYLALERDLEIIPVLNKIDLPAAQPEAIKKQIEEFIGLDTSNTIACSAKTGQGIPEILESIIRLVPPPKPPQETELKALIFDSHYDPYVGIMVYVRVISGEIKKGDRITFMATKGSSFEVLGIGAFLPEATLMEGSLRAGQVGYFIANLKKVKDVKIGDTVTTVKHPAKEPLEGFKEIKPVVFAGIYPIDSSDFDTLKDALGRLQLNDSALTIEQESSHSLGFGFRCGFLGLLHLEIIFERISREFDLDIIATAPSVIYKVVLKNGKTLFI

SEQ ID NO: 403 - protein, 228 aa, Chlamydia trachomatis
RYLQSRLKKWQNPFYLITQQHILTQLLLNTWKSLGSIVNIITPQEYLSNIMSLCMDKRGICLKTDMLDQHRLVLSYELPLNEIVSDFNDKLKSVTKGYGSFDYRLGDYKKGAIIKLEILINDEAVDAFSCLVHRDKAESKGRSICEKLVDVIPPQLFKIPIQAAINKKIIARETIRALAKNVTAKCYGGDITRKRKLWDKQKKGKKRMKEFGKVSIPNTAFVEVLKME

SEQ ID NO: 404 - protein, 160 aa, Chlamydia trachomatis
FEDVREALYAAKIISYAQGFMLLKQVSQDKGWDLNLGELALIWRGGCIIQSAFLDKIHQGFENSPEAHSLILQDYFKKVLFDSETGFRRAVLHAIGSGVAIPCLSSALSFYDGYRTVDSPLFLVQGLRDYFGAHGYERRDCPRGEFYHTDWLETKKTFRA

SEQ ID NO: 405 - protein, 322 aa, Chlamydia trachomatis
  VARIANT (1)...(322): Xaa = Any Amino Acid
EGSVAPNTDIGLIGLAVMGKNLVLNMVDHGFSVSVYNRSPAKTEEFLKDHGESGALQGFTTIQEFVQSLKRPRKIMIMIKAGAPVDEMIASLLPFLEEGDILIDGGNSYYLDSERRYVDLKKEGILFVGMGVSGGEEGARKGPSIMPGGNIDAWPAIAPIFQSIAAQVGGRPCCSWIGTGGAGHFVKAVHNGIEYGDIQLICETYEILKTRLNLSLEQIGNIFFEWNQTDLNSYLLGAAAAVLIAKDENGNAIASTILDVAGQKGTGRWVAEDAIKAGVPMSLIIESVLARYLSTWKEVRTKAAQEFPGFLFXVNLHKKLLP

SEQ ID NO: 406 - protein, 451 aa, Chlamydia trachomatis
  VARIANT (1)...(451): Xaa = Any Amino Acid
IFMQQLIDNLKKRGILDNSSAGLESLTVPVSAYLGFDPTAPSLHIGHWIGICFLRRLAAYGITPVALVGGATGMIGDPSGKSVERSLLDQAQVLDNSKKIAAALASYLPGIRIVNNADWLGSLSMVDFLRDVGKHFRLGSMLAKDVVKQRVYSEEGISYTEFSYLLLQSYDFAHLFKEHNVVLQCGGSDQWGNITSGIDYIRRRGLGQAYGLTYPLLTDSKGKKIGKTESGTIWLDPALTPPYELFQYFLRLPDQEISKVMRTLTLLDNEEVFALDERLTSDPQAVKXYIAEVIVKDVHGSEGLAQAQAATESFFASKGKSITEAELVALVESGVGVKVARADLIGKRWLDIVVELGFCSSRGQARRLIQQRGLYINQEPLADEQSILDGTQLCFDRYVLLSQGKRKKQVIDLKLGGVCGSKYRYWVDWFGRDGQKPCIEHGGSWFFCFCL

SEQ ID NO: 407 - protein, 260 aa, Chlamydia trachomatis
FVKEIFFVKTHDLADTWQLYWSTKEIHHRDVLIESYLPLVKNVAHRLASGMPSHVKMEDLYALGVEGLIRAVERFDPEKSKRFESYALFIIKAAIIDGLRKQDWVPRSVYQRANRLADAMDSLRQTLGKEPTDGELCEYLNISQQELSHWFSSSRPALVLSLNDDFSCQDDDEGLALEERIADERAETGYDVIRKKEAISILTEALLALDEKERQVMALYYYDDLVLKEIGKILGVSESRVSQIHSKALLKLRGTLSSLL

SEQ ID NO: 408 - protein, 132 aa, Chlamydia trachomatis
MYMALKSKNSQELVECVRKYLGKQIGLSLWNRQDVLEVITIDSLVEQFVRDSQEKVVLDLNEKVVAQVKHLLRVGEGNFRAIVTGSETRKELKRIVASPPYFPDLLVLAHSELPEEIPITLLGAVSDEVLLS

SEQ ID NO: 409 - protein, 403 aa, Chlamydia trachomatis
GISFPLGASRLALTVCLLLFLVNFLVITKGAERIAEVRARFSLEALPGKQMSLDADIAAGRIGYSRASVKKSSLLEESDYFSAMEGVFRFVKGDAIMSWVLLGVNILAALFLGRATHVGDLWLTVLGDALVSQIPALLTSCAAATLIAKVGEKESLAQHLLDYYEQSRQSFLFIALILCGMACIPGAPKALILGFSVLLFLGYKNPSSGETLLFQKERVEFVLPDEGVGNPANLYKDARNQIYQELGVVFPEAIVVARGYVTGSSPRLIFSGQEVALRELSCPAILESIRQLAPETISERFVAHLVASPEFREHAFLSIEEILPLKISENSLIFLLRALVARGERVSLHLFPKILEAIDVYGSQIKEFSGIGRVCTKISWEANWFILMESPRCLRGNYDRLSG

SEQ ID NO: 410 - protein, 82 aa, Chlamydia trachomatis
MAKLIISADDENQEFHLEDGSSIAEVCEHSGVPFACMEGVCGTCVIEVLEGADNLSDFSEAEYDFLGDPEDSNERLACQMLH

SEQ ID NO: 411 - protein, 365 aa, Chlamydia trachomatis
EFMFTSLSAIQNAIRPSCQLPVLTPRRALITSLASGIILGLAGCVVGVLASLPALIAVSAVILGVSLFASGLFLCRYVCPPKIVSRRPSTELPAEPTPELPEIKRPKPIAPPPPDFIPPKPLRRTIGEMLFGWNCIESIRQMPFFLANDKTPLFFRNPSARFRAWNIPFTHTIFVSTSGQFSSLRMQSNLPAAIANATQSAAFAKRGQGGLGVNDAFPAVLTDKCWEESKPESGILLPGECSSATWEDKNHLVPCWDEETKTYNKPLLFIQMLAPKASMSKSCYEITLRAYTACFEEAIRCGCRMIQIPLIASFGDFVPRALSKRPKWIESAKLALLHAVEKTAKKHASKDLVIVLTNIPQPVNL

SEQ ID NO: 412 - protein, 613 aa, Chlamydia trachomatis
QKLFVGHLVMATPCIQNAFRRKTLPVRIGDLFVGSEHSIKIQSMTTTATTDVDGTVRQICALQELGCDIVRVTVQGLREVHACEHIKDRLIQQNISIPLVADIHFFPQAAIHVVDCVDKVRINPGNYVASPKRNMFTGKIYSDEQYAHSLEHLMNKFSPLVEKCKRLGKAMRIGVNHGSLSERVTQRYGNTIEGMVYSALEYAEVCVAMDYHDVIFSMKSSNPKVMVAAYRSLAYELDQREWSYPLHLGVTEAGSGTAGIVKSAVGIGTLLSEGLGDTIRCSLTGSPINEIPICIDLLKQTTELSERWGEADNPFAIHSSKQLGTRNTLNTPPWDNVYGLLINLTDVQLLTAEPIELLQCLGIDTTTGKIDPTTPEGVVVPKAMRSSPIVSEIEKHLLVFNKEDAPILNPMNEEEWLSEETLSAPFVYFEVTDIHTARRFFSLRQHSTQPVCLSFSLDPHLSKNEAIIDLSARLGALLLDGLGSCVLLDFVDIKLSRTLGFLILQSANIRSVTVEYVSCPGCGRTLFDLLAVSQRIRERTKHLPGGLKIAVMGCIVNGPGEMADADFGYVGSKPGMIDLYVKHKCVKSCIPIENAEEELVQLLKEHGVWKEPE

SEQ ID NO: 413 - protein, 173 aa, Chlamydia trachomatis
AMRVLLIRVNFPSKHITLIYIVSWIDTHFIYTIHNMYGCLRKEMDICYKRDGNVLLNQAVFNVLACMNLSQTLYRNTNDVALATQLLQSTNLSNRSIHICGGCSRHRLDFDGVLTTNKKISDSYWEGFASKRILYTGCCHDEVSYKQFLKLAGTVPAESLSPEGFGGLRKYKL

SEQ ID NO: 414 - protein, 252 aa, Chlamydia trachomatis
MERARIGSLMTLPSEALRKQTFPELEYLPIRHGIFPKQDDKEEASQVSDEVISSSLGGNDFCNARQVHGTSVRYVTPKTPKRAPADGLFTTTPLLSLHIYHADCQAAIFYDPENHVIANVHAGWRGLVGNIYAVTVRLLKKTFNTRPQDLIVAISPSLGPDMAVYPDYKRLFPSSFFPLMPKENHLDFRAVARKQLLSEGLSSNHIFISERCTCSESNTFFSFRSWKSRHQQDPSAIRSRKNNVTAVLLLPR

SEQ ID NO: 415 - protein, 365 aa, Chlamydia trachomatis
MSIEVRIPNIAESISEVTISALLIPSGDLVQENQGILEIESDKVNQLIYAPCSGRVEWSVSVGDTVAVGSVVGIISEAEKSQDTAPIHEQMPFSLVEQESDAQIIAFPSSVRQDPPAEGKTFVPLKEIQPASSDHRESRESMSAIRKTISRRLVQSLHDSAMLTTFNEIHMGPLIALRKERQEDFVAKYGVKLGFMSFFVRAVVDSLKKYPRVNAYIEDNEIVYRHYYDISIAIGTDRGLVVPVIRNCDQLSSGEIELQLADLASRAREGKLAIHELEGGGFTITNGGVYGSLLSTPIINPPQVGILGMHKIEKRPVVREDAIVIADMMYVAMSYDHRIIDGKEAVGFLVNVKEQLEQPELLLKM

SEQ ID NO: 416 - protein, 906 aa, Chlamydia trachomatis
IRLMDSDFARHVHSSDIDWIESLFERFEKHEPMDSSWKYFFEGYQVGKTEGSPTESSHDQFFTSLQEKKAHSLLMIYRYYGYLQGQVSPISSSEESSLVTEKVRNFDPQEEIPSLGLLPQSYVRIADFIQVLKEKYCRSISVETLNCSPEIQEYVWKLMEGEKPSLTKEVLLARYRDVKRAVAFEEFLQVKFTGKKRFSLEGGESLVPMLEHLIACGVKQGINRYVMGMPHRGRLNVLANIFGKPYRQIFMEFEDAPQIRGLETVGDVKYHKGYVANRPEQNVMMALLPNPSHLESVDPVVEGAVAAIQHQGEAGKEQACLAVLMHGDAALAGQGVVYETFQLSGIPGYSTEGTVHIVVNNQIGFTAQPRESRSTPYCTDIAKMMGIPVFRVNGEDVLACLQVMEYAIHIRERFHCDVIIDLCCYRKYGHNESDDPSVTAPFLYEEIKKKKQGSELFKEILLHHPEWNISSNELERIDTEIAHVLNQEYASLKDPGVERLDECMHCTRMAAGELLVDNVDTSLDKEALFDLSAKLCDIPEHFSPHAKIRSLLNKRMSMADGEIGYDWGMAEEVAFASLLQEGFSLRLSGQDSIRGTFSQRQLVWTDVQTGDTFSPLYHLSPSQGSVELYNSPLSEYAVLGFEYGYAQQAEKTLVIWEAQFGDFSNGAQIIFDQYISSGIQKWDLHSDVVVLLPHGYEGQGPEHSSARIERYLQLASDWNFQVVLPSTPVQYFRILREHTKRDLSLPLIIFSPKMLLRHPQCVSSIAEFGMKGGFKPFLEDENPNYHAKVLVLCSGKIYYDYRASLPKDLECRFACIRVESLYPLYLEDLLVLISKYTEVHHYVWLQEEPQNMGAFSYFALATDEIFPSKLQCVCRPRSSSTATGSASLSQKELSMLMETLFSIGRE

SEQ ID NO: 417 - protein, 295 aa, Chlamydia trachomatis
MNGKTPLALYIHIPFCSKKCHYCSFYTIPYKEELMRSYCEAVIKEGLKKLAPLRCSHYIDTVFFGGGTPSLVPPALIQDILVALEAQHATEITLEANPENLSLEYIQALALTSINRISIGVQTFNDPLLKLLGRTHSSSKAIEAFMLCSQYGFSNVSADLIYGLPTQSISDFIVDLRQAISLPIQHISIYNLTIDPHTSFYKHRKRILPSIADDDSLAEMALAAEELLENQGFTRYELASYAKNQAASKHNTYYWTAKPFLGLGVSASQYLHGIRSKNLSRISHYLRLRINIYRL

SEQ ID NO: 418 - protein, 567 aa, Chlamydia trachomatis
FLIEKMNKKERINKKNASTKIQRNTPTRALLSIGSQQLSSFTKLSFNNEAKLSGVATPTRDTDVVPLQYLQARYLSKNDPNPDYLPIHGGSMTGNINMGTHSVFNLKQPTKPSATLPEESSKPKDPREEEGFTKKTAEKQEQAIKEYNTKLAEYQKKIDDYNAAWEAFYSEAATVKYVKGIVDKILNNNKLSTALNSATEVEKKIALAQKALGIEITINPDADTDPVPETPKPTPTTDTEEKESPPLSYDDLPSVIKNAQFVVTQSQNKLTGDLKMTNAQIANIKTPDTGDSNYAANVTYLESKLKQPKRAFLSNTLPTTTSSPTISFNGYIPWLSTTNGSSSPTEPDFKSELADKCFTAEQENLKVKTAGLLVLSVRGTWSPTTATIADGSTQTPKTISVNLTVTPDNSSGTNTPSSGSDSSGDASATTLTIPLTLYSRESVQLQLPKTASDIKMDTSSQTSNGGSGSVSSSATETLTIPLTLYSGESVQLQLPITTTSSVKMATTTSQTSNGGGDTSSQITLSSWSWEAALYPTDVTVTNKTTPPTTKTPSSPSPNSKMIKNKIV

SEQ ID NO: 419 - protein, 276 aa, Chlamydia trachomatis
IFNFVNLYTILFLIIFELGDGDEGVFVVGGVVLLVTVTSVGYRAASQDQDDSVICDEVSPPPLEVWEVVVAIFTLDVVVIGSCSCTDSPEYSVRGIVSVSVAEDDTEPLPPLEVWEEVSIFMSDAVLIGSCSCTDSLEYSVRGIVSVVAEASPEESDPLLGVLVPLELSGVTVRFTDMVLGVCVLPSAIVAVVGLHVPLTDKTSRPAVFTFRFSCSAVKHLSASSLLKSGSVGEEDPFVVLSHGMYPLNEIVGELVVVGRVLERKALLGCLSLDSR

SEQ ID NO: 420 - protein, 183 aa, Chlamydia trachomatis
DSIEIYEVKDLKNEIMNDIKNNISSSFWNPNKVVTKVLLKVSETGIESTPGIVKHNQPITQSENPKDPTDAVTFKYLKENYTKENDPNPGFLPTKGGTMTGDIDMQGNNVTDIVMYKQNGQQDPDDGSAVTIGYLNEKADEIKSNDKITRVSQAYRILTHKYPRYTNFSVLLKILTLSLTQIF

SEQ ID NO: 421 - protein, 424 aa, Chlamydia trachomatis
QNYTGVAGLSDINSQISTLHQLLGIAEDPDTVTNPDLLKTSGGTVYENIDMNSNTVSDLGTPTNKDTKSAINVEFVQAKITSPQMAFLKNNDTNLSNITVSEYFNWLQAPTPNPAPTTPDNSNTPNNPPSSSNGASSFIRELAATTTGSTDTEITPAAEGTDLPNTTFSEKSPLWEEFFSYPDSSRSEMVIQKTGILTFSMQGTWNHPNNTTPTSTDPISLELTVTPPKTDTTPKSPSSSPKKTTSEATSSPATNGPTTASITKTFSRKYNLSATPSPTPTTPTTPDPITKKFSLASGQSCTLQIPVQATGSVLKLKYVNPNNNSSGGSSGSGGDSQEENPTSSSGTNNAPASQTSRIQIRYASTTTTDSGSTTKNPIKAQADESTPPETTSTGITLTSFSWSLVLTSGEITKAKSTPSTPSQP

SEQ ID NO: 422 - protein, 134 aa, Chlamydia trachomatis
EKNSSHKGDFSENVVFGRSVPSAAGVISVSVEPVVVAASSLINEEAPFEEDGGLFGVLLLSGVVGAGFGVGACSQLKYSETVILERFVSLFFRKAICGEVILACTNSTLIALLVSLFVGVPRSDTVLLFISIFS

SEQ ID NO: 423 - protein, 496 aa, Chlamydia trachomatis
LIKRQNMNKKIIKERVSSSVPSTPSDQPADPTNPVTKMLFECKLSQNQGDASADVDAMVTTAHVKLDAKNQQVRKVAKREEDQNVIVLSQLEGYLQKGSRSIAGLFLPTSGGAMVGDINMGTSPGNTIKGLPSSWGSAMFLGNEYAASVGIVQDVVGEYRARLDDLIDRITKYAGSGEGSLEQLIKDLGSPQESQAGQTPSVTLEKPTDAKWLLLSAKNAMTGTLRFEKKQGALPTTPDPTITNLKAGGLGTIGTATPKDKLQNIVSVADLTTILKDLQNNAPSEGTGSHTGSDVGSRSGSGTDSVSGGVAGASVSTTTASTFPEWTGQEVPYLVEQSPDSGSGSLSVQNPLKSSNADNYIKKDNGTYSLLRRGLYLITFAYEFGSPIQNGAVTCTGTLRKKSDSTSAGGDVAAQPTSGDATAPTDPEPSPAFSVVGSSDGKTVVGSAYILVPGDKALSKHTLTLALTPGKNTEVSPTSATASKSYVAISYMGAGY

SEQ ID NO: 424 - protein, 239 aa, Chlamydia trachomatis
VAMALYLLPNTLGSKRSEDLPSSVGEIVRNKIQGLIVESDRGGRLFLSLWKVEEPHRFPLAVMSKNDTSVKACDFYLEPILKKQESWGVISDAGLPCIADPGAKLVRRARTLGIPVHAVSGPCSITQALMLSGLPGQNFTFHGYLPQNPKERSRYLRSCSGKSHTQICIETPYRNPYTFDALLDQLPDHGELCVAIDLMGDQEYVSTRSIAVWNQSSDIEEVRERLKKVPAIFLFITSF

SEQ ID NO: 425 - protein, 111 aa, Chlamydia trachomatis
LKVLIKRSKELQLSCSLGVAKIFVSKFPQTGLFEILSEFQKLICQMGDKESIEASDIQSFVEKKEAISLWKLRDALLRKDRVAAHSLMRSLVSDMGEEPLGFSTFYVVSTS

SEQ ID NO: 426 - protein, 191 aa, Chlamydia trachomatis
EFSFPGFLYLLAESKCLKKIKSGNKKNNPRIIGFWRWIMGNSQNSIHITSTKDFVQYIERERFRVIVIGSSSLEDKDIFSELYISGRKSFFDGQRLLQQELLSWTDHFGLFASQETIGIYQAEKMSSSLQEFIIDYTRHPNPNLTLFLFTNKAELFSSLSSKLSNALCLSLFGEYFAERDARIAQGFDKTF

SEQ ID NO: 427 - protein, 299 aa, Chlamydia trachomatis
  VARIANT (1)...(299): Xaa = Any Amino Acid
MNMLGVQKKRSTRKTAARKTVVRKPAAKKTAAKKAPVRKVAAKKTVARKTVAKKTVAARKPVAKXATARKAPVRXAVAKKTVARKTVAXKTVAARKPVAKKAAAKKAPVRKVALAAKKTVARKTVAKKTVALAARKPVAKKATAKKAPVRKAVAKKTVARKTVAKKTVAARKPVAKKATGKKAPVRKVAAKKTVARKTVAKKTVAARKPVAKKATAKKAPVRKAVAKKTVAKRVASTKKSSVAVKAGVCMKKHKHTAACGRVAASGVKVCASAAKRKMNPNRSRTAHSWRQQLMKLVAR

SEQ ID NO: 428 - protein, 175 aa, Chlamydia trachomatis
MGDVYVGMTGLSVEIGSTDAEGRLILADAISYALKYCNPTRIIDFATLTGAMVVSLGESVAGFFANNDVLARDLAEASSETGEALWRMPLVEKYDQALHSDIADMKNIGSNRAGSITAALFLQRFLEDNPVAWAHLDIAGTAYHEKEELPYPKYATGFGVARGCLIHYMEKFLSK

SEQ ID NO: 429 - protein, 309 aa, Chlamydia trachomatis
VVLLYSQASWDQRSKADALVLPFWMKNPKAQEAAVVDEDYKLVYQNALSNFSGKKGETAFLFGNDHTKEQKIVLLGLGKSEEVSGTTVLEAYAQATTVLRKAKCKTVNILFPTISQLRFSVEEFLTNLAAGVLSLNYNYPTYHKVDTSLPFLEKVTVMGIVSKVGDKIFRKEESLFEGVYLTRDLVNTNADEVTPEKLAAVAKGLAGEFASLDVKILDRKAILKEKMGLLAAVAKGAAVEPRFIVLDYQGKPKSKDRTVLIGKGVTFDSGGLDLKPGKAMITMKEDMAGAATVLGIFSAFSFPWSFRSM

SEQ ID NO: 430 - protein, 157 aa, Chlamydia trachomatis
MLFGYLVGFLAADPEERMTSGGKRVVVLRLGVKSRVGSKDETVWCRCNIWNNRYDKMLPYLKKGSSVIVAGELSLESYVGRDGSPQASISVSVDTLKFNSGSSRPDARGSDEGRQRANDNVSIGFDGESLDTDSALDKEVYAGFGEDQQYASEDVPF

SEQ ID NO: 431 - protein, 190 aa, Chlamydia trachomatis
  VARIANT (1)...(190): Xaa = Any Amino Acid
KILLKSLKLPDVAFDQNNTCILFVDGEFSLHLTYEEHSDRLYVYAPLLDGXPDNPQRKLALYEKLLEGSMLGGQMAGGGVGVATKEQLILMHCVLDMKYAETNLLKAFAQLFIETVVKWRTVCSDISVASPENPLLIPCHKCLKGVALAEEFNLLQQESVHKSFAIIQQKEEGLLPFVFKPPPSSLHFFG

SEQ ID NO: 432 - protein, 618 aa, Chlamydia trachomatis
  VARIANT (1)...(618): Xaa = Any Amino Acid
NSSIFYRPQDWSHLAYRNCRHFLVNGRMLINLRGTDLSSQKFATDSYIADPYSKNIYSPQLFGSPKQEKDYAFSYLKYEDFDWEGDTPLHLPKENYFIYEMHVRSFTRDPSSQVSHPGTFLGIIEKIDHLKQLGVHAVELLPIFEFDETVHPFKNQDFPHLCNYWGYSSVNFFCPSRRYTYGADPCAPAREFKTLVKALHRAGIEVILDVVFNHTGFEGTSCPLPWIDLKSYYMVNDHGDLMNFSGCGNTVNTNTPTTLKWILDALRYWVQEMHVDGFRFDLASVFSRDPQGVPLPLTPILQAISSDSILSETKLIAEPWDAGGLYQLGHFPSISTRWSEWNGCYRDHVKAFLNGDAHQVSSFASRISGSHDIYPNGKPTNSINYICSHDGFTLYDTVAYNDKHNEENGEYNRDGTSANYSYNFGCEGETTDPTICALRERQMKNFFLALFLSQGIPMIQSGDEYGHTAYGNNNHWCLDTKINYFLWDRLAERKELFSFLCQVIALRKAYTELFNTSFLSEDTITWLNTKGSPREWGADHYLAFXLKHLNYSLFVXFYSGNERIEISLPKPRKEHLAYEKIVDSTTGFFSQILSPKLSLEPYSSLVAISRRKTSLESR

SEQ ID NO: 433 - protein, 305 aa, Chlamydia trachomatis
RVWFSEPQEDGLQPLWHMNILTGTLRTGGEKNKVKKLNLLVLLGVFCGVSGVGDADVKVSDALSQSILVEPKIRVLLLSESTTALIEAKGAFSVFGDGELLRVSSQGQRCAAHALYGGIRWGENYPNVECLKIEPLDGAASLFVASNGIQYKGAIYIHRTDRSCLFIVNELALEDYLKSTLSVKYLKELDKEALSACVILERTALYERLLAGNSHSFWHVNAQEDRYGGFGVTSQFYGVEEAVDWTSRLVLDNPEGLVFNADYLLRANVDHLAIEGYNARQILEKFYKDADLVVIESWEDDCKGA

SEQ ID NO: 434 - protein, 247 aa, Chlamydia trachomatis
TIANTYMTHKISVLHQDKKFDFSLRPKKLTEFCGQKQLKERLDLFLRAAVQRNEVPGHCLFYGPPGLGKTSLAHIMANTIGKGLVIASGPQLLKPSDLIGLLTGLQEGDIFFIDEIHRMGKAAEEYLYPAMEDFKVDITLDSGPGARSVRLDLAPFTLVGATTRAGMLSEPLRTRFAFTGRVDYYTDEDLVSILSRSSQLLAIEANQETLLEIARRARGTPRLANNLLRWVRDFAQMREGNCINSRP

SEQ ID NO: 435 - protein, 192 aa, Chlamydia trachomatis
MGIKEDNWIRKMAIEEGMIEPFADSQVKLHPETGEKLISYGLSSYGYDLRISREFKVFTNVYNSLVDPKCFTEDALISIVASPDVCIIPPNSFALARSVEYFRIPRNVLTVCIGKSTYARCGLIVNVTPFEPEWEGYVTIEISNTTPLPAKVYANEGIAQVLFFEGDAACDVSYAERQGKYQKQQGITIPFV

SEQ ID NO: 436 - protein, 109 aa, Chlamydia trachomatis
NSCVNTKVADWRTKKLAPIFPLDYEDFFTVFMKKQHYTLPGNVSNMRILSPVRPVSETALTTIIISGLEEEDKLGLLGQVQQFLFDAEEAHPQRGESILIQNVLDDITQ

SEQ ID NO: 437 - protein, 168 aa, Chlamydia trachomatis
VFCAGAYFGCARFEFLEPTGSLFVAKRDLGFFPGAANGPAYESAFSYTSSSGVLAAPLVFADFPGESFSLFNGGCCFENAEHFPEICIEARYNNLLGKPAAILSRRLDKGLVVLSGPHIEYLPEFCSLQEDNVIQAREQIAAHSSSLEEYKQFLIHRLLSNVVEHVLY

SEQ ID NO: 438 - protein, 105 aa, Chlamydia trachomatis
GKEMKRILVYSDKGVSPYYLRHTVRWLKQVAAPFQMEVCRVNGRFLIHEPLWEDTTQLLVIPGGADVPYHNVLHGLGTARIDNYVREGGCYLGILRRSLFWLRAV

SEQ ID NO: 439 - protein, 285 aa, Chlamydia trachomatis
  VARIANT (1)...(285): Xaa = Any Amino Acid
SAVFKLESLLSMMSSPHPMSSSRNTPLGVFYSLLACFYWGMVFVIPSMLGNFADLDIVLTRYSVFGICSLITILYKRSNIFKTVPFFLWKKGILWAFLINIAYYFGIAQAVRYSGSAVTVIIAGLAPIAILFYSNIKKKMLSYSFLLSMSGIIVVGIILSNVSEFQSESSSSLPLYLLGFGCVTAATSIWAGYIIYNHDFLEQHSEISPDTWCHMLGISSLIICLPLIILGDTFGITHVTRNFLFHTPLSERCLXIVLCSAMGIFPLRELSQLGTKLLFICLQLF

SEQ ID NO: 440 - protein, 110 aa, Chlamydia trachomatis
  VARIANT (1)...(110): Xaa = Any Amino Acid
FSISYPSFRKMPXDRSLLCYGDFSSSRAIAAWNKASLHLSTALLGALLIFEPIFGWILSYLCKREMPSFQEGLGFFLMLGASLCLLLAQKKASEQETPSETLITTESEAN

SEQ ID NO: 441 - protein, 752 aa, Chlamydia trachomatis
  VARIANT (1)...(752): Xaa = Any Amino Acid
KDMGCEEKLSGILELILPEDPLSDQTGYAFLRVPYKNSLVTVCGHLPLSLFKIGSSVDLTGHWSVDASGALVFRFTSAATYSPDSGIIAYLNAQIKGVGPKLAQKIVSTFGEDTLTVLDSCPSKLVEVASPGISPARCEDFSKQLQEQRDLRHALLFLQRHGIAIHYGLRLYKKYQNQTIEKVCQDPFLLAKEMYGIGFKTADLIATCLGVPLNSPNRIVAGIQYSLDELQEEGHTCYPLNDFIVLVEKLLNEEAPEEIIRKEEIRTQIHFLSRQKTVYVKELEQDTYIWSRQLFLAEQQIAIDIRRLLFSSKRIRSINTQEAILEVENLLDLKLEEKQKEALHASSSQKIHIISGGPGTGKSTITRAILSIFEKISSPKKIILAAPTGKAAKRMTEITGKRTQTIHSLLQYDFKTLSFRKNHEDPIDCDLVIVASPESGMIDTILLQRFLAALPDHAILILIGDVHQLPSVGPGNVLKDLILSHHIEVTYLTKIFRQLQNSNIITNAHKVNQGEFPVLNSSSGKKDFLFFQKEDPEEAIKHIIHLVSDFVPKKFGIFTKDIQVLAPXRKGVLGILNLNRELKAALNPNKLFIQGKFHSFSTGDRVMQTRNNYNKEVFNGDIGYVTSIDLSTKSLIVCVDGRYISYSQAELNDLIPAYATSIHKYQGSETSCIILPIHTSHYVMLYRNLLYTAITRGKKLVILVGTKKAVAIAVRNDKVQHRCTGLQQAMHSLLNKPTPLFSPYTICRPSLG

SEQ ID NO: 442 - protein, 563 aa, Chlamydia trachomatis
KRSFSVQLERREIVESSRILITSALPYANGPLHFGHITGAYLPADVYARFQRLQGKEVLYICGSDEYGIAITLNAELAGMGYQEYVDMYHKLHKDTFKKLGISVDFFSRTTNAYHPAIVQDFYRNLQERGLVENQVTEQLYSEEEGKFLADRYVVGTCPKCGFDRARGDECQQCGADYEARDLKEPRSKLTGAALSLRDTEHAYLHLERMKEDLLAFVQGIYLRPHMRNFVTDYIEHLRPRAVTRDLSWGIPVPDLENKVFYVWFDAPIGYISGTMDWAASIGDPEAWKKFWLDDTVTYAQFIGKDNTSFHAVIFPAMEIGQSLPYKKVDALVTSEFLLLEGFQFSKSDGNFIDMDAFLETYSLDKLRYVLAAIAPETSDSEFSFQEFKTRCNSELVGKYGNFVNRVLAFAVKNGCTELSSPQLEQKDLDFISKSQKLAKDAAEHYAQYSLRKACSTIMELAALGNGYFNDEAPWKLAKEGNWNRVRAILFCACYCQKLLALISYPIMPETALKILEMIAPYSLDLGSQDPDRLHSLWTDSFFDYSEEKFSLKEPELLFTMVE

SEQ ID NO: 443 - protein, 101 aa, Chlamydia trachomatis
VMARKDRLTNERLNKLFDSPFSLVNYVIKQAKNKIARGDVRSSNVAIEALNFLDLYGIQSEYAERDDRERHLSATGERRREQGFGTSRRKDPSLYNWSDVK

SEQ ID NO: 444 - protein, 373 aa, Chlamydia trachomatis
  VARIANT (1)...(373): Xaa = Any Amino Acid
ACILPRGKVFLGIDDSKKLTPKQRRYLYELLLEDPEVDCGVGVISVERIDEINILEATKEAMVQAIASLRSTPDFLLVDGLFLPHKIPSLKIIKGDARSVSIAAASIIAKEYRDELMRKLHVEYPEYGFDKHKGYGTAAHLQALKHFGPCVYHRKSFSPVKESIXRGSMSVKVISPFSQDGVQFFPKLFIISAPAGAGKTTLTHMLQREFPDAFEKTVSSTTRSARPGEVHGVDYLFVSEDDFKQSLDREDFLEWVFLFGTYYGTSKAEISRVLQKGKHCIAVIDVQGALALKKQMPAVTIFIQAPSQEELERRLNARDSEKDFQKKERLEHSAVEIAAASEFDYVVVNDDLITAYQVLRSIFIAEEHRMSHG

SEQ ID NO: 445 - protein, 123 aa, Chlamydia trachomatis
NTMGNLIKELQDEQCRTDLADFCVGDTIRVATNISEGGKERVQVFQGTVMARKGGGAGETVSLHRVAYGEGMEKSFLLNSPKIVSIEVVKRGKVSRARLFYLRGKTGKAAKVKELIGSRAAKK

SEQ ID NO: 446 - protein, 283 aa, Chlamydia trachomatis
KHKKKEVQGHILISAGQLLSAKKSRELASCSHLVLLCGHYEGIDERALTAEVDEEISIGDYVLTNGCAAALVLVDALARFIPGILGNQESAEYDSLENGLLEGPQYTRPRVFEGESVPEVLLCGDHQKIADWRKQVSLERTRERRPDLYLQYFYGNSACLSTQEDLPRIEVVSPKTFSVVLEVQDLRKAKKFYSRMFGKECWDGDKLFLLGKTSLYLQQTKETRGPTTVFIELETDHDFVARGFLKRWEMLGGELGEQGTGGFPLRQVFDLDGHIWVVSCVQK

SEQ ID NO: 447 - protein, 120 aa, Chlamydia trachomatis
MEIDILSLFPDYFASPLQATILGRAIKQGALSVRSRDIREFGLGKWKQVDDSPYNGEGMLLMAEPVVQAIRSIRRKKSKVIYLSPQDNFFPQRKVVASNWRRVRIWYCYVDTMRELMKGR

SEQ ID NO: 448 - protein, 116 aa, Chlamydia trachomatis
VALKIRLRQQGRKNHVVYRLVLADVESPRDGKYIELLGWYDPHSEQNYQLKSERIFYWLNQGAELTEKAGALVKQGAPGVYAELMAKKVARRAVVRQKRRAYRQRLAARKAEAAAK

SEQ ID NO: 449 - protein, 448 aa, Chlamydia trachomatis
MISSLSQKLSNIFSSLFTAKRVTEEGISDSIREVRLALLDADVNYQAVKDFIAKVKQKVVGEEVWKHVSPGQQFIKCLHEELSSSLASEQTAVSLRGCPAVILLCGLQGAGKTTTCAKLADYFLREKKAKKVLVASCDLKRFSAVEQLEGLVKQTGADFFRREGNDPVDMAAEAVQHAKSQGYDLVLVDTAGRLHVDDALMDELVAIARVTSPCETLFVMNLAMGQDAVVTAKAFDERLGLTGVVVSMADGDARAGAVLSVKSLLNKPIKFEGCGEKIKDLRPFNAQSMAERILGMGDTISLVDKMRECISEEENKELEEKLTKATFTYEDFHKQILAFRRLGPLRKIMNMMPSFGGAKPSDKDLEESEKQMKRNEAIILSMTPEERKELVELSMSRMKRIAAGCGLTLGDVNQFRKQMMQSKKFFKGMTREKMEQMGKKMSGGNLWR

SEQ ID NO: 450 - protein, 292 aa, Chlamydia trachomatis
  VARIANT (1)...(292): Xaa = Any Amino Acid
MKKLLREASEYLLSRGIRFPQREAEDILMDLLEISSRSALHQAKLSSEEQSLYWKRLRKRGDRCPTAYIHGKVHFLGVELQVTPQVLIPRQETEIFVEQIIGYLQMHKEKTTFYDVCCGSGCIGLAVRKHCPHVRVTLSDISPEALAIAESNARSNALAVASPFLLGDLFDPFSFPADVLVCNPPYLSYKEFFESDPEVRCHEPWKALVGGVSGLEFYHRIATHIHKILVSGGVGWLEIGSTQGEDVKQIFHAKGIRGRVLKDYAQLDRFFFLXNQANDAVSSGEVSGFSER

SEQ ID NO: 451 - protein, 232 aa, Chlamydia trachomatis
  VARIANT (1)...(232): Xaa = Any Amino Acid
GXCVRMYHLYAASKGWQCEVLSASESDLGGYKEYVMGISGASVKRFLQYEAGTHRVQRVPETETQGRVHTSAVTVAVLPEPAEDDEEVFIDEKDLRIDTFRSSGAGGQHVNVTDSAVRITHIPSGVVVTCQDERSQHKNKAKAMRVLKARIRDAEVQKRAQEASAMRSAQVGSGDRSERIRTYNFPQNRVTDHRIGLTLYNLDRVMEGELDMITTALVTHVHRQLFGHEETA

SEQ ID NO: 452 - protein, 628 aa, Chlamydia trachomatis
MTSSYMSRLYSLNKSRRILHSSFRLLKSTKMLSHPETQKELQEVLKQLEEAILDQNREDASLFAKQAQAIQKRFPKSKLRATFDLIYALTFAAILAFLIRQFWFELYEVPTGSMRPTILEQDRILVSKTTFGLRLPFSNRSIGYTPEAITRGELVVFTVGDLPIPNADTKYFGIIPGKKRYIKRCMGKPGDTVYFYGGKIYGIDCDGEPIFPQNTENLYHVPYISFDGTPEILTHSEEQTDVIFNQFHTPCGKISLPQQASYGQFFYKNAWHNDTPYALKDPHNEPVSYADLFGIKNFAMVRILTKKQAALTHVLPSPLSDTYLEIAHTPNVSYPHPHLRPFETQRIPTIEPMKTLLPLRKEHIHLIRNNLTTSRFTVVDGYAYKYQPAPMNTSGMVRMFALPMPNIPDGCYEFSKGDVFKINMGGFRTKLKQPHPLTQLSNSQVIDLFNCGISFHTIYIPKNPQYAPFPNRYAFFNQGNLFVMDSPVFIDSDPALQKFIVSEEEKELQSSEDKPYIAFIDRGPPPESTEEFVSFITNFGLKIPEGHVLVLGDNCPMSADSRDFGFVPVENLLGSPVGIFWPINRLGLLSSNITPLSLPGYLVNGLALGAFLYCIGLWYYRKNHRLFP

SEQ ID NO: 453 - protein, 543 aa, Chlamydia trachomatis
KLTRTGNLSEESLMFSIVGLILELCHMLRIITLLKEQKKRRLCFPADFIAEGLDQTRGWFYTLTVIAAALFDQPAFKNVIVNGIILAEDGNKMSKRLNNYPSPKMIMDAYGADALRLYLLNSVVVKAEDLRFSDKGVESVLKQVLLPLSNALAFYNTYAELYGFDPKETDNIELAEIDRWILSSLYSLLGKTRESMSQYDLHAAVNPFVDFIEDLTNWYIRRSRRRFWDAEDSTDRRAAFSTLYEVLVVFSKVIAPFIPFISEDMYQQLRGETDPESVHLCDFPHVVLEKILPNLERKMQDIREIVALGHSLRKEHKLKVARGQPLQNVYIVGSQERMEALSQVGSLIGEELNVKDVHFCSETPEYVTTLIKPNFRTLGKKVGNRLPEIQRALAGLPQEQIQAFMHKGQMVVSLGEETISLDKEDITVSWASAEGFVARSSASFVAVLDCQLTEPLIMEGIARELVASNKINTMRRNGKLHVSDRIAIRLHAPVIVQEAFALHKEYICEETLTTSVSVIDYKEGEEWDINGHAVSFVLERVER

SEQ ID NO: 454 - protein, 548 aa, Chlamydia trachomatis
VNNQRMDNEDKISISAKEEKILSFWKEQDIFQKTLDNREGCPTFSFYDGPPFATGLPHYGHLLAGTIKDVVCRYASMDGHYVPRRFGWDCHGVPVEYEVEKSLGLTEPGAIERFGVANFNEECRKIVFRYADEWKYFVDRIGRWVDFSATWRTMDLSFMESVWWVFRSLYDQGLVYEGTKVVPFSTKLGTPLSNFEAGQNYKEVDDPSVVVKFALQDNQGFLLAWTTTPWTLVSNMALAVHPELTYVRIKDKESGDEYILGQESLPRWFPDRESYEWIGQLSGKSLVGQSYEPLFPYFQDKKELGAFRILPADFIEESEGTGIVHMAPAFGEADFFACQEHNVPLVCPVDNQGCYTAEVKDFVGEYIKSADKGIARRLKNENKLFYQGTVRHRYPFCWRTDSPLIYKAVNSWFVAVEKVKSKMLKANESIHWTPGHIKQGRFGKWLEGARDWAISRNRYWGTPIPIWRSDDGELLVIGSIQELEALSGQKIVDLHRHFIDEIEINQNGKSFRRIPYVFDCWFDSGAMPYAQNHYPFERAEETEALLPS

SEQ ID NO: 455 - protein, 177 aa, Chlamydia trachomatis
KLYLFKGVFFVYVFSNTFFFMQHAHNADSFPAWDCLQHNYLRRNALTSFCSYVPILSTVVGIRTLYNMRKLHQAFVRRTGGFLCQNDPNIPCNKFPCSIIRKEWPQVHTKAMQEVFGIKALVCLGSLILKIFRAVKAFFHRTFSPSLLPEQDASIQLPDSPQSGIPEETLSETPRSS

SEQ ID NO: 456 - protein, 160 aa, Chlamydia trachomatis
KNKRLQRFLFLLPAVVTELAQDLSSVKGSLLSHYIRKKGFVKASPVIEGRESFERSLFAVWVSLQPEEIRHQLTMESFYRDEQKKKRVLTGELEVYPHIVKNNPGDYLLKNGEDVVAFVYATSIDLSKWLGKPVVLECVSRPNNHFAFPAYIVLSVKEGA

SEQ ID NO: 457 - protein, 361 aa, Chlamydia trachomatis
  VARIANT (1)...(361): Xaa = Any Amino Acid
KIEQSRLTFSFKSIIIPSLEDESSRAVNASLEAQILANCRSFCVRTLSISMLIFALSCGADACLCAADLSKAKVEASVGDRAAFSPFTGEIKGNRVARGLRLAPHTDSFIIKELSKGDCLAVLGESKDYYVVAAPEGVRGYVFRTFVLDNVIEGEKVNVRLEPSTSAPILARLSKGTVVKTLGAAQGKWIEIALPKQCVFYVAKNFVKNVGALDLYNQKEGQKKLALDLLSSAMDFADAELQKKIEDIDLDAIYKKMNLAQSEEFKDVPGLQSLVQKALERFQEAFLAKSLEKSAVKVPGIQHKVLEXIAVVSPAVEETPVVTKIEEQKVTTVPVPAPSCCYRAGSRFKLCQRFFIIALYP

SEQ ID NO: 458 - protein, 188 aa, Chlamydia trachomatis
  VARIANT (1)...(188): Xaa = Any Amino Acid
GQAIVDEVFQEHLLYLESTAPQKNKEEEKISSLLGAIQQMANGCEVQVFSQKGLVSMLLGGAGSINMLLQHSPEHKDHPDLPTDLLERIAQMMRSLSIGPTSILAKPEPHCNCLHCQIGRATVEEEDAGVSDEDLTXRSWDISQSGEKMYTVTDPLNPEEQFNVYLXTPIGCTCGQPYCEHVKAVLYT

SEQ ID NO: 459 - protein, 434 aa, Chlamydia trachomatis
MKKTSVIDTSVLIYDPKALSSFSNTRIIIPFTVIEELESCAKFRDESGKNASRALSNIRLLLEQSERPSSGQILLKNGSELCIEVSPLVNLSNHEKQKKHLTLELLQIISQREPVVFVTKSLGRRVHAEALGIEAKDYENKCVSFRSLYRGHRKLKVANSTIEYFYKDGSIAFPSDLSPLPSPNEYFFLSGDSDNYSAVGRYSSKDNKILSLKPAPEKIWGVKPLNIEQRCALDLLLRDDIKLVTLMGQAGSGKTILALAAAMYQVFEKPKYNKLLVSRPIIPMGKDIGFLPGIKEAKLMHWMQPIYDNMEFLFDVNNMGDFSETLHSLMETKKLEMEALTYIRGRSLPKVFMIIDEAQNLTPHEIKTIISRAGKGTKIVLTGDPTQIDSLYFDENSNGLTYLVGKFHHLPLYGHMFMTRTERSELAAAAATIL

SEQ ID NO: 460 - protein, 153 aa, Chlamydia trachomatis
IFLYVLSSYLVLYLSLLIATILGMPQTLGVCCRIEGAPGMPAYPLIILLSVVTLSCCYAEKRAVSIGKYGKAFVLSCINLLSPILAYNILLFPNLLVSTVDNRYTMTVFNAAAETRTLQHLVTIVLIGLPFVVAYAIYIYRVFRGKTDFPSIY

SEQ ID NO: 461 - protein, 227 aa, Chlamydia trachomatis
  VARIANT (1)...(227): Xaa = Any Amino Acid
VRAFFMEFSLATILPVVWYVILCIAVFAYSLGDGFDLGLSTIYFLSKDEKERRLLLNSIGPVWDGNEVWFVIMFAGLFAGFPTAYGTLLSIFYMPIWXMVMLYIFRGCSLEFRSKAESNRWKLFWDVLFSISGMSISFFLGTLAGNLLVGFPIAPDTSYSSLSWKLFFRPYQVLCGLFVVAAFALHGISFALMKTTEGLHERLKNKFSFMFCLVTWFCIFPCSLRLF

SEQ ID NO: 462 - protein, 446 aa, Chlamydia trachomatis
MSAEILARVQFALFIGFHYLFVPISLGLSIMIVLMEGLYLFTKKSIYKQLTWFWIKIFTLTFVVGVVTGLMQIFSFGANWSRFAEYTGNVFGMFLGSEGMFAFFLESGFLGVLLFGRYKVSKKMHFFSACMVALGAHMSAFWIVCANSWMQTPSGYEMVMRNGMLVPQMTSFWAAVLSPSALQRFTHVVLGAWLSGIFLVLSVSAHYLRKERHKDFANQGLKISMFCAFLVLALQLWSADVTARGVAKHQPAKLAAFEGVFKTQEHTPIYLLGIVDMKKERVIGIPIPSGLSLLVHRNAKTPVTGLDQFPKDEWPNVAFVFQTYHLMVMLWGVMVLLALIAFAVYKKKSWSCKKGILWILSLSVLFPELCNEIGWISTEVGRQPWVVYGLLKTKDATSPIVNAGQIWQSLILFSIIFICLLSVFVSLLLKKIGEGPDEQDLIEVDL

SEQ ID NO: 463 - protein, 264 aa, Chlamydia trachomatis
MFVGITYYTTPLLEIALIWVVLNYLLKFFWGTGAMDLVFGLLSFLCLFVLAEKLHLPVIRNLMLHVVNIAAIVVFIIFQPEIRLALSRIRLRRGKFVINMQDEFIDHLTACIYRMAERQIGALIVLENERLLNDLLNLSAVKINADFSEELLEAIFEPSSHLHDGAVLMRGETISYARVILPLAHDTTQLSRSMGTRHRAALGASQRTDALVIVVSEETGAVSLARDGILTRGVKMDRFKAILRSILTRNERKTNPIISWMRKK

SEQ ID NO: 464 - protein, 375 aa, Chlamydia trachomatis
VLPLLSGRLQIKSITITRTFHNIPVRVIDLAPEQTVIGLQANGLLKKKVAMMITGNKSVVEKLRPSNLEIVISAKGRTESWIETIDPYNLVCLDTDIHLRKNIKSVTSEDIFIRLTQFVTEDVSVTITKPIGRAPKGYEYLDTWPKYLVQKVSGPKEYVSSLKDHGLELTFNLNKVSFEELDRNRLAQGNLDEVVYLVPEDWKKVYIPFDNSYMELNDPQADFLRLLFLKQEFIPLNINLPVLLFFPVENSQLVNPQNYYLEENAPLVLNHGIYQMDLPLYVKDVSHLFLDVVKNNIALTIIMEPPVKSQREHFIHWAVEFLDEKTLENTFVQAVMAQEQKTNKHMILDEAGIRHRFREYLRKLTLFDQNGEPLP

SEQ ID NO: 465 - protein, 461 aa, Chlamydia trachomatis
MLFKRLRTGGKILVDHLVYGLGLGVLTILRLLPRSSLRLFSKGLGTALFYFISDFRKTALTNLALAFPEKSFAERYQIARQSVQQMIITFVELATVASPKFAKHIDEMIAIATSEDAPEGFFPEEVSSQQELDHFFSRLDRQEGAILFCGHQANWELPFLYITKRYPGLAFAKPVKNRRLNQKIISLRESFQGKIVPPQNAINQALRALHRGEVVGIVGDQVLLSSEYSYPLFGSQAFTTTSPALLAYKTKKTVIAVAIYRKPNGNYLVVPSKAFHANTELSIRESTEQLMDRLMRFLEKGITCKPEQWLWLHKRWKRKLRHKFKRRYAFSHILIIVKGTSLQALQRFLIEFGEFYADASLSLAIIGATDTVLANSFAPYSLQFFSSEEELLAAPNFFPAIVASPLFGLSRKTRLHYKRTGSRKIFTRNELKDSLLQKQSLIQSFHKLLRRVASPTRSRKG

SEQ ID NO: 466 - protein, 143 aa, Chlamydia trachomatis
MSEHVHKELLHLGEVFRSQREERALSLKDVEAATSIRLSALEAIEAGHLGKLISPVYAQGFMKKYAAFLDMDGDRLLKEHPYVLKIFQEFSDQNMDMLLDLESMGGRNSPEKAIRSWLNLGWAGVFVVGAACIWWLGNLFNLF

SEQ ID NO: 467 - protein, 245 aa, Chlamydia trachomatis
PLSFRNCLLLYFLYFENNLEKKGFTISIPPHTVFQGRSPTVSCTVYQSGKIVVQGKGTQEFVEFFLEPEILQTFSSQNVQQDLRSRIGVDESGKGDFFGPLCTAGVYASSPQAIEALYKTSICDSKLIPDAKILSLAQNIRSLCACKVITLFPEKYNALYANFQNLNSLLAWTHATIIDNLAPHPAGAVFAISDQFASSERVLLQAVRKKRSDIELIQRHRAEQDVVVAAASILAREVFSLPYTP

SEQ ID NO: 468 - protein, 288 aa, Chlamydia trachomatis
WSGMLKVLFHTMTLFGHLLSTPIYIVGDACGKDRDEYKNPPLRAFSFESQFLQIENAKFKTLPDQSLGYRQADTSLFATIPVTEMSGFLLSSRYLGAEVSWKSSKELQDTDPQAVGYFAFQDKSFYQYITLSVGAYTLALTNWQWSVLFSGMVDPENIEIGSGLYQVVLSSKYHASKSLSVIMGVINEVGLHDKQAWPLLGFSYKPEDRLTLNCIYPVNFSAEYQCTPVCDLGVAYRLTRLRKKFPKNSLATSEGIFEYSGREIEGNIKLIFWPGQNLKMFGGYFRRE

SEQ ID NO: 469 - protein, 194 aa, Chlamydia trachomatis
HLVGKMPSTVAPIKGQDHFLNLVFPERVAAAYMSPLAQKYPKAALSIASLAGFLLGILKLITFPVLCAAGLFVFPIRGLISCLFHKSFQGCSGYVLATFLSLFSLALTIVGIVSCITWAPGFIFPMISVSIAFATVETCFQIYTHLFPALEHKPSSSLKIEIAAAKLPRSSSAPDLNCPSLPTQSASPSQRFSA

SEQ ID NO: 470 - protein, 376 aa, Chlamydia trachomatis
ILVLSVFCFWDNFMTPVTPVPPQSPQQVKGLLSRFLTAPDRHPKLRYVYDIALIAISILCIVSIILWTQGSGLALFAIAPALAIGALGVTLLVSDLAESQKSKEIADTVAAVSLPFILTGTAAGLMFSAIAVGKGAVILANPLFLMGSMTLGFALMSLHRVTYQYLSNREQWKQQKKLEQVELAAWESHLPKESKSSALEEVRYSPRLMKRGKTWRKRAIRRKNYIPIPLVDKTLQTMQPDALFSSTTTHSTDSEQILTSVSPQSSDTESSSSSSFHTPPNSDKELSDSNSSDSSSSSEYMDALETVAAGDVSGITPPSKPSSSPKTTRRVVKLSRSERNAQHHRNKDQEQRQDSSESSDEESSSDSSQKKKPSRK

SEQ ID NO: 471 - protein, 436 aa, Chlamydia trachomatis
  VARIANT (1)...(436): Xaa = Any Amino Acid
NNMGIAHTEWESVIGLEVHVELNTESKLFSPARNHFGDEPNTNISPVCTGMPGSLPVLNKDAVRKAVLFGCAVEGDVALFSRFDRKSYFYPDSPRNFQITQYEHPIVRGGCIRAVVEGEEKTFXLAQTHLEDDAGMLKHFGDFAGVDYNRAGVPLIEIVSKPCMFSAEDAVAYANALVSILGYIGISDCNMEEGSIRFDVNISVRPRGSRELRNKVEIKNMNSFTFMAQALEAEKRRQIEEYLSHPNEDPKKVVPAATYRWDPEKKKTVLMRLKERAEDYMYFVEPDLPVLQITETYIDEVRQTLPELPHSKYMRYITDFDIAEDLAMILVGDRHTAHFFETATMSCKNYRALSNWITVEFAGRCKAKGKTLLFTGILPEWVAQLVNFIVRGVITGKIAKEIADRMVSSFGESPEDILRRHPSLLPMTDDHALRYR

SEQ ID NO: 472 - protein, 491 aa, Chlamydia trachomatis
MYRKSALELRDAVVNRELSVTAITEYFYHRIESHDEQIGAFLSLCKERALLRASRIDDKLAKGDPIGLLAGIPIGVKDNIHITGVKTTCASKMLENFVAPFDSTVVRRIEMEDGILLGKLNMDEFAMGSTTRYSAFHPTNNPWDLERVPGGSSGGSAAAVSARFCPIALGSDTGGSIRQPAAFCGVVGFKPSYGAVSRYGLVAFGSSLDQIGPLTTVVEDVALAMDAFAGRDPKDSTTRDFFKGTFSQALSLEVPKLIGVPRGFLDGLQEDCKENFFEALAVMEREGSRIIDVDLSVLKHAVPVYYIVASAEAATNLARFDGVRYGHRCAQADNMHEMYARSRKEGFGKEVTRRILLGNYVLSAERQNIFYKKGMAVRARLIDAFQAAFERCDVIAMPVCATPAIRDQDVLDPVSLYLQDIYTVAVNLAYLPAISVPSGLSKEGLPLGVQFIGERGSDQQICQVGYSFQEHSQIKQLYPKAVNGLFDGGIE

SEQ ID NO: 473 - protein, 125 aa, Chlamydia trachomatis
GFFCFKKFGGFFFFLGSCLPFFGLEVAGFFFNQGGILFFAKNAALELEDAHVEEFVTSMNDVIALMQEVIAIDISDIILEATVHHFVGPEDLREDMVTSDFTQEEFLSNVPVSLGGLVKVPTVIK

SEQ ID NO: 474 - protein, 109 aa, Chlamydia trachomatis
IVKKITKSELSIHLRWRDVMLCKVCRGLSSLIVVLGAINTGILGVTGYKVNLLTHLLGEGTMWTQAAYVVTGIAGVMVCLNFLKCCFKKRHEDCCSSKGGCHHHHMDRE

SEQ ID NO: 475 - protein, 471 aa, Chlamydia trachomatis
SYCSWCKFWEEYSPSAARGLRLMFTDFWRTRVLRQTSPMDVVFGNLDVASNEARLMAAYTSECADYLEAHDLAGPDGVAAAREIAQRWDKRVRDLQDKGAAQKLLNDPLGRRTPNYQSKNPGEYTVGNSMFYDGPQVANLQNVDTGFWLDMSNFSDVVLSREIQTGLRARATLEESMPMLENLEERFRRLQETCDAARTEIEESGWTRESASRMGGDETQGPSRAQQAFQSFVNECNSIEFSFGSFGEHVRVLCARVSRGLVAAGEAIRRCFSCCKGSTHRYAPRDDLSPEGASLAETLARFADDMGIEQGADGTYDIPWVDDWRRGVPSIEGEGSASIYEIMMPIYEVMNMDLETRRSFAVQQGHYQDPRASDYDLPRASDYDLPRSPYPTPPLPSRYQLQNMDVEAGFREAVYASFVAGMYNYVVTQPQERIPNSQQVEGILRDMLTNGSQTFSNLMQRWDREVASPRE

SEQ ID NO: 476 - protein, 173 aa, Chlamydia trachomatis
VFILVLGWFVMSIGGVGGNGNSRIPSHNGDGSNRRSQNTKGNNKVEDRVHSLYSSLSNENRESPYPVVDVSSMIESTPTSGETPRASRGVFSRFQRGLGRVADKVRRAVQCAWGSVSTRRSSATRAVESGSSSRTARGASSGRSILLQQLEGCVLCSQISGELGFYARPLLWM

SEQ ID NO: 477 - protein, 438 aa, Chlamydia trachomatis
VKPPSSLKILIMSSVHFLRTVPWRASFLLFVLMHHKTIPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLLR

SEQ ID NO: 478 - protein, 148 aa, Chlamydia trachomatis
FEVTTLSIPLHSLDTEKSVTIHAPNLSIQKIFLSNSGDENFYENVELLSKEQNNIPLLTLPKEQSHLHLPDGNLSSHFGYQGDWTFSWKDSDEGHSLIANWTPKNYVPHPERQSTLVANTLWNTYSDMQAVQSMINTTAHGGAYLFGT

SEQ ID NO: 479 - protein, 182 aa, Chlamydia trachomatis
KQNIGSFSKEGFGSWHSVAVSGEVCASIPIVSNGSGLFSSFSIFSKLQGFSGTQDGFEESSGEIRSFSASSFRNISLPIGITFEKKSQKTRTYYYFLGAYIQDLKRDVESGPVVLLKNAVSWDAPMANLDSRAYMFRLTNQRALHRLQTLLNVSCVLRGQSIVTPWIWGHLQVLVPLPSIAF

SEQ ID NO: 480 - protein, 199 aa, Chlamydia trachomatis
IMVCPLRNCCTSHTSTENLPMEETSPLVEAIVQAVQTCLTVAKHTENAKVYNQKRKRYHQTGCWRQLKKLLCCCCPKEKPVSGSITALSLWMQSHIPTRGLLVVGYAVYSSGVRWEAILEGETLSPGDRAQLDACLESAQVRLAGLMLNYWDGDFPGYGTSGGRFSPRMQEDIIARFRDKVGICELTDAVALKHFCRRT

SEQ ID NO: 481 - protein, 307 aa, Chlamydia trachomatis
  VARIANT (1)...(307): Xaa = Any Amino Acid
ETFTNGLKEHYVSRDVGFVASLHALGDYILNYTQDDRDGFLARYGGFQATAACHYENGSIFGVAFGQLYGQTKSRMYYSKDAGNMTMLSCFGRSYVASPIKGTETVVYWETAYGYSVHRMHTQYFNDKTQKFDHSKCHWHNNNYYAFVGAEHNFLEYCIPTRQFARDYELAGFMRFEMAGGWSSATQETGSLTRYFARGAGHNMSLPIGIVVHAVSHVRRSPLSKLTLNMGYXPDIWRVTPHCNMEIIANGVKTPIQGSPLARHAFFLEVHDTLYIHHFGRAYMNYSLDARRRQTAHFVSMGLNRIF

SEQ ID NO: 482 - protein, 708 aa, Chlamydia trachomatis
VLAMPFSLRSTSFCFLACLCSYSYGFASSPQVLTPNVTTPFKGDDVYLNGDCAFVNVYAGAEEGSIISANGDNLTITGQNHTLSFTDSQGPVLQNYAFISAGETLTLRDFSSLMFSKNVSCGEKGMISGKTVSISGAGEVIFWDNSVGYSPLSTVPTSSSTPPAPTVSDARKGSIFSVETSLEISGVKKGVMFDNNAGNFGTVFRGKNNNNAGGGGSGSATPSSTTFTVKNCKGKVSFTDNVASCGGGVVYKGIVLFKDNEGGIFFRGNTAYDDLRILAATNQDQNTETGGGGGVICSPDDSVKFEGNKGSIVFDYNFAKGRGGSILTKEFSLVADDSVVFSNNTAEKGGGAIYAPTINMSTNGGSILFERNRAAEGGAICVSAASSGSTGKLTLSASDGDIVFSGNMTSDRPGERSAVRILSSGTTVALNASGLSKLIFHDPVVQINSAAAASTPSPSSSSTPAAVTINQSGNGSVIFTAESLTPSEKLQVLNSTSNFPGTLTVSGGELVVTEGATLTTGTITATSGRVSLGSGASLSAVAGAANNNYTCTVSKLGIDLESFLTPNYKTAILGAYGTVTVKRGSTLDLVMENEAEVYDNPLFVGSLTIPFVTLSSSSTRSGVMVAGVCDVDADAAHYGYQGSWSADWTKPPLAPDAKGMVPPNTSNTLYLTWRPASNYGEYRLDPQRKGELVPNSLWVAGSALRNLY

SEQ ID NO: 483 - protein, 140 aa, Chlamydia trachomatis
LYLNELRPFVQAEFSYADHESFTEEGDQARAFKSGHLLNLSVPVGVKFDRCSSTHPNKYSFMAAYICDAYRTISGTETTLLSHQETWTTDAFHLARHGVVVRGSMYASLTSNIEVYGHGRYEYRDASRGYGLSAGSRVRF

SEQ ID NO: 484 - protein, 212 aa, Chlamydia trachomatis
GMRCLSMAIKEAGSLRGILNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTQQALCGSYLFGDAFIRASYGFGNQHMKTSYTFAEESDVRWDNNCLAGEIGAGLPIVITPS

SEQ ID NO: 485 - protein, 115 aa, Chlamydia trachomatis
SVDHAFQSAFVSFFFVSKQCSYESSYQSSSARFSILQSLVAQLLVLLQLVGLSFLRIWMIQLNDRYDWLGSNQKINVLKLQLGTKPPANAPSDLTLGNEMPKYGYQGSWKLAWDS

SEQ ID NO: 486 - protein, 524 aa, Chlamydia trachomatis
VVFGNLLGSFTVLGRGHSLTFENIRTSTNGAALSNSAADGLFTIEGFKELSFSNCNSLLAVLPAATTNKGSQTPTTTSTPSNGTIYSKTDLLLLNNEKFSFYSNLVSGDGGAIDAKSLTVQGISKLCVFQENTAQADGGACQVVTSFSAMANEAPIAFVANVAGVRGGGIAAVQDGQQGVSSSTSTEDPVVSFSRNTAVEFDGNVARVGGGIYSYGNVAFLNNGKTLFLNNVAFPVYIAAKQPTSGQASNTSNNYGDGGAIFCKNGAQVGSNNSGSVSFDGEGVVFFSSNVAAGKGGAIYAKKLSVANCGPVQFLRNIANDGGAIYLGESGELSLSADYGDIIFDGNLKRTAKENAADVNGVTVSSQAISMGSGGKITTLRAKAGHQILFNDPIEMANGNNQPAQSSKLLKINDGEGYTGDIVFANGSSTLYQNVTIEQGRIVLREKAKLSVNSLSQTGGSLYMEAGSTLDFVTPQPPQQPPAANQLITLSNLHLSLSSLLANNAVTNPPTNPPAQDSQSCSHW

SEQ ID NO: 487 - protein, 79 aa, Chlamydia trachomatis
LILSLSFCVMQTSFHKFFLSMILAYSCCSLNGGGYAAEIMVPQGIYDGETLTVSFPYTVIGDPSGTTVFSAGELTLKNP

SEQ ID NO: 488 - protein, 522 aa, Chlamydia trachomatis
PAMIKRTSLSFACLSFFYLSTISILQANETDTLQFRRFTFSDREIQFVLDPVSLITAQNVTFSNINSWGRGVCTIADNTQTQIFSNSINTTSAAGGVFDMVTISFTASNNANLLFCNNYCTHNKGGGAIRSKGPIRFSNNQDVLFYNNTTAGAQYTGTGNKSEKNRGGALYAKNITLTGNRTLAFINNMSGDCGGAIAANTQISITDTAKGVLFENNHTLNHIPDTRAENMARGGAICSRKSSCSISNNLGPIIFNYNQGGKGGAISATQCVISNNEERIVFSNNSSIGWNKSTHASNGGAIQTAQGFTLQNNKGPIYFDSNTAAHAGGAIDCGYIDIRNNGPIYFLNNSAAWGAAFNLSKLRPATNYIHTGTGDIVFNNNVVFKFDANLLGMRKLFHINNNTQTPYTLSLGAKEDTRIYFYDLFQWERVREPNNAQVSPSSRNVITINPIEEFSGAVVFSYKQMSSDIKTLMGTEHNYIREAPTTLKFGTLAIEDGAELEFFDIPFTQNPTSLLALGSDLR

SEQ ID NO: 489 - protein, 523 aa, Chlamydia trachomatis
STCFRKRPTLTVGKHGKLNITNLGVILPIILKEGKSPPCIRVNPQDMTQNTDTGQTPSSTSSISTPMIIFNGRLSIVDENYESVYDSMDLSRGKAEQPILSIETTNDGQLGPNWQNSLNTSLLSPPHYGYQGLWTPNWITTTYTITLNNNSSAPTSANSIAEQKKTSETFTPNSTTTAGIPSIKASAGSGSGSSTTTDVQVTRHTLTVASNWTPVGYIVDPIRRGDLIANSLVHSGRNMTMGLRSLLPDNSWFALQGAATTLFTKQQKRLSYHGYSSASKGYTVSSQASGAHGHKFLLSFSQSSDKMKEKETNNRLSSRYYLSALCFEHPMFDRIALIGAAACNYGTHNMRSFYGTKRSSKGKFHSTTLGASLRCELRDSMPLRSIMLTPFAQALFSRTKPGAIRESGDLARLFTLEQAHTAIVSPIGIKGAYSSDTWPTLSWEMELAYQPTLYWKRPLLNTLLIQNNGSWVTTNTPLAKHSFYGRGSHSLKFSHLKLFANYQAEVATSTVSHYINAGGALVF

SEQ ID NO: 490 - protein, 989 aa, Chlamydia trachomatis
LSSRSGYFHCLTLHQCRRSSGLLTMKKAFFFFLIGSSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRPFTSSNPNAAVNKIREGGAIHAQNLYINHNHDVVGFMKNFSYVRGGAISTANTFVVSENQSCFLFMDNICIQTNTAGKGGAIYAGTSNSFESNNCDLFFINNACCAGGAIFSPICSLTGNRGNIVFYNNRCFKNVETASSESSDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGAGNSASNASITLKHIGLNLSSILKSGAEIPLLWVEPTNNSNNYTADTAATFSLSDVKLSLIDDYGNSPYESTDLTHALSSQPMLSISEASDNQLRSDDMDFSGLNVPHYGWQGLWSWGWAKTQDPEPASSATITDPKKANRFHRTLLLTWLPAGYVPSPKHRSPLIANTLWGNMLLATESLKNSAELTPSDHPFWGITGGGLGMMVYQDPRENHPGFHMRSSGYSAGMIAGQTHTFSLKFSQTYTKLNERYAKNNVSSKNYSCQGEMLFSLQEGFLLAKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATQRPQAWTVELAYQPVLYRQELEIATQLLASKGIWFGSGSPSSRHAMSYKISQQTQPLSWLTLHFQYHGFYSSSTFCNYLNGEIALRF

SEQ ID NO: 491 - protein, 168 aa, Chlamydia trachomatis
RTDRGEDRSSCTTGVIDKEEIAVITLKRIARSSIDSATFSCCISLNTDVVHKEKTRLILAHNKGISGTNGSSSDIRKVLHKSDHIMIVIYVKILSMNCSAFSYFINSCIRITRCKWSATSIIFKDYRTYCITNLHGRRIGTRITNRTTTFRGEIFCKINTFFLCIKKA

SEQ ID NO: 492 - protein, 348 aa, Chlamydia trachomatis
  VARIANT (1)...(348): Xaa = Any Amino Acid
FSSFTPFLIYNPSLGAAKHTLLLRSNLPSLFQYLFRLLLLPYRVLSTPPPPVISRPSTPSAPKPSTPPPLLPKAPKPVKTQEDLLPLVPEQVFVEMYEDMARRQTIEALVPAWDSDIIFKCLCYFHTLYPGLIPLETFPPATIFNFKQKIISILEDKKAVLRGEPIKGPLPIWCSKENYRRHLQRTTLLPVFMWYHPTPKTLSDTMQTMKQLAIKGSVGASHWLLVIVDIQARRLVYXDSLYNYVMPPENMKKELQSFAQQLDQVYPAYDSKKFSVKIAAKEVIQRGSGSSCGAWCCQFLHWYLKDPLTDALNDLPVDSVERHENLASFVQACEAAVQDLPELSWPEA

SEQ ID NO: 493 - protein, 113 aa, Chlamydia trachomatis
HRHLKIMSESQAGTNASMVCRRAISSYISTNTCSGTKGRRSSCVLTGLGALGRRGGGVEGFGAEGVLGRDMTGGGGVLRTRYGKRRRRKRYWNRDGRLLLSRRVCLAAPREGL

SEQ ID NO: 494 - protein, 339 aa, Chlamydia trachomatis
LFVCLINEQFIMEPIHNPPPQTCSYSRPSTTYTSFKDASCDTKVTRIIIALFLIVISCGLILCAYTFRDLLDADYLAQEGPQQATKLLQQLDDVLTGPPLPIWDNEHLFQFSCLMQNKHRRVLPIDICNPLTKFNFLECICNCLMTKQSVNVNETDMCELFCPPTCTPENYRRLLCTSSVFPFVMWHDPSADTQEAMLTKMDQTMSSGRVGNSHWVLVIVDIEYRCVTFFDSLCDYVASPQQMREQLEGLAVSLGAIYPKEGGADSDQEELLSPFQVRIGSTVKVQSPGEFTCGAWCCQFLAWYLENPDFDLEEKVPTNPSERRALLADFISTTEQAMS

SEQ ID NO: 495 - protein, 753 aa, Chlamydia trachomatis
PRIYGTVFVNKCRKYCGPFFLNTQHVELLVSGKQSSPQDLLGIVSESLNQDRIVLFRPGAETVFVELRGKIQQAESHHSGIFSLPVMKGISPQDYRVYHQNGLLAHDPYAFPLLWGEIDSFLFHEGTHQRIYERMGAIPCEIDGVPGVRFIVWAPHAQRVSVIGDFNGWHGLVNPLHKVSDQGVWELFVPGLTAGACYKWEMVTESGQVLIKSDPYGKFFGPPPRSVSVVIDDSYEWNDSEWLEERIKKTEGPMNLYEVHVGSWQWQEGQPLNYKELADQLALYCKQMHYTHVELLPVTEHPLNESWGYQTTGYYAPTSRYGSFEDLQYFIDTMHQHGIGVILDWVPGHFPIDSFAMSGFDGTPLYEYTRNPSPLHPHWHTYTFDYAKPEVCNFLLGSALFWIDKMHVDGIRVDAVSSMLYLDYGRYAGEWVPNRYGGRENLDAIRFLQQFNTVIHEKYPGVLTFAEESTTFPKITVSVEEGGLGFDYKWNMGWMHDTLHYFEKDFPYRPYHQSDLTFPQWYAFSERFLLPFSHDEVVHGKRSLIGKMPGDAWRQFAQLRLLLGYQICQPGKKLLFMGGEFGQGREWSPGRELDWELLDISYHQGVHLCSQELNALYVQSPQLWQADHLPSSFRWVDFSDVRNGVVAYLRFADADAKKALLCVHHFGVGYFPHYLLPILPLESCDLLMNTDNTRFGGSGKGFREPEILTPEIARQEREAAGLIEADDESGPDCWGLDIELPPSATLIFSVTLQ

SEQ ID NO: 496 - protein, 179 aa, Chlamydia trachomatis
HPCVHRYADESLHGIKKNRFPPKVKGRHKDHEPINHFDDRLDNLGEKFLSLQEEKKSLNGATLPVESYLATQQKRSLPQGGKELSDLDSNFQKQFPKDLVDCSVYQKREVPRVEYLRKKDHNIFCIYLQKRSHRYVVPAFISTFSKRFFILQEIILPCSSTRKRDEYTPGLMIASSLET

SEQ ID NO: 497 - protein, 336 aa, Chlamydia trachomatis
  VARIANT (1)...(336): Xaa = Any Amino Acid
YKGAGSFMIKIAQSFKPYIMEPGAKIPIPGSTLYAQVFPSLWRIFSSSHELVNEGRVPIQGPLQRFAVFQNLNRGGVAVMTEQYKYYLSPNGCYTRSIADLPSASFYSGEYVSFGVHKHADXEKIRRRKDLKEILPFLFRHGALLQNQPNLSMEKTEVALLLDTLDAAIAEPNKERVFSLLERFVYAGLSKTLLPRLYDEEYQGIVSEDPRPGNEAVPFSLLRAAALSMRRIFIQESDGVVTLLPALPPEFPCGRWIGLYFENIGEISFEWSKKTIRRVILKAHVSRELAIISPGVYSSRFRVEEQGRIISCKIKNLLEKVEIKAGTTYLWDRFCK

SEQ ID NO: 498 - protein, 267 aa, Chlamydia trachomatis
LSGGNTLSSILKMFIPIKIARAFILQIFLINKMTPSALFHKRLIEQFTIFLSVDRGISPLSVQAYCQDVLLFLQRASIEATDRINQESVFLFVEKCHKAKESETTLARRLIALKVFFHFLKDVKMLDQQPFIEHPKIWKRLPSILSTEEVNSLLDQPLNIPNLDTHIASRDAAILYTFYATGIRVSELCDLCIGDISDDFIRVTGKGRKTRLVPISIKAKQAIDAYLSSFRDELQKKIPLKNMYFCLSEGKNSIVPVYGNALLFMQN

SEQ ID NO: 499 - protein, 99 aa, Chlamydia trachomatis
TTKKNPSEEHVFLSIRGKKLDRSCVWKRITFYAKLVTTKRISPHSLRHPFATHLLNNHADLRIIQEMLGHSRISSTEIYTHVASESLIEKFHTYHPRDI

SEQ ID NO: 500 - protein, 177 aa, Chlamydia trachomatis
SKNSTPTILEISKICDEVFSSFSLEQVSYKGTRASLENSLVYPRLHLYWDNNSHTGRDSKNYKESAPLPVLQILLLQQERFPKVELEIPNTPHQPQKQQNSTKPSPKGLTAVSFTFPHLFSDAAEKTTDSGYPNKHTRYLNKKIFRRKAMPRIGLEPTCREALDPKSSVSTNFTTWA

SEQ ID NO: 501 - protein, 101 aa, Chlamydia trachomatis
MKQLSILLGMVSLSSAVFGADAVYSGSLVQPSESVLVAGVEFEEQEGERIPYSFYYPYQYDYYYPNTGVDEDTPESFQEKHECPCKKPVPEKKKKKPRRRS

SEQ ID NO: 502 - protein, 316 aa, Chlamydia trachomatis
VPSFLKGLDTLTSVTMDTPTPLSSVPTNASLKGEPGSSSQFSSAEKGVLKTSIGDVVLSQSIEDGGNETQISLVGVVNINMAQEELPALVSPRTFIFLPPETVELEIQIAEMFQALEETPSSDSRSLQQKETSAQTPPAPSGKVSIFSLQAQGSSQTRSLPSSQESLSPQQPARAIQGLNTPFSPAARCTIRAVPLSIVPHRRANPKPSQSVLIIALVLTRQAIQQERLNFLPRNGNFLLKQLKPAQQEEKKETVNKKDILIKNRIVIILTKRKISRMICKCLLLKDPLIRKMKILRKYFLSLTLLIMRPLILRPI

SEQ ID NO: 503 - protein, 294 aa, Chlamydia trachomatis
SKSKTFSKCSHHSSRTYQTGHSTGTAQLSSQEWEFSSQTVKTCSTGREKRDGQQERHSDQEQNSDHSYQEEDLSDDMQVSSSKRSSHPEDENTEEVFSVSHFAYHAAPHPASNLDQESNQSTFQKRPPSPMSLFSSQNATEEAPKEARVENVFLRFMRLMARILGQAEAEAHELYLRVKERTDSVDALTLLLSKINNEKGAIDWNQDEEMRALVDQAKKLGVPIGDSYDWSEEGKKLLKENIQMRKENMEKITQLERTDMQRHLQEVSQCHQARSNVLKLLKELMDTFIYNMRP

SEQ ID NO: 504 - protein, 271 aa, Chlamydia trachomatis
ITKDSYYYVILVCSRTDVALSQTLDLPDASLAVQTEKFPYSCSISKESAPSCIRKIFAHLASQKESAPLSFSRLQPTTPKERILFFGSSPSSQLSSTVRTTTSSPWNLFSNSQARNSTRKLSEKLHLSSELSARDSTKPSSSEPVKPSENLLHTPEHHKESFSSLKKDNLSPIMEEIDSFSAETESLEERLVTQKKEETVAQEQKHPLLRTSTPPSKASGESQDSSEHSSKEDPYSQQPSHKIQRRGTSQKSCSYHHTTYCRDLLFKLPSH

SEQ ID NO: 505 - protein, 320 aa, Chlamydia trachomatis
HKKKKKPLHKNKNILYLEPPPLLPKHQEKVKTRPSTLRKKTLILSNLLTKYKEEERAKRVVPIITPPTVGIFSLSYLLTKQGILADFSAYSAYKDNLETTQQELTMLHQERIEQVQKIVDKSKTMRFWDSLASIVATIIPWIEMGVAVTIIALGGGILSWCSLFAALIMIVISLLEAFDGWRAIAKHLPGNDLEKKMRYLGYVKLALTVFSCLLSLSALYVAKLGMSPLLEGVVKSIAPALSGMLGLTQGVALYLQSSSQKIRARCTQIDARIELINWERDEYFLRAEQLLDSMQTSFEQLTETLQLQREIDQTFTDALR

SEQ ID NO: 506 - protein, 506 aa, Chlamydia trachomatis
PNVYRRLTIAILPMTITVPQETLPSLQTIATGEQTETSCEEASALSNEIQLLEPGQAAILRSLSDLCLSVIEQTEKTLPHSKHSPSFRESCPLKYLSQQTSASSRTQESATAEQQSLTPTPTPQKTPTQTLHNKPSTPISHKSSVQGRIQTSPQHSTPLRSIPVIISLPNTQQALTDREPIQNSNCSPTLSVTIFNKESSSSSKKDSAASREQSSSHSSSLQKNLSSPRAALLSPMALFETTAQKETLAREGLLHEREDLSQEGDRDHHQSDQQQEEKEDLAISASFLSHSKKRREHHFDPEYLPEEIREFALSEAQLSQLLHIRLNHLDILRICAEIMKLMLNSREQDLLERRSTRTHFMQEAKKIADSFAKQARITKWLGIATATLGIFGGISPIIGEVGGEGLLNVIRKATGGWQQASSKTFFEGWGKCVLSLSELAKVSSTVYDLRPKPVRTIAESYKELFRLEHDEMLRSIEELKDHGRNMDSFLLQILQTQHDAVRSLYQ

SEQ ID NO: 507 - protein, 309 aa, Chlamydia trachomatis
MRKIILCSPRGFCAGVIRAIQTVEVALEKWGRPIYVKHEIVHNRHVVDKLREKGAIFIEDLQEVPRNSRVIFSAHGVPPSLREEATERGLIAIDATCGLVTKVHSAVKMYAKKGYHIILIGKRKHVEIIGIRGEAPDQITVVENIAEVEALPFSAQDPLFYVTQTTLSMDDAADIVALAALKARYPRIFTLPSSSICYATQNRQGALRNILPQVDFVYVIGDRQSSNSNRLREVAERRGVTARLVNHPDEVTEEILQYSGNIGITAGASTPEDVVQACLMKLQELIPDLSIEMDLFVEEDTVFQLPKEL

SEQ ID NO: 508 - protein, 352 aa, Chlamydia trachomatis
FAILLSNGSAFLGRASQSLCNEWFEKRVQYWEYDGFLPVIGPVIWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTIILAEDGSF

SEQ ID NO: 509 - protein, 328 aa, Chlamydia trachomatis
KGSLPILGPFLNGKMGFWRTSIMKMNRIWLLLLTFSSAIHSPVRGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSIRAPQLQKSMRSFFPKKDDAFHRSSSLFYSPMVPHFWAELRNHYATSGLKSGYNIGSTMGFSLSLGLLYGSRRVFSALIFLR

SEQ ID NO: 510 - protein, 431 aa, Chlamydia trachomatis
VLVEVFMLKFQLCLLFLFGYLAIVFEHIVRVNKSAVSLAMGGLMWLVCFSHIPHIDHVMMVEEIADMAQVIFFLFAAMAIVELIDAHRGFSIVVRCCNVESRSVLLWVLLILSFFLSAALDNLTSIIIIISILKRLVKAREDRLLLGALCVIGVNAGGAWTPLGDVTTTMLWINDKISTSGIITTLFLPSVVCVVIAGICGQLLLKKRRCSGLSEDLDREPALPKSNLIACVGFGSLLMVPMWKAVLGVPPFMGALLGLGLVWLVSDWIHSPHGEGRNHLRMPHILTRIDISSVTFFIGILLAVASNALTYSHVLRDLSVSMDALFSRNTLAVLLGLVSSVLDNVPLVAATIGMYDLPMNDPLWKLIAYTAGTGGSILIIGSAAGVALAYMGMEKVSFGWYVKHASWIALASYFGGLAVYFLMENCVNLFV

SEQ ID NO: 511 - protein, 416 aa, Chlamydia trachomatis
LVKVSLSFKHLIPKLVTCLKEGYSFNTLKKDFTAGITAGILAFPLAIAIAIGIGVSPLQGLLASIIGGFLASALGGSRVLISGPTSSFISILYCIGVKYGEDGLFTITLMAGIFLVIFGLAGLGTFIKYMPYPVVTGLTTGIAVIIFSSQIRDFLGLQMGDGVPLDFIGKWAAYWDYLWTWDSKTFAVGLFTLLLMIYFRNYKPRYPGVMISIIIASTLVWILKIDIPTIGSRYGTLPSSLPGPVFPHISITKMLQLMPDALTISVLSGIETLLAAVVADGMTGWRHQSNCQLIGQGIANIGTSLFAGMPVTGSLSRTTASIKCGASTPIAGIIHAICLSFILLLLAPLTIKIPLTCLAAVLILIAWNMSEIHHFIHLFTAPKKDVLVLLTVFILTVMTTITSAVQVGMILQPFYS

SEQ ID NO: 512 - protein, 147 aa, Chlamydia trachomatis
AIYLMLSPQQNILMNPNNLKMTCYFSKNEVPPFTEIYEINGPFFFGIADRLKNLLNEIEKPPKIFILCMTRVPTIDASAMHALEEFFLECDRQGTLLLLAGVKKTPLSDLRRYHVDELIGVDHIFSNIKGALLFAKALIKLESKSSQ

SEQ ID NO: 513 - protein, 252 aa, Chlamydia trachomatis
  VARIANT (1)...(252): Xaa = Any Amino Acid
SFRVCSRYKNWKNAFDGCSSNDSWAKEFSGYSCQLHNCLERIGFSLTHLYELAIGGTAIGTGLNVPEGFVEKVIQYLRRETGEPFVPASNYFAALSNHDALVQAHGSLTVLACALVKIATDLSXLGSGPRCGLGEIFFPENEPGSSIMPGKINPTQSEALQMVCSQVIGNNQSIIFSGTKGNFELNVMKPVIIYDFLQSVNLLAGAMRSFADCFVCGLKVNKGQLQQNVERSLMLVTALVPFWGTINVQRLL

SEQ ID NO: 514 - protein, 100 aa, Chlamydia trachomatis
TIMQLTTIPRKLFCPRVIGTTSIKCVLPIFISRANSKALASTTFFKCSNTGIKDPFILCTAAICIAVGKTSFEDWVYSRDHWDARDVYFQALPHDAELLN

SEQ ID NO: 515 - protein, 146 aa, Chlamydia trachomatis
  VARIANT (1)...(146): Xaa = Any Amino Acid
MRQENDSLGIVLVPEDKLFGAQTGXSQEFFSYGKESMPLEIIHALVKIKKCAAKANGDLGCLDAKRRDMIVAATDEILSGEFDEHFPLKVWQTGSGTQSNMNVNEVIANLAIQRHGGELGSKHPVHPNDHVNKPSPQMMFSQRQCI

SEQ ID NO: 516 - protein, 366 aa, Chlamydia trachomatis
MAMALAGLFVLTVLTLSLFYSVLLLERSTFFFFRMEKTSKRSFGKKWVFALIPITVLPCLFYLKDDPKLAAPVPTKSFTLLLDWTPNPNHIPLYVGVEKGFFVDEGISLTLQKNTDTCSSIPHLLLEKVDYTLYHSLGVLKTAVARGGAPVQVAGRLIDSSLQGLIYRKNEGVEKLEDLNGRVLGFCLNDSKNLPNLLEALRKHHVVPSEIKNVSADMISPMLTYQIDFLYGGFYNVEGVTIALKGTPTGCFLSDTYGSPTGPQLLICGKKGSPAMTPQTLQSLQKALSRSLDFCREYPQEAFAIYVEATKDSPKVLSDEQAQWEVTLPLLAKTQEPLSRELLESLLVTLSTTCPDLQASIDTFFY

SEQ ID NO: 517 - protein, 163 aa, Chlamydia trachomatis
KKQSAASLEGKSFCSSRVFCSLSSIIRAPLLFANTSMRSTVVGGCGVMFTGMRAILRNTQASLWSKIPSLSQSPKVAPIALPLMIGPSWLCACAPLAMQQLPFSIVCALLCLSWLMMTITTIVLQTANKAGSQTIIATQTILGLAVVIVGAQLLVSGLQQTFL

SEQ ID NO: 518 - protein, 213 aa, Chlamydia trachomatis
MLHSLFRLTLLFYALFNALGSLPVFIALLKNFSFKKQQRIILRESIFALLLLLLFVTFGRGFFRLLGITLPAFQFTGGLLLGSIAIDMMKALPSQSETLEKDKDEPVFFPLAFPVITGPAMITSTLGHMEEGIFPKEIVLGAIVLAWLFSLITLLFSSSINRLFGQMGLLALERLFGISLALMAGNLMLKALSTAFNIGYYMLHLKALLYVKR

SEQ ID NO: 519 - protein, 237 aa, Chlamydia trachomatis
  VARIANT (1)...(237): Xaa = Any Amino Acid
SLPSYSSYSRCFMRXAKEGVTTNELDLLSRELHKRHNAIPAPLNYGHPPFPKTICTSLNEVICHGIPNDIPLQNGDIMNIDVSCIVDGFYGDCSRMVMIGEVSEIKRKVCEASLEALNAAISILEPNLPLYEIGEVIENCAAKYGFSVVDQFVGHGVGVKFHENPFVAHHRNSCKIPLAPGMIFTIEPMINVGKKEGFIDPINHWEARTCDHQPSAQWEHAILITDSGCEVLTLLDK

SEQ ID NO: 520 - protein, 411 aa, Chlamydia trachomatis
TKKRVLMGFGTVRGKGKAVKSFFLRPLQNLEVGLFSLPIVLLLGEIGCVSSISSVSLVAVLSIVGVFVALVSFFRSWGYGLSVVGAIFFGLALCNNFPVSVFWGGLLTVSFIISYGILLLSVSLVEGHIKEKAVSLSELTASHNSLQDSYNREVQERKEKELLAQSKITALEQELSVSHEQLQEVSRKYTHTSEDLQILIDQRDSWLKDYMTLHQEYVRVVAGDEENVIFPWKVFQGNSEKDSGYQQRVQDAEHKIAHLEKLCEEENSGKRYAEECLDKALADLLESTRLREILEKEIFQKDEEIASLKQEIAAEKLLSSSVSDDRAAYKGKYLQLREQFTVKDSFLKKARRERFLAQEQLLVLKRAKEEEALNLSTTDSFSIIQNLLLQIEALEEEVTYLEELVLHNQNR

SEQ ID NO: 521 - protein, 152 aa, Chlamydia trachomatis
NMSAPTSQVGDTQYVSSLPPLEPLGTPPIAELLFSIYSLLLEAVEIRQETILTQSKQLNDNTNIQQQLNQETNQIKYAVVGSGAKEDENHTSTKPEPKLFCTTLKYPRPISNCPTKWTDYPLSRIYKHQHYAANRSTELLLHQNIELRGKHS

SEQ ID NO: 522 - protein, 92 aa, Chlamydia trachomatis
TKKRIKSNTLSLALELKKTKITRVQNQNQNYSAQRSNIQDQLVTARQNGQIILSHASTNINIMQQIAQQNSSFIKTLNSVGSTVNQLNKPLS

SEQ ID NO: 523 - protein, 84 aa, Chlamydia trachomatis
IYTTIPKNQVNSQNSSYLQNVQSVNQAVGASRQAIQNQISGLGNASQVISSNLNTNNNIIQQSLQVGQALIQTFSQIVSLIANI

SEQ ID NO: 524 - protein, 205 aa, Chlamydia trachomatis
RGYPMSSAIIPTLPEKNTVIPDSTLIEPTSIEINKKSAMYFCIAVMLKLSVATTDYSHAIMAVLQENTLEQQRKTKELINIPLLYVPDLIKKNGSDDEYTNHSTIQAFQTSNQQITANRELIQQELSAAQQRAQANQKSVNATSTESMKILQAVSALLTSLIDLTIKANLTTSLRTNILGCTGFPMHPNNKPCETKGRLTAKNRA

SEQ ID NO: 525 - protein, 232 aa, Chlamydia trachomatis
ELSSPISTNKLPFGESPKTASLLVLVTSCSAPSIAFFLQYFFQVRGPIEWLALSVKGIHQHYFWQWLTYPLVTADTLKLGDLRSLEITQRLLMRNVLDFILFYKATDVIIRKLGTGSFVFLLTTQVSIAGISIWAFLWLIGSTQAFFGPESLICALLIVRVFLDPEKRLTLPLFPISLSRKWSFVLLLHFYFLILILSGAYAILLGSVLSMALAICFCYKENIPNPYRGSYR

SEQ ID NO: 526 - protein, 176 aa, Chlamydia trachomatis
MQENLFYRVIANFMCIEKDLFFMKKALDEARKAYEQDEVPVGCIIVHGDKIIARGHNSVEQLKDPTAHAEMICISAAAEYLENWRLKDTILYCTLEPCLMCAGAIQLARIPRIVWGAPDLRLGAGGSWLNVFLEKHPFHQVECCSGVCYQESEQLMKNFFLEKRKAKDEGRNSRAT

SEQ ID NO: 527 - protein, 95 aa, Chlamydia trachomatis
YLRRHRMSLDKGTKEEITKKFQLHEKDTGSADVQIAILTEHITELKEHLKRSPKDQNSRLALLKLVGQRRKLLEYLNSTDTERYKNLIARLNLRK

SEQ ID NO: 528 - protein, 140 aa, Chlamydia trachomatis
DNSMAFETFSVALDKDKTLIFETGKIARQASGAVLVKMNETWVFSSACAASLSEAVGFLPFRVDYQEKFSSAGRTSGGFLKREGRPSEREILVSRLIDRSLRPSFPNRLMQDIQVLSYVWSYDGKTLPDPPSLFAELLPL

SEQ ID NO: 529 - protein, 198 aa, Chlamydia trachomatis
VPPSLDLVMAGTASAVLMIEGHCDFLTEEQVLEAIAFGQTYIAKICDAIEAWQKAIGKQKNFSAVLDMPEDVQNVVSDFIREKFEKALSFRDKEALEQASKELEESVIANLVQEENSDFSLLNVKAAFKTAKSNQMRALIQDLGIRVDGRTTTEIRPISIETPLLPRTHGSCLFTRGETQSMAVCTLGGENMAQDSKI

SEQ ID NO: 530 - protein, 307 aa, Chlamydia trachomatis
  VARIANT (1)...(307): Xaa = Any Amino Acid
KVGRIGSPGRREIGHGKLAEXALSHVLPETSRFPYIIRLESNITESNGSSSMASVCGGCLALMDAGVPIKAPVAGIAMGLILDRDQAIILSDISGIEDHLGDMDFKVAGTAKGITAFQMDIKIEGITHKIMEQALAQAKQGRSHILNLMTQVLASPKGTVSKYAPRIETMQINTSKIATVIGPGGKQIRQIIERSGAQVDINDDGVINIAASTQESINKAKELIEGLTGEVEVGKVYNGRVTSIATFGVFVEVLPGKEGLCHISELSKQKVDNISDFVKEGDKLAVKLLSINEKGQLKLSHKATLED

SEQ ID NO: 531 - protein, 425 aa, Chlamydia trachomatis
PVLISLKCLLGLEQVESEICSSRRSVMLLGIIFIDEIDAVGRHRGAGIGGGHDEREQTLNQLLVEMDGFGTNEGVILMAATNRPDVLDKALLRPGRFDRRVVVNLPDIKGRFEILAVHAKRIKLDPTVASPLMAVARSTPGASGADLENLLNEAALLAARKDRTAVTAVEVAEARDKVLYGKERRSLEMDAQEKKTTAYHESGHAIVGLCVEHSDPVDKVTIIPRGLSLGATHFLPEKNKLSYWKKELYDQLAVLMGGRAAEQIFLGDVSSGAQQDIAQATKIVRSMICEWGMSDHLGTVAYDEHSEAAPTGYGSYHEKNYSEETAKVIDNELKTLLDAAYQRALDIINSHKEELELMTQMLIEFETLDSKDVKEIMDHSWDADKKRARMKEEGMLYKKISDDLPPPPPQENVQDGTSLKFNTST

SEQ ID NO: 532 - protein, 82 aa, Chlamydia trachomatis
ISLKNPTKFTSLGGRIPKGILLIGAPGTGKTLIAKAVAGEADRPFFSIAGSDFVEMFVGVGASRIRDMFEQAKRNAPWHYLH

SEQ ID NO: 533 - protein, 453 aa, Chlamydia trachomatis
LSACLISIVVSFMAKDKKTNPESKKSFPTAFFFLLFGVIFGVVTVQNFFSAKKASVGFSHQLEHLVNLKLLIPEESRKTALNDNLVSFSGRFREVVPAEGQVRYQYLDLIERKHQIDFELEEASKSLTVLSKEVRNAITWFSAISGMPIPEAGYTISPRTDVGLSVLEPLVVYGPVASPAQIVNLAALENRVRSLPKSTESLRVFGSDLYALIGKYLSPALGIGSESLKKEIKDLHQQVENSLTQVIEGDQAVALYKTVLETLHRISLALVSPEEGTRFHQLRSVRLYREDFNRCVKLLRESDETQVQLDKLRGELVQAVWYFNNQELSSRALEKQDPEVFSRWFEGAKQEWAAFSSNKSLSFRAPDQPRNLVLEKTFRSEEPTPHYSGYLFTFMPIILVLLFIYFIFSRQVKGMNGSAMSFGKSPARLLAKGQKQSNFCGCSRDRGSQRRTR

SEQ ID NO: 534 - protein, 325 aa, Chlamydia trachomatis
CYDNPFIFENDKQLEGFFSSLDKKKKYLLALSGGSDSLFLMYLLKSRAIFFTAVHVDYGWRETSYQEASDLAALCEQEQIPFILDRPEATDPMDSRDIENAARRYRYELFYRLCKEKCFSGVFLGHHADDQAETILKRVFEGAHLGNLKGMSAQVMYRDVALALLRPLLHIPKHKIVEALDSHQVQYVQDITNCNERFLRARMRERLFPYLQDVFGKNIRDPLLSLAGDSAELREYLDQQTAPFLLRVVDNERGKLLPIEQELLKTPFLAKWVCKQFFLNEGLVASKSFLQTVYDHLMTGSTARLRLRNRTVLVKARGVIIESIY

SEQ ID NO: 535 - protein, 365 aa, Chlamydia trachomatis
NVQLIFYYGIIMPILWKVLIFRYLKTTVFCTLSLICISIISSLQEIVSYIAKDVPYATVFKVTAYQIPYLLPFILPASCFISAFTLFRKLSDNNQITFLKASGASQGMIIFPVLIASGVLCCFNFYTCSELASICRFQTGKAIANIAMTSPALLLQTLQKKENDRIFIAIDHCGKSKFDNVIIALKHNQEISNIGFIETIIPDVNKDSVQAKNVLVISKIPLFSEARTSNPNEFYLETLDEFLIPKITATLFAGKSYMKTRTDYLPWKQLIQDARLHLAEILRRIAIGLLCSTMTFSGLALGTYKPRFRKPVLIYALFPILNLIFLIVGKNTIHPISAVMLFLFPQLLSWLIFSWRIYTENQGHA

SEQ ID NO: 536 - protein, 116 aa, Chlamydia trachomatis
  VARIANT (1)...(116): Xaa = Any Amino Acid
KSRACIDMVIWKRYLLSRFWISLSSLFFLAVIFYASIHHSLHAFREGKTAIAGAPLQLSLLYYLSQISLKAEFILPTTRCNCFDNYTIFHAEQKRNSITAGFRAFPENFXTSTSYI

SEQ ID NO: 537 - protein, 154 aa, Chlamydia trachomatis
  VARIANT (1)...(154): Xaa = Any Amino Acid
KQNSFSLQLVAIASTITLFSMQSKREILLLQASGLSLKTLXRPLVISSSLITLLLYANFQWLHPICEKISVTKEHMDKGTLEKAQEKIPALYLKDQTVLIFSSINRRAATLNNVFWIKGPKTIYAIKKLAFTTPSLLSGLKCPIFPKMKITKCL

SEQ ID NO: 538 - protein, 145 aa, Chlamydia trachomatis
NDLCNQKTCIYYSIAPIGLEVSYFSEDENHEVSLTQFFDMKEFPELEFSYYDNPFSKIFITGRDCSFSAFLQAIPWHAAKFGLLTTVPQRILSLLTLFYYMLISPLLCIAAVILSAHLCLRFHRLPKITWAYLVLWEPLIFSLLF

SEQ ID NO: 539 - protein, 491 aa, Chlamydia trachomatis
  VARIANT (1)...(491): Xaa = Any Amino Acid
RKLSISXGKIHESMHENDPLTKTIVWNSDEITKLASSLVYTNDMPIRLFYQKALTNMSAELTVNVHNALMALFLARYEATAVSQQPRKENLSYFNDFLHFLRKAAALLNEKDLLDLQEKHSKSLVSSLSAKLYDHTIDFVEAANYIFLNISSKLQPEEGKKPLSAGQYVAEIYDELHRLFSKYPNGPLFKAIDRMLDPYLKEFDPILLGILPCLEGKLIQGDKEIKVLRTPSPVSQSSILYANCNGEFLHFLDAKTCQGDKILVIIPRPWRPEHATSRSRIIEESLQDYSSVYMSAFPEPEDFLYGLEQVHGELETFADFFSLVQQEFFKPKAQGYCVLPEEMKERMGVFFRRYLFLLLKNVFFSKXKILFKNDKVLLLHLIYYFVVFNLIEQLDPNTLVIMSKDGLDYASVFVSGFAFFENRGNWDEDSLKRMVARMLAPTLVARDRLVFAQHVELLSKFLNCLRKNRHNLKDLRTLFSYDLEGWQFSGI

SEQ ID NO: 540 - protein, 190 aa, Chlamydia trachomatis
  VARIANT (1)...(190): Xaa = Any Amino Acid
KDYFSLALGGGMEKTRKFEKALENLEQLKKISYDYSSGNAEASSHNKALSEMKKAMHYIDHYFKQAGALSQKDVDKVIKETDFLIAGVQDVFSFLEDRKEEVYRSLSQDYRHLNHTYDVTREHLNNKMVEPKEILNGSLENCQDREEFLNNLVEVKRDRSYELFYMANEDNKRFYTDALAQIIYKXREDP

SEQ ID NO: 541 - protein, 194 aa, Chlamydia trachomatis
FRRRSSCSTDAGYFLFGSHHGLGSAPLDFASRELARNKPPVRIVAPGECFRNEDVSARSHVIFHQVEAFCVDKDISFSDLTSMLAGFYHIFFGRKVELRFRHSYFPFVEPGIEVDISCECHGAGCSLCKHSGWLEVAGAGMIHPNVLRKASFDPEEYSGYALGMGIERLAMLKYGISDIRLFSENDLRFLRQFS

SEQ ID NO: 542 - protein, 181 aa, Chlamydia trachomatis
MTIQEELEAVKQQFSCDVSLAHSSKDLFDVKVKYLGKKGIFRGFADQLRKCPIEQKATVGASINACKQYVEEVLLERGKAVLAKEEAEEFLKEKIDISLPGSEEAALGGKHVIKKVLDDVVDIFVRFGFCVREAPNIESEKNNFSLLNFEEDHPARQMQDTFYLDPTTVLVRPRWILRLGS

SEQ ID NO: 543 - protein, 107 aa, Chlamydia trachomatis
  VARIANT (1)...(107): Xaa = Any Amino Acid
MVRATGSVASRSRRKRVLKQAKGFWGDRKGHFRQSRSSVMRAMAFNYMHRKDRKGDFRSLWITRLNVASRIHGLSYSRLINGLKQAGIHLXEKCCLRWLFMTLKGLL

SEQ ID NO: 544 - protein, 214 aa, Chlamydia trachomatis
  VARIANT (1)...(214): Xaa = Any Amino Acid
EKSLFLGKGGLWFFLGSPSAITNFSRVDVALNLRINRQIRAPRVRVIGSAGEQLGILSIKEALDLAKEADLDLVEVASNSEPPVCKIMDYGKYRYDITKKEKDSKKAQHQVRIKEVKLKPNIDDNDXLTKAKQARAFIEKGNKVKVSCMFRGRELAYPEHGHKVVQRMCQGLEDIGFVESEPKLNGRSLICVIAPGTLKTKKKQEKVHAQDEKQ

SEQ ID NO: 545 - protein, 301 aa, Chlamydia trachomatis
MTDSFPFSVQESVPLSRFSTFRIGGPARYFKELTSLSEALTVFSYLHTHPLPYIIIGKGSNCLFDDQGFDGLVLYNNIQGQEFLSDTQIKVLSGSSFALLGKRLSSQGFSGLEFAVGIPGTVGGAVFMNAGTTLANTASSLINVEIIDHSGILLSIPREKLLFSYRTSPFQKKPAFIASATFQLTKDPQAAKRAKALIEERILKQPYEYPSAGCIFRNPEGLSAGALIDRAGLKGLKIGGGQISEKHGNFIINTGNACTADILELIEIIQKILKNKVFPYIKKSVSSPFASSLVVCEKEIT

SEQ ID NO: 546 - protein, 202 aa, Chlamydia trachomatis
VGSFFKRLMMLTGIDILFSNIIKLSHSIFRQVVEPGDTIVDATCGNGKDALFLAQLLRGKGRLVVYDIQQEALDRATANFQSGLLAEERAIIEMKLCSHEYLQEQGAKLFHYNLGYLPSGDKQITTCSESTVTSIYKALELVAPSGIVSVVCYPGHQEGAAELCCVEQVATELDPSMWEVCTHYSVNRRNAPRLFLFRRRQG

SEQ ID NO: 547 - protein, 245 aa, Chlamydia trachomatis
SGEVWGWSRCSLSHTKYFPVKPQDLKLPYFWEERSPQIANHVFYVPNYYSRYEEFVIPTWQELFANNGPICCELCSGNGDWVVEQALKDASVNWIAVEKRFDRVRKIWSKMGTYRVNNLLIVCGEAQTFFSHYVSDASFQKIVVASNFPDPWPKFRHRKHRLFQDLFVQDMMRTLVVGGQLTLATDDYNYLVNAITVMLKYLSPGLKSPHYINVKDNYGGSWFENLWRSKGQEIFCTEFIKRVGI

SEQ ID NO: 548 - protein, 346 aa, Chlamydia trachomatis
MQADILDGKQKRVNLNSKRLVNCNQVDVNQLVPIKYKWAWEHYLNGCANNWLPTEIPMGKDIELWKSDRLSEDERRVILLNLGFFSTAESLVGNNIVLAIFKHVTNPEARQYLLRQAFEEAVHTHTFLYICESLGLDEKEIFNAYNERAAIKAKDDFQMEITGKVLDPNFRTDSVEGLQEFVKNLVGYYIIMEGIFFYSGFVMILSFHRQNKMIGIGEQYQYILRDETIHLNFGIDLINGIKEENPEIWTPELQQEIVELIKRAVDLEIEYAQDCLPRGILGLRASMFIDYVQHIADRRLERIGLKPIYHTKNPFPWMSETIDLNKEKNFFETRDTEYQHAASLTW

SEQ ID NO: 549 - protein, 1072 aa, Chlamydia trachomatis
RRLCFKIENNAYSMFTRIVMVDLQEKQCTIVKRNGMFVPFDRNRIFQALEAAFRDTRRIDDHMPLPEDLESSIRSITHQVVKEVVQKITDGQVVTVERIQDMVESQLYVNGLQDVARDYIVYRDDRKAHRKKSWQSLSVVRRCGTVVHFNPMKISAALEKAFRATDKTEGMTPSSVARGEEINALTQNIVAEIEECCSQQDRRIDIEKIQDIVEQQLMVVGHYAIAKNYILYREARARVRDNREEDGSTEKTIAEEAFEVLSKDGSTYTMTHSQLLAHLARACSRFPETTDAALLTDMAFANFYSGIKESEVVLACIMAARANIEKEPDYALVAAELLLDVVYKEALGKSKYAEDLEQAHRDHFKRYIAEGDTYRLNAELKHLFDLDALADAMDLSRDLQFSYMGIQNLYDRYFNHHEGCRLETPQIFWMRVAMGLALNEQDKTSWAITFYNLLSTFRYTPATPTLFNSGMRHSQLSSCYLSTVQDDLVNIYKVIADNAMLSKWAGGIGNDWTAIRATGALIKGTNGRSQGVIPFIKVTNDTAVAVASNQGGKRKGAVCVYLEVWHLDYEDFLELRKNTGDERRRAHDVNTASWIPDLFFKRLQQKGTWTLFSPDDVPGLHDAYGEEFERLYEEYERKVDTGEIRLFKKVEAEDLWRKMLSMVFETGHPWMTFKDPSNIRSAQDHKGVVRCSNLCTEILLNCSETETAVCNLGSINLVQHIVGDGLDEEKLSETISIAVRMLDNVIDINFYPTKEAKEANFAHRAIGLGVMGFQDALYKLDISYASQEAVEFADYSSELISYYAIQASCLLAKERGTYSSYKGSKWDRGLLPIDTIQLLANYRGEANLQMDTSSRKDWEPIRSLVKEHGMRHCQLMAIAPTATISNIIGVTQSIEPTYKHLFVKSNLSGEFTIPNVYLIEKLKKLGIWDADMLDDLKYFDGSLLEIERIPDHLKHIFLTAFEIEPEWIIECASRRQKWIDMGQSLNLYLAQPDGKKLSNMYLTAWKKGLKTTYYLRSSSATTVEKSFVASPINKRGIQPRWMKNKSASAGIIVERAKKAPVCSLEEGCEACQ

SEQ ID NO: 550 - protein, 263 aa, Chlamydia trachomatis
  VARIANT (1)...(263): Xaa = Any Amino Acid
MNRIEIDLRGKRRVVTPNAITAFGLCCGLFIIFKSVLKTSSSLELMHRLQGLSLLLISAMIADFSDGAVARIMKAESAFGAHFDSLSDAITFGIAPPLIAIKSLNGEYGGTFCSSFLLVTCIIYSLCGVLRLVRYNLFAATGEKATTFTGLPIPAAAACVVSLGVLLASDTLNSLPERARVLLVSLGLLLSGCLMISTWRFPGLKHFHFRVSSSLLVLGIGLVACLFFSGLVDHFTQVFXLVSWLYVLVVAPVFPFINKRSSS

SEQ ID NO: 551 - protein, 149 aa, Chlamydia trachomatis
YMGVFAISLLSQTVCLYFTFFSLGIALGVLFSFKIFTKKLSRQYEIIRDLEHSKAILQMSLDTRRSQEQIMEEFSHKLTSVSQAFARDMKTESQEFFSEKTQAITSVLAPVHNTLSAFKQNLENFETKQAEDRGVSKNNSLNYSLQNRS

SEQ ID NO: 552 - protein, 300 aa, Chlamydia trachomatis
ASRRPRSLKEQLSQLLTAEQKLERETQALTNILKHPGSRGRWGEIQLERILEISGMLKYCDYSTQTVDSSESSSRADIVIRLPQNRSLVIDAKTPFSEEYLTDNHADPTDLVKKIKDHIKTLKTKSYWDKFEQSPEFVILFLPGESLFNDAIRCAPELMDYAGQSNVILSSPVTLMALLKTVTHVWKQENLQNQIREIGQLGKDLYQRMHKLFDHFHKVGKHLGQAVHSYNDMSSSLSARVLPILRTFDKLELSSSHNKIEALSQVSTLPHSPKVPCPESDLAECLSPEASYLKPPSSNQ

SEQ ID NO: 553 - protein, 477 aa, Chlamydia trachomatis
AFRSISVARRRLNKVLPLFALDKVPSLGKEFVLEKEVFAEGEVLHHDCFTNDIIFVELVFDLPALSAEELPWLRLLVFVLLQLGSGNRSYKEHLEFLLEHTGGVDVLYEFSSQATDTDRLSPSISIRGKALISKAEYLFQVIRETLTTVDFSDIARLKELLMQHAESLTNSVRNSPMGYAVSLACCNKSIAGGLAYQMAGLPYVKYIRELLSNFDSQAQEIIDRLQTLYKKCFVGRRQLVISSSKANYQVLHDQRFFGLLDERLEGGELWKNPVLDVVKDSRGIVIPARGAYNVLAFPLGSLAYDHPDAAVLSVAAEVLGNVILHAKIREQGGAYGSGASANLGRGAFYCYSYRDPEVATTYQVLLQGIRDMAAGDFSEEDVHEGILGVIQNLDDPISPGSRGSASYYRSRSGKVPFVRQAFRQAVLSTTKAQICEVVRNRLEGCLSEASFVSFAGEEMLQKSAKELNEAFQIEAAF

SEQ ID NO: 554 - protein, 306 aa, Chlamydia trachomatis
KRSALFMKVSIRSVVVFFIFMGILNLGRHLDFLEEKLLRRVGKVEKQSVTLPLQKRFKEPVRVIERYPSDGADEDKVLFGLAWLTCSIFDQQDLLALHVLDLVLMGTDAAPLKSRLLKSGLCKQVDMSIDSELHEIPVYIVCKGCSHSGSQKLESLILASLEEILQEGIPMHLVEGAVHQLELARKEIAGYSIPYGLSLFFRAGLLRQHGGKAEDGLRIHTLFANLRENIQKPDYLPRLVARGKYFLDNPHYARVIFLPDSQLIAQENKEERNVLHTIQMQMSEEELERVEAVSKRLEAYQSQEED

SEQ ID NO: 555 - protein, 129 aa, Chlamydia trachomatis
  VARIANT (1)...(129): Xaa = Any Amino Acid
WSGSRTRAYGLMXXSESYPIRDPFFSMTRRSLNTFMNAFTGADFTCYPAASQIPEDFYNLLSVYIDAVFHPLLTENSFLQEAWRYERTEEGNLSYTGIVFNEMKGALMSGESRLSEVRMPHCSLRSLTV

SEQ ID NO: 556 - protein, 92 aa, Chlamydia trachomatis
  VARIANT (1)...(92): Xaa = Any Amino Acid
KIEWDMKTGDTYRNFVVKLSQDLPEIESKLIEVEHTPTGATIMMIVNDDDENVFNISFRTCPQDSSGVAHVLEHMALCXGLRVTQFGILFSQ

SEQ ID NO: 557 - protein, 493 aa, Chlamydia trachomatis
VCCYRTSVFSSPMLGYSASKKDSKADICLAVSSGDQEVSQEDLLKEVSRGFSRVAAKATPGVVYIENFPKTGNQAIASPGNKRGFQENPFDYFNDEFFNRFFGLPSYREQQRPQQRDAVRGTGFIVSEDGYVVTNHHVVEDAGKIHVTLHDGQKYTAKIVGLDPKTDLAVIKIQAEKLPFLTFGNSDQLQIGDWAIAIGNPFGLQATVTVGVVSAKGRNQLHIVASPFEDFIQTDAAINPGNSGGPLLNINGQVIGVNTAIVSGSGGYIGIGFAIPSLMAKRVIDQLISDGQVTRGFLGVTLQPIDSELATCYKLEKVYGALVTDVVKGSPAEKAGLRQEDVIVAYNGKEVESLSALRNAISLMMPGTRVILKIVREGKTIEIPVTVTQIPTEDGVSALQKMGVRVQNITPEICKKLGLAADTRGILVVAVEAGSPAASAGVAPGQLILAVNRQRVASVEELNQVLKNSKGENVLLMVSQGDVVRFIVLKSDE

SEQ ID NO: 558 - protein, 299 aa, Chlamydia trachomatis
  VARIANT (1)...(299): Xaa = Any Amino Acid
VVSWERNCVRIIKQGFTDYYTGYYRESRVFSHYTMCRFTDLTFVGGVTPGKGGSQFLDLPIFDSVLEAKRATGCRASMIFVPPPFAAEAIFEAEDXGIELIVCITEGIPIKDMLEVASLMEKSASSLIGPNCPGVIKPGVCKIGIMPGYIHLPGKVGVVSXSGTLTYEAVWQLTQRKIGQSVCIGIGGDPLNGTSFIDALQEFEKDSQTEAVLMIGEIGGSAEEEAADWIRQHSSKPVIAFIAGATAPKGKRMGHAGAIISGKSGDAFSKQEALRQAGVTVVEFPALIGEAVASVLKPR

SEQ ID NO: 559 - protein, 200 aa, Chlamydia trachomatis
  VARIANT (1)...(200): Xaa = Any Amino Acid
RIQSAASSSALPPISPIIRTASVWLSFSNSWRASIKDVPFKGSPPIPIHTLCPIFLCVSCQTASYVSVPDXETTPTFPGRWIYPGMMPILQTPGLITPGQFGPIKELALFSIREATSSISLIGIPSVIQTISSIPXSSASKMASAANGGGTKIIEARQPVALARLASKTESKMGKSKNWLPPFPGVTPPTKVRSVKRHIV

SEQ ID NO: 560 - protein, 142 aa, Chlamydia trachomatis
PKQLGLSYIALDGTIGCLVNGAGLAMSTLDILKLYGGSAANFLDVGGSASEKQIQEAISLVLSDKSVRVLFIHIFGGIMDCAVVASGLVSAMQGQKETIPTVIRLEGTNVDKGKGMIINAGIPCEFVTSMSEGAELAVQLSR

SEQ ID NO: 561 - protein, 245 aa, Chlamydia trachomatis
MHLHEYQAKDLLTAYQLPIPPYHVATSVPEVEAAIQAEQWKAGVVKAQVHAGGRGKNGGVVIAHSPEDLLAAADKLLHMQFSSNQTAGLSLPVNKVLISPLVEIASEYYLAIVIDRKHRCPVIMLSKAGGVDIEEVAEKQPDQLLKMTLPSSGKIYGYQLRRIAKFMEWDQPIADQGNRIIRQLLQCFYEKDASLLEINPLVLTKDGSLVILDAKMTIDDNALYRHPELADCYDPSQENIRDVLA

SEQ ID NO: 562 - protein, 256 aa, Chlamydia trachomatis
FDYSVFKFFGNKLRSLFKRTLSSDLLEYAEVLLYEGDFGPKLTEAFCEELRRCKNPDERAVKELIRSFLSKIISKLPQREPLSVRPFSTLVLGTNGSGKTTTVAKLAHYYLSQNQKVLIVATDTFRSAGMDQMRCWAETLNCGFISGKPGGDAAAIAFDGISAAVARDYDHVIIDTSGRLHTHTNLLKELQKIATVCNKAFPGAPHETLMTIDATLGSNTIESGCNYSMKPYLSKWTYFHKSGRFCQRRLSLPYRR

SEQ ID NO: 563 - protein, 241 aa, Chlamydia trachomatis
EISMGLYDRDYAQDSRLPGTFSSRVYGWMTAGLAVTALTSLGLYATGAYRALFPMWWIWCFATLGVSFYIQAQIQKLSVPAVMGLFLAYSILEGMFFGTLVPVYAAQFGGGVVWAAFGSAGIIFGLSAAYGAFTKNDLTQIHRILMLALVGLVVISLAFLIVSLFTPMPLLYLLICYLGLIIFVGLTVVDAQSIRRVARSVGDHGDLSYKLSLIMALQMYCNVIMIFWYLLQIFASSDKRR

SEQ ID NO: 564 - protein, 397 aa, Chlamydia trachomatis
MCMRNKCVGGILIVAGTVIGAGVLAVPILTAVEGFFPAVVLYVLAWLVSLASGYGYLEVLTWCKGNRQANLCSMAEETLGRVGRIVLCLVYLFLFYSLLVAYFCDGGNILSRVIGESFFSYPWMRHVMPLLFFSLFAPLLMANTSVIDYCNRGFVFGLIFVFGLFCVLGVPRIQGELLLRASWFSSLNSLPIFFLAFGFQNVVPSLYHYLDGNIREVKRAILIGSLIPLILYIAWEALVLGTVPLVDLLKAKDLGWTAAGALQGSLKNSAFYIAGELFGFFALVTSFIGTALALKDFYIDIFKWDARKKRVSLFFLVQVFPLVWAIFYPEIVLSCLRYAGGIGGACIVVLFPVAMLWNGRYGKRRCFGKRILPGGKTVLLILTGYTVLNLATLYYAF

SEQ ID NO: 565 - protein, 417 aa, Chlamydia trachomatis
MESRSRKSMRLSKKGILMINKMLGGALLVAGTTIGAGVLAVPVSTSEGGFLPTTLLYIVSWFIAVASGYCFLEVLTWTHSRKNVNMVSLAEYTLGHKSKIIMWLIYLLLFYSLLVAYFCDGGNILMRVMGCRSWDTPWIRHAMPVVFFALFSPLLMAKTSIIDQCNRVFVFGLGIAFAMFCYFGFPLMKTDLLVRSAWGATLKGFPILFLAFGFQNVVPTLYHYMDKNVKDVKKAIVIGSSIPLVLYIIWEAIVLGAVPISFLEQAKVEGWTAIGALQTALKCAAFYVALAGEFFGFFALISSFIGVSLGLKDFFIDAFQWDEKKRKVEIFFLVFVFPLVWAVFYPGIVLKCLECTGALGETIVLGVCPVLMVWKGRYGKKRYYGKRILPGGKGTLLVMSGLVLLNLVLIAQKFLGY

SEQ ID NO: 566 - protein, 617 aa, Chlamydia trachomatis
LEPGFPNKRIDMCGIFGYLGEKNAVPLVLEGLSELEYRGYDSAGIATLIEGRLFVEKAVGPVSQLCSAVSSDIHSQAAIGHTRWATHGEPSRFNAHPHIDMDASCALVHNGIIENFQKLKEELEEQGVVFSSDTDTEVIVQLFARRYKETRDLIQSFSWTLKRLQGSFACALMHQDHPEVLLCAAHESPLILGLGEDEVFISSDIHAFLKYSGCTQTLASGELVVLRIGKSIETYNFELARIQKEVRCIDHTEDSLDKKGFDYYMLKEIYEQPEVFERILHLTCEENSFTESFLKGFSLDEIQSLHIVACGSSYHAGYLAKYVIESIASIPVYVEIASEFRYRQPYIAEHSLAILISQSGETADTLAALNEFRKLSKARVLGICNVRESALASRVDHCLFIEAGLEVGVASTKAFTAQLLLLILLGLRLANHRQVIAQEDLAQAIQGLKDLPNLTRLFLDSSIHDWRCRQIEETSFIFLGRRFMYPICMEAALKLKEIAYVEANAYPAGEMKHGPIALIREGTPVIVYCGDRSVYTKTIGAIMEVKARKAYVIALAPESNRDIAAVSDEQIYIPDSHDLAAPILFTIAGQIMAYTMALQRGTEVDRPRNLAKSVTVE

SEQ ID NO: 567 - protein, 462 aa, Chlamydia trachomatis
MTRDVSQLFGTDGVRGRANFEPMTVETSVLLGKAIAGVLLEKHAGKHRVVVGKDTRLSGYMFENALIAGLTSMGIETLMLGPIPTPGVAFITRAYRADAGIMISASHNPYRDNGIKIFSSDGFKIGQAVEERIEAMVASKDFGKLPDDHAVGKNKRVKDATGRYIEYAKATFPKGRTLKGLRIVLDCAHGATYRVAPSVFEELDAEVICYGCEPSGCNINAGCGALWPSTIQKAVIEHKADVGIALDGDGDRLIMVASPEKGHIVDGDMLLSICASDLKRRQALPDNRVVALATVMTNFGVLRYLESLGIQVTISPVGDRHVLQHMLENQAVLGGEQSGHMIFLDYNTTGDGIVSALQVLRIMIESESTLSDLTACIVKSPQALINVPVTKKVPLESLANVQGVLKEVKEVLGDSGRILLRYSGTENICRVMVEGTKKHQVDSLAKTIVDVVEAEIGAGISE

SEQ ID NO: 568 - protein, 127 aa, Chlamydia trachomatis
MIYFFVFMTPYLIEALVACCILLSLGMVLIFAFTICLLLKLHKIMKLVSRISSLFNFEARWLAPLLIGKKFILNWLRKKYADRKMSQLADELEDNEDSENSCSSRLLCGAKLAAIALCAWLLIRKKD

SEQ ID NO: 569 - protein, 271 aa, Chlamydia trachomatis
  VARIANT (1)...(271): Xaa = Any Amino Acid
RSFKGDSMTTLPNTCTSNSNSINTFTXDIEMAKQIQGSRKDPLAKTSWIAGLICVVAGVLGLLAIGIGGCSMASGLGLIGAIIAAVVVAVGLCCLVSALCLXVEKSQWWQKEFKSWIEQKSQFRIVMADMLEANQKLQSEVEFLSKGWSDAAAVHKEDVTKYEQVVEKYGEKIMKLYKQTGVLTIEKVNLQKEKKTWLEEKAEMEQKLTTVTDLEAAKQQLEEKVTDLESEKQELREELDKATENLDEMAHEAMEFEKEKHGIKPGRRGSI

SEQ ID NO: 570 - protein, 142 aa, Chlamydia trachomatis
  VARIANT (1)...(142): Xaa = Any Amino Acid
DFSTXKHKADTKQHKPTATTTAAIIAPINPNPEAIEHPPIPIARSPNTPATTQINPAIHEVLARGSFREPWICFAISISXVKVFIELEFEVQVLGRVVIESPLNDRHADGPKKQPQTYFCTNFCFLAKKKERFYLLLNLLTS

SEQ ID NO: 571 - protein, 302 aa, Chlamydia trachomatis
KMHALLINLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANAGLRLIF

SEQ ID NO: 572 - protein, 720 aa, Chlamydia trachomatis
  VARIANT (1)...(720): Xaa = Any Amino Acid
LLVRWKLPIIPSNFFYRKCEXPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGSVEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLKERKSAEVLLINSRENPGYTGSIRFLEAESKVPQCIHVQQGSLELLNGATLCSYGFKQDAGAKLVLAAGSKLKILDSGTPVQGHAISKPEAEIESSSEPEGAHSLWIAKNAQTTVPMVASPIHTISVDLASFSSSQQEGTVEAPQVIVPGGSYVRSGELNLELVNTTGTGYENHALLKNEAKVPLMSFVASSDEASAEISNLSVSDLQIHVATPEIEEDTYGHMGDWSEAKIQDGTLVINWNPTGYRLDPQKAGALVFNALWEEGAVLSALKNARFAD

SEQ ID NO: 573 - protein, 596 aa, Chlamydia trachomatis
  VARIANT (1)...(596): Xaa = Any Amino Acid
FVKKVLFRRFEMSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLIFEKIKGGLEFASCSSLEQGGACGAQSILIHDCQGLQVKHCTTAVNAEGSSANDHLGFGGGAFFVTGSLSGEKSLYMPAGDMVVALANCDGAISFEGNSANFANGGAIAASGKVLFVANDKKTSFIENRALSGGAIAASSDIAFQNCAELVFKGNCAIGTEDKGSLGGGAISSLGTVLLQGNHGITCDKNESASQGGAIFGKNCQISDNEGPVVFRDSTACLGGGAIAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGAILATGKVEITNNSVEFLLQEMRXSTSSSNSRGVSFIQQKRRATTLFRIFWGRSDFRKRSSYSPQRCSSI

SEQ ID NO: 574 - protein, 323 aa, Chlamydia trachomatis
MKVRLGVDMMGGDHDPLVVWEALGEVLLSSTGEQPVEFTVFATSDVHHQLMNSPLSRSVRIVTAEDFVSMEDSLLAAVRKKRSSMALGLDALQQGDLDGFVSSGNTAALVTLARSKIPMIPAVPRPALLVSVPTLSGFAVILDVGATVSVNPDEMVGFARMGLAYRQSLSSNSNQPFTLGLLNIGSEERKGTDSHKQTFRMLRNIFGSAFLGNIESGDVFSGKVASPIVVTDGFTGNVFLKTAEGLFDFLRHILGDRLEKSIKMQFDYTIYPGSIISGLSRLVIKCHGKSHGTALFGGISGAIDLARANVCSRIADRFGDNVV

SEQ ID NO: 575 - protein, 117 aa, Chlamydia trachomatis
AKPIRAKPTISSGFTDTVAPTSKITANPERVGTETNNAGLGTAGIIGILERASVTKAAVFPEETKPSRSPCCNASNPRAIEDRFLRTAANKESSIETKSSAVTIRTERDSGEFINWW

SEQ ID NO: 576 - protein, 525 aa, Chlamydia trachomatis
VRTPVERRAFRNAMENDILLNIESKEIRYAHLKNGQLFDLIIERKKIRQLKGNIYRGRVTNILRNIQSAFINIDERENGFIHISDVLENSKKFEQMFDIDSDADHAEPRPEETSEAPIEELLKLDSPVLVQVVKEPIGTKGARLTSNISIPGRYLVLLPNSPHRGVSRKIEDPLMRDQLKQLIRSFEMPQNMGLICRTASISASTETLINEAQDLLNTWQSILEKFYSPDHPSLLYEETDILKKAVMTCVDKSYKRLLIDDYATYQKCKRLLGKYSPDTTVKIEYYRDSVPMFERFNIEKEIDRATKRKIWLSSGGYLFFDKTEAMHTIDVNSGRSTQLENGVEETLVQINLEAAEEIARQLRLRNIGGLVIIDFIDMKSRKNQRRVLERLKEHMKYDAARCTILSMSEFGLVEMTRQRNRESLMQTLFTTCPYCNGNAIIKTSESILIEIERDLKKIIKHKEHTNLCLVVHPEIAHYMKQEQDDVELIRLAKQLKAKLQINTSDSIHLNHYQFFSLITGEGIEL

SEQ ID NO: 577 - protein, 298 aa, Chlamydia trachomatis
KISAEKAEALCSQWLKVIIDDLKNPIIFPPYHKKIRSPIDLYQFGIDFFSALIDHQKSQILHPERLDQIQEYIQAGHNVVLLANHQTESDPQLMYCLLGASHPQLMESMIFVALAGDRITSDPLARPFSMGCDLLCIYSKRHINHPPELKEEKLMHNQKSMRTLKMLLSEGGKFFYVAPSGGRDRKNLQGELYPAEFHPDSVEMFRLLAKSSGKTTHFFPLAMKTYDILPPPPTIEEAIGEHRVISFAPVAFNFGDELLLDELCSSEEADIYDKHALRALRASRAFSIVTDLYKEILT

SEQ ID NO: 578 - protein, 793 aa, Chlamydia trachomatis
  VARIANT (1)...(793): Xaa = Any Amino Acid
MDNHLPVINDPTNDPKNMKRSLSLLLLCIPSFLTACSKSFQTIRDENPLTILTPALADQKIAKILCPNGLSLMIVSSPHAAESGAALVVKTGNNADPVEFPGLAHFTEHCVFLGNEKYPEPSGFPAFLSTHGGIYNAFTYPDKTCFLFSVNNADLDNALDQFVHLFIQPLFRQEDLNKEVHAVEQEFAMHPTKDSRRMHRIQQLIAPKNHPLKRFGCGNLSTLNSVTTQDMQTWFATHYSPENMAAIVYTTAPLDTAVPYIASLFSEIPISAQYTPQKPFPKTQDTTALNKLFINKAVEPSPQLAIYWHFYDAPQSLQGWAQSLISILSSEKENSLVALLKKEQLITEMEAELYSTSHNTQDFEILYKLTNKGEREYQRVLQLTFAFLDYVRHERLPAYSLPEIQKINSLEYTYSTQTELFSTLSRMVPNFTSEPLATYPYRSLVYPEYSQEDEQTFATFLADPQQARYILSATLPSSWENADEFYDPIFDDTFYEKPLDFTPIQDSSSLGFAFPNPNKFIPQTVQLLSQKKQHEGFAFSPQLTYDQNAITLYTCEDSFYTIPKIAMELRIRSPQIQRTDVRSLVLRDLYSLLANETLIKRYDDALKAGMTFAVSPGATGVDLSLLGYTETSPVLINALLSSLRDLPVEESLFLYYKDQLSEQYQKNLIACPIRAGLNKLYSQILVDTVSLEXKLNTLNTLSYEEFANFTNKLLQELAVESLALGTLSAQDLSNLLSTLSNFAEASSPYAAPSYLSSKKTSLFYKAFVPISSLWKLVCCCSNKTKIPINIRTL

SEQ ID NO: 579 - protein, 251 aa, Chlamydia trachomatis
TGLRSLGDSAILSIFIYRSYRITMAYFDSRNYVFSLFIIAMLILLESRPIEYFSQRVFATIAKIGKQSPICWWWTIMIAAPLSAFFLKESGAMIIAATLLSKQFYKFSPSPKFCYATMGLLFSNISISGLTSSFSSRALLTILPEIKWTNSFIISHFCWKVILAILVSTTILFCLFRKEFKKFPKTIPSTTMMNDRLPSWIIFIHVVLVGCVILSRAIPLFLGFLFIFYLGFQRFTIFYQHPIQNSKSSVS

SEQ ID NO: 580 - protein, 79 aa, Chlamydia trachomatis
GYNSAGFIRSWNMQHTIMLSLENDNDKLASMMDRVVAASSSILSASKDSESNRQFTISKAPDKEAPCRVSYVAASALSE

SEQ ID NO: 581 - protein, 263 aa, Chlamydia trachomatis
NSHTLSSDTFGDQLSLSISSRDSLQVINACHLETPSNSIWKSVALFRRYTGITTPVSWRVVKQIPVGAGLAGGSSNAATALFALNQIFKTGLSDEEMRSLAEQIGMDTPFFFSTGAALGVARGEKIIALEESVSDRYVLYFSSEGVLTSRAFAVVQPSDCSSRKNLEYTQNDLEKPVFRLRLDLKEKKHWLESLWAELPVHIGLTGSGATLFVRYPEILEEDPSYAAQIQRAVTLSGGLLTSPIRRDPTAWYSIYSESALAAT

SEQ ID NO: 582 - protein, 183 aa, Chlamydia trachomatis
RTNKVAPDPVSPICTGSSAHRLSSQCFFSFKSKRNRKTGFSKSFCVYSKFFLEEQSEGCTTAKARLVRTPSLEKYKTYLSETLSSRAIIFSPRATPKAAPVEKKKGVSMPICSAKERISSSDSPVLKIWFKANNAVAALLLPPARPAPTGICLTTRQLTGVVMPVYRRKSATLFHIELLGVSR

SEQ ID NO: 583 - protein, 167 aa, Chlamydia trachomatis
MKPQLLLLEDVDGLGRSGDLVVAKPGYVRNYLLPKGKAVVSSAGTLRLQAKLQEQRLLQAAADKEESLRLAEMLRSIVLDFQVRVDSENNMYGSVTVNDMISAAEQQGVVLTRKNFPRSHSGIKNLGRHVVGLKLKEGVTADLHLEVRADHEIIEQKELQSAEEQEG

SEQ ID NO: 584 - protein, 81 aa, Chlamydia trachomatis
MNRPVHNEHRRKRFAKKCPFVSAGWKTIDYKDVTTLKRFITERGKILPRRITGVSSRFQALLAQAVKRARHVGLLPFVGED

SEQ ID NO: 585 - protein, 112 aa, Chlamydia trachomatis
MQKKTGQLYEGAYVFSVTLSEDARRKALEKVTSGITNYGGEVLKIHDQGRKKLAYTIRGAREGYYYFIYFTVAPEAIAELWREYHLNEDLLRFMTLKASAVKEVLEFATLPE

SEQ ID NO: 586 - protein, 107 aa, Chlamydia trachomatis
SCLSCQEVFRCFHGRYSCCSRRHHREFGFVRFRQDCGSGGHNGIKNTTQILQSNHYWQLRLGVGRPSYPGAEGVADYVLSSFSLNEKEKLNDFLEKGIEEILPWLGC

SEQ ID NO: 587 - protein, 134 aa, Chlamydia trachomatis
MVKLVVGIGNPGRQYVWTRHNIGFLLLDSLASRFLGAFREAPRLYASFAKVEISSEAVVLMKPTTYVNLTGKAVLAAKKFFDVSMEDILVVADDIIGNSVLCVFGKIVALVGTMELRIPRRFCNPIIIGNYVLG

SEQ ID NO: 588 - protein, 127 aa, Chlamydia trachomatis
LLLCSRFLNEGREIKALVKDIQYHVTTYDVIHLDFEELVDGRDVRLNVPIRCINTVDCVGVKLGGSLRQVIRCIRVVCKPKDIVPFLELDVQSLGLSQTLKLSDICIPEGIRPVTSLKEVAVTVARR

SEQ ID NO: 589 - protein, 493 aa, Chlamydia trachomatis
LLKEIINEFYLINETKSLLMKIIHTAIEFAPVIKAGGLGDALYGLAKALAANHTTEVVIPLYPKLFTLPKEQDLCSIQKLSYFFAGEQEATAFSYFYEGIKVTLFKLDTQPELFENAETIYTSDDAFRFCAFSAAAASYIQKEGANIVHLHDWHTGLVAGLLKQQPCSQLQKIVLTLHNFGYRGYTTREILEASSLNEFYISQYQLFRDPQTCVLLKGALYCSDFVTTVSPTYAKEILEDYSDYEIHDAITARQHHLRGILNGIDTTIWGPETDPNLAKNYTKELFETPSIFFEAKAENKKALYERLGLSLEHSPCVCIISRIAEQKGPHFMKQAILHALENAYTLIIIGTCYGNQLHEEFANLQESLANSPNVRILLTYSDVLARQIFAAADMICIPSMFEPCGLTQMIGMRYGTVPLVRATGGLADTVANGINGFSFFNPHDFYEFRNMLLEAVTTYRTNHDKWQHIVRACLNFSSDLETAANKYLEIYKQ

SEQ ID NO: 590 - protein, 219 aa, Chlamydia trachomatis
LGIQKRFLGEQMRVSLPNFLTVFRLFITPIFMILYLKGRWFGLSAAFLPYVLLFLLIITEITDAVDGYIARKFSQVTDLGKLLDPMADSVYRISLYLTFTQPPVNLPLILVFIFLARDSVISTLRTLCASRGQVLAARMSGKLKAILQAISFFFIIFSMFLCAKGIISTDDLEFFSTVIVSLVAFYSICSGVEYIWVNKSHLLQKNDSRMASHREVYCL

SEQ ID NO: 591 - protein, 1033 aa, Chlamydia trachomatis
LFCRARLLFQAVFRVRKALLFLRYLGVFMSSQPLTLQAMMAAILNFWSEQGCIIHQGYDLEVGAGTFNPATFLQSLGPEPFRTAYIEPSRRPQDGRYGQHPNRLQKYHQLQVILKPVPENFLSLYLESLKVIGLNLVDHDIRFVHDDWENPTIGAWGLGWEVWLNGMEITQLTYFQAVGSKPLDAISGEITYGVERIAMYLQKKNSVYDVMWNGSLTYGDITQYAEQAWSQYNFETANTTMWLKHFDDFSAEALATLDQGLPLPAYDFVIKASHAFNMLDSRGVISVTERTRYIAKIRQLARAAADKYVAWRESLGFPLLKTPPSTPTVTPKKIPTICQPEDFLLEIGSEELPATFVPTGIQQLESLAKKLLADHGIAYKHLEVLGTPRRLALCIEGLSHVTIRPESEKKGPPLSLLFMTDGSVSPQGEQFFPSHGLSISHRSALDQPSAICRVRSINGTDYLFLVIPEERKETAAILVNELPQLIRSIRFPQKMTWDNGGVEYARPIRWLVALALYGDQILPISLGFVSSGNTSWGHRQLDNRQLTIPSSNMYVDTLRSACVIVSQKERRAIIKQGLQNLTGDQIVAIAPEHLVDETVFLTEHPFVISAQFDPAFCSLPKELLIAEMIQHQRYFPTQNMQGEITNRFLIVCDNSPTDSIVEGNEKALAPRLTDGNFLFKQDLLTPLSSFVEKLKSVTYFESLGSLADKTSRLKLHLEEAYALLPLCAKEDIDTAIHYCKADLVSSVVNEFPELQGIMGRYYLQNASLSRAAALAIGEHLQHITLGSNISTTGALLSILDRIDNLLSCFILGLLPTSSHDPYALRRQSLEILTLLYTTQSSVDIEDLFARLIRHFPSSIPNTVWSPEEVLSKLNTFVWGRLRTILSSLGFDKEIIATVLTDNCPKNPLTIIQSAQSIQELKNTQILKTIAATHNRLKKILASLSFSVTEQMFSLQSAEDLLFKQALDRFVEETTALPISSKDYLHLLKELAQSTELFLDSVRVASDDESTRNQRIALLIAAQKCFGFYAWDVL

SEQ ID NO: 592 - protein, 164 aa, Chlamydia trachomatis
KRSSLMRFLLALFSLILVLPATEAFSTEDKQCQQEAEEDCSQVADTCVFYSYAEGLEHARDEGKLTLVVLLDTSGYSFETLAYAAHAMESSLLSTFADFVVLSRREAVPLIIPPGSRSYGWRDSVVLRSFLRSNISITACDCYLSYWGFFCRDHGYYRDAVNKS

SEQ ID NO: 593 - protein, 104 aa, Chlamydia trachomatis
NISSLVLNLLGFMRSLHFLLTAFTFSLFCGAALTASSPKTLSFVAAEAAGVGAARPSSVASLLDSAHEVAKSAGVGYGSAYILNELQNLQSQELEGLLASQENI

SEQ ID NO: 594 - protein, 111 aa, Chlamydia trachomatis
SSIFLRKSFIVAEYRAIFVMAMNHYNDRQTLPSMDEMMSLVVGTEAMTLLVARRMNTELMRDIVVQSIQKLLDKHWRDRKRKLCHQTGKGLDSLQEYVRLSGERVKVSLVS

SEQ ID NO: 595 - protein, 144 aa, Chlamydia trachomatis
  VARIANT (1)...(144): Xaa = Any Amino Acid
XHSYEQFTPREKARVIEEVIQQVRCWGSPITIHEYLRQLASLVKVPEPAVLSYLSSITSAAEDKGKKVSAKEPSSESEQTSTEGKISKKISPRMILEADVIRCLLFAKPEDEFVPATVKQYLSPEEFHCGRISSYICYGYESLQ

SEQ ID NO: 596 - protein, 203 aa, Chlamydia trachomatis
  VARIANT (1)...(203): Xaa = Any Amino Acid
SGLGISLKTGFCLLRSIMFPIQDALGYTIGFSSRRFKEGGRGGKYINSPETILFKKSRVLYGLQFSRKRIAKERRVILVEGQADCLQMIDFGFNCTLAAQGTSFTETHVHELVKLGVSKAYLLFDGDAAGEKASLRVGDLCQAAGITAIVCRLPSGQDPDSFLMQRGPEELRELLDRGEDYLSFLVWHKXILMNSLLQEKKLE

SEQ ID NO: 597 - protein, 223 aa, Chlamydia trachomatis
MYYTEESLETLKHSIDIVSVLGEYVHLKRSGADYKACCPFHDEKTPSFIVYPTRGHYHCYGCGEHGDAINFLMKQQGYSFSEAVLFLAKKFHVDLVVRTRETSGQDSKDSFRRINREAERFFQYCLLHLPEGEEALAYLYKRGFSPDTIDRFQIGYAPEQRLFIQAMEERNICVKQLEWAGYLAKDWFLFAQEHHVPDSRCFRLYHWIFFSEVQRRWAWWKIY

SEQ ID NO: 598 - protein, 94 aa, Chlamydia trachomatis
LYLVLRDRKNFLFVVGEQALMYQRTFETRVYNGVEFLGNTRLWEAKFLREKGIHQGERSTHSQENYSALPWRILYRRRAGIACKKILYDAYIHE

SEQ ID NO: 599 - protein, 457 aa, Chlamydia trachomatis
EPVPLLRIKNFFDHAILDKAMTHKLTPMMQQWHQCKEQAGDCLLLFRLGEFYEAFFDDALILAQNLDITLTQRQNVPMSGIPATCLDGYVDRLVSRGFKVAIAEQADNTEGSKGLVPRTINRLITPGALLSSSLLPEKANNYVLAINQVGSLYGLSCLDLSIGTFLVAEYDNTKDLIEAICRLAPTELLSHAKFYQKNAAVIKQLQQHLRITLSEYVSWAFEYQSATKKLYTCFQVSSLDGFGLQGLVPAINAAGALLSYIQDKLLLPISHLSIPKIYGQQKHLLIDKASQTNLELLSPIHGEHGKGSLLQVMERTSTPMGGRLLRNTLINPFYDLKEITLRQDSVEFFLQQEDLRKILKRQLSCVRDLERLATKISTSLATPKDIGTLRDSLLSCTHIANNLQNCALPEFLENKFLIAPPLCSLIKTLSTELIQELPLKVSEGIFSQTTIIQIFYD

SEQ ID NO: 600 - protein, 425 aa, Chlamydia trachomatis
VFDCSPSMLSHKNVIDRAYPRTSFKSVRRNIFANHYHPDLLRLRNIKENSKSWILEYQERIRNETGIKKLKVCYAQALGYYIEVASNLAPQLPKEFIRRQSRLHAERFTTQELQQFQDEVFSVEDKLQTLETKLFKELCFYIVEHRDLILKLSTAVADLDYVVSLAELAAEYDYRRPLVDHSDALSITKGMHPVALTLLDKGTFIPNDTVMHSAQTRMILLTGPNMAGKSTYIRQIALLVIMAQMGSFIPARSAHIGIVDKIFTRIGAGDNLSKGMSTFMVEMAETANILHNATDRSLVILDEIGRGTSTYDGLAIAQAVVEFLLFTDGKKAKTLFATHYKELTELEMHCQHVENFHAMVKENSGQPIFMYEIVKGHSKKSFGIHVAKLAGFPLSVVSRAQQILHQFEGPDLRPEPEKAQQLVMF

SEQ ID NO: 601 - protein, 541 aa, Chlamydia trachomatis
VRIEDFSLKDVSSSPGVYLMKDSQGTVLYVGKAKNLRNRLSSYLQKKGDSRERIPFLMKKTTDIDTIVVSNETEAILLENNLIKKYQPRYNVLLKDDKTFFCLSVSLEHPWPRIEAIRTRALSPGKKKQWLFGPYVSAEACYALLEVISLWFPLRTCSDREFSTRQRPCVLYEMKRCLAPCVGLCSQTEYQETLDKAILFLKGDVRSTISNLEKAIEKASQEQKFEHAAALYRTLTLIRQTMAKQHVEKFQAYDIDVLGLYRKGSLAIVSVLSVYSGKLLGARYFIFPENAQEDSALFPSFILQYYAENPRIPKEIFVPVSLDSPELPYLLNTAEPPKIRCPKTEYGKELLALAHKNAAEQAKPFNSITPPYEELQHFFNLSQYPYRIECYDNAHLQGEHNVGVCIVFENDLFSPKQYRTFSITSHGDDLAAFEEVLTRRFRSLTTELPNLIVIDGGRNQFKRAQRILEELNLTGITVVTIAKESGNHSKSCAKKSYFVKLSPKESFFIPHPQFFSSFSYYEMKPTVSRFNTIVKNMQKQC

SEQ ID NO: 602 - protein, 127 aa, Chlamydia trachomatis
EFNRDYRSNHRQGIWQSQQKLRQEKLFCETFPQGILLHPTSAILQFFQLLRDEAHRFAIQHYRKKHAKAVLTTKKIPGIGEVKTKRLLQKFKSWKRVFIASEEELKTVQGITAKDIQRIQEEGAKPE

SEQ ID NO: 603 - protein, 146 aa, Chlamydia trachomatis
  VARIANT (1)...(146): Xaa = Any Amino Acid
SRYRDPCDSSDHCSLLSKNRWGFIIRXRISLTRFLDAISKXXKGIYVEQDSKNSLVKVRVEVNVASPYGVSIPEKTEEIQGCIVSEISEYTGLHVAAVHVVVKGLTHPKAKDEEVPAIEVIEEPCLEEFSSAEEYLEEVSVIQTEE

SEQ ID NO: 604 - protein, 178 aa, Chlamydia trachomatis
LFTTNLKLGSPPMNSGMFPFTFFLLYICLGMLTAYLANKKNRNLIGWFLAGMFFGIFAIIFLLILPPLPSSTQDNRSMDQQDSEEFLLQNTLEDSEIISIPDTMNQIAIDTEKWFYLNKDCTNVGPISIVQLTAFLKECKHSPEKGIDPQELWVWKKGMPNWEKVKNIPELSGTVKDE

SEQ ID NO: 605 - protein, 120 aa, Chlamydia trachomatis
VSRLTLPKNARLLKRKQFVYVQRNGRCCRADQVTLRVVPSRHSNTSKVGITVSKKFGKAHQRNRFKRIVREAFRHVRPNLPGCQVVISPRGNSQPDFLKLSEELLQRIPEALPLASSSRC

SEQ ID NO: 606 - protein, 99 aa, Chlamydia trachomatis
AVTHFTVALIEFQELAKRSQGQSHVNVAEVIAPLAEYLTQFGEQDKENQWRLEMIISQYYLDAGLPNSALEHAKIAFESAPQDIQSSISRSLVHIEHQS

SEQ ID NO: 607 - protein, 262 aa, Chlamydia trachomatis
EFMSSLRIARSCSFKQKTLLAALVFFGLGASQVCATPSNSREIAWYVDYQEARDESREKDLPMLLFFSGSDWNGSCMKIRDEVLSSSDFISAVADQFVCVVVDFPRHTELRDPLINEQNEDLKNRLYVASNTFPSLVLLSPEERAIYKIESFGNENGSNLGESLCRVIANDQELEQVFPLIPTLSSVALRKYYQLAEELSRKDFMATALEQGVLCDDSFFLSEKFRQLVEAGRMDSEECRAVKNRLLELDPENEQSRISQWL

SEQ ID NO: 608 - protein, 502 aa, Chlamydia trachomatis
LLIMKGWIRSNSTKTRPFRMNTAIDLFLYNTLSREKERFLPVNDPVKLYTCGPTVYDYAHIGNFRTYIFEDLLKRVLLFLGYSVYHVMNITDVDDKTLAGARKKGCSLEKYCQPYIHAFFADLETLHILKADAYPHATHYIPQMIEAIQQLINQGVAYIGQDQSVYFSISQFPNYGALSHLNLEELRNSARIDADEYDKDNLCDFVLWKAYDPDRDGEIFWESPFGKGRPGWHLECSIMSMSLLGQSLDIHAGGVDNIFPHHENEIAQSESLTHKPFVRYWLHSHHLLVDRKKMSKSLGNFFTLRDLLDQGFSGEEVRYLLLQGHYRTQLNFTQEGLHASRQSLKRLRDFICRLEDPSYPDDIIHPEVALATACQSFLETFITSLTNDLNISSSLAALFDFIRKINSSIDQHTGIQTETDSSVFSKQDAQHILALLRKIDQVLGVLPFSQPDIPEEVLLLVEQREAARKVKNWQEADRLRDEILSRGFAIEDGKTGMKVKKL

SEQ ID NO: 609 - protein, 161 aa, Chlamydia trachomatis
NFRNTNISPEKTYVHASRGELIALLFDELVCDKLIAPHHITDHPLETTPLCKTLRSGDETLVERFESFCLGKELCNAYSELNDPLQQRKLLEEQMRKKALNPDSEYHPIDEEFLEALCQGMPPAGGFGIGIDRLVMMLTDAASIRDVLFFPVMRRIEAKKD

SEQ ID NO: 610 - protein, 237 aa, Chlamydia trachomatis
EIAKPFRKETPKVRFAGRLVLFRSMGKNAFGQILDNDAKIQVMFNRDFSAVAGLAADAGISPIKFIEKKLDLGDILGLEGYLFFTHSGELTVLVETVTLLCKSLISLPDKHAGLADKEIRYRKRWADLISSEDVRKTFLTRSRILKLIREYMDQQSFLEVETPILQTVYGGAEATPFVTTLQGLHAEMFLRISLEIALKKLLVGGMSRVYEIGKVFRNEGIDRTHNPEFTMIEAASM

SEQ ID NO: 611 - protein, 150 aa, Chlamydia trachomatis
  VARIANT (1)...(150): Xaa = Any Amino Acid
GACSSHVWRSQLLVLLQNVVLRVRRRSNRVAETGIHWMSYQDALNKAKQEGKHVAVFFTGSDWCIWCMRMQDQILQTAAFSEFDKQYLCMVEIDFPHNKEQTAEQKEQNRHLKSLYSVDGFPTLVFLDSEGXEVAKMGFEPGGGGHMFID

SEQ ID NO: 612 - protein, 762 aa, Chlamydia trachomatis
KRFSIKKRFMDPTHQPFRLYAEVIVNANINKILDYGIPAELENLVTVGSVVKVPLQRKLTNDKYKIAIVLKIKSSSDFVHVIQPILDISYEGITLPQDLIDLIFWISQYYFCPLGSAVSLFLPTVYAQTHSTKHQNNVFLGQNAERTQEILKTLDNPQQIAVLRKLLKTTKPLTPPELMRKTEVSAKTLDALVKQKFIRIVDSADLEIQDEQLHYFLPETPTLNQEQLDAINTISQSLVAEQFQTCLLFGVTGSGKTEVYLQVIRKARALGKSVILLVPEVALTIQTLSFFKMHFGSEVGVLHYKLSDSERTQTWHKASRGLINIIIGPRSAIFCPIQNLGLIIVDEEHDSAYKQSDLPPFYQARDVAVMRGKMTNATVILGSATPSLESYTNALSKKYTLSVLSKRASTSTPTKVFLIDMNLEIEKTRKKPFFSQTVIRSIEQRLEVGEQTIIFFNRRGFHTNVSCSSCKYTLKCPHCDMILTFHKTERILLCHLCNTRLSKPITSCPQCLGTMTLQYRGTGTEKIETLLREFFPTARTIRLDSDTTRFRGSHDALVKQFATGKADILIGTQMIAKGMHFPAVTLSVVLSGDSGLYIPDFRAAEQVFQLITQVTGRSGRSHLPGEVLIQTFLPQNSTISHALAQDFPAFYKEEILGRKVCNYPPFTRLIRCIFLGKCSDYTLKETQRVHTLIKQNLDSQASLMEISPCGHFKVKDLFHYQFLIKTRNILVANKQIQEALAAAKLSSKVRCIVDVDPVTTFF

SEQ ID NO: 613 - protein, 381 aa, Chlamydia trachomatis
GKWVLKEALSIDFITNDFLGFSRLDSLVHAVEARYRLYCRDKPHAQLGYGGSRAILGSSSLLDGVEHQIAHFHGAPEALILPSGFVANTAICAHLSSVADYVLWDEQVHISVSYNLSVFLSGWHQSFRHNDLDHLESLLESCQQRGFQRVFILVCSVYSFKGSFAPLEQIVALSHQYHAQLIVDEAHAVGLFGDAGKGFCASLGYENFYSVLVTFSKALGSAGAAWLSSCDRKQDLIKEPMVSLSTGIPPYLLVSIQVAYEFLSQEGELARTRLRRIRDYFAQKISWAAAGFVQPLSLPGISEQELYQKLVATGIRVGVACPPTGKVLRANLHAFNTEQEVDILVSLLATEQVTYQKNVVTGSTSTMQRTLEDNFAAANAS

SEQ ID NO: 614 - protein, 538 aa, Chlamydia trachomatis
  VARIANT (1)...(538): Xaa = Any Amino Acid
EMRDNRNTARSKRGKLRSEKTVLRSFLKLCAEMTTATVFWDEQLGKLSYNQVYKAVCALATRLANYPDQHIGIMMPASAGAYIAYFATLLSGKIPVMINWSQGLREVTACANLVGVTHVITAKPLMQKLAQTHGEDAEYPFSLXFLDEVRKELSFLEKCRVGICMSIPFEWMMRWFGVFDKDPEDVAVILFTSGTEKLPKGVPLTNASLLANQRACFDCFSPKEDDAMISFLPPFHAYGFNSCTLFPLLSGIPVVFAYNPLYAKKIVEMIDEAKVTLLGSTPVFLSYIINAAKKSETTLPSLRFVVVGGDVFKHSLYQEALKTFPHVQLRQGYGTTECSPVITINTVNSPKHESCVGMPVRGMEVLIVSEETKVPVSTGVTGLVLTRGTSLFKGYLGEDFGHGFIELAGETWYVTGDLGYVDRHGELFLKGRLSRFVKIGAEMVSLEAMESIIMEGCGQNAADHPLVVCGLPGEKERLCLFTIFPTSVSEVNDILKNSKTSNLLKISYHHQVEAIPMLGTGKPDYCSLNALAKRLFSE

SEQ ID NO: 615 - protein, 88 aa, Chlamydia trachomatis
LRHRIWGSSFSRYRTGSTPKLGKVFKEAVKALLRCGIFFMPKREVRVSVCPADYSVLKQFPTKQEFNTFLSDWFNQEGGETPLEVPYA

SEQ ID NO: 616 - protein, 219 aa, Chlamydia trachomatis
SHDIFLIINEKNSSFQNANLLIWIWKYCTLWCKNNFNKPRGSMKIGFWRRLYEVCYTSLIGCALKLRYRVLVEGIESINQNSQKGALFLSNHVAEIDPVILEHVFWLKFHVRPIAVDYLFNNPVVKWFLDSVRAIPVPSVVPGRDDKRLLERIERFYVCVTQALDRKESLLLYPSGRLSRNGKEEIVNQQAAYTILHRAKECDVFLVKTQDLGKFFFTL

SEQ ID NO: 617 - protein, 354 aa, Chlamydia trachomatis
VIVTSLQPAEKLMFSLLNDCQKAAETVVMQAMLSLMRYRKAHKFIPFWKKPDQTYVTPADYAIQYYFYQKLTSLFPHIPLVGEETLNPATDHPRIPQILQFAQQLDPKVSCQDLYQALSPESSHSSLFWLTDPIDGTSGFIKQRCFAIALSLFYEHTPVLSVIACPSSKNNSFKIYSAAKGKGLTICNPTHSFPFSLHEDFQPTCKFCEASLSARNHQHLATHILSKHLPWNPQPIRADSQCKYAWVADNTVDFFIRIPYSPPRAHYRDHAPGVFLIEEAGGLVTDISGNPLPFSNPNLYLDRHPLILASANEQMHSTILETLYKLRHQATQNMLPLATHVSATKHKQLSALQL

SEQ ID NO: 618 - protein, 350 aa, Chlamydia trachomatis
MKYSLQIEDLHIEGYEQVLKVTCESVQLVAVIAIHQTKVGPALGGIRAFPYLQFEDGLQDALRLSKAMTYKALLSSTETGGGKSVIFLPKGMTSPTEGMLRAFGQAVNSLQGKYIAAEDVGVSVQDVMIIREETPYVCGLVTVSGDPSIYTAHGVFLCIQETADYLWKTDIRGKRVALAVQGLGAVGRKLVHELFFAGAELIVYDTRKDLLDEVVTLYGAQVDENIISSDCDILCPCALGGIINSMSIDQLRCRAIVGATNNQLENPAIGRELVALARGILYAPDYLANAGGLLNVAGSVGRAYSPKEVLSKVEGLPKILRKLYEQGAKENRDTGTLADAIVEERLAVYA

SEQ ID NO: 619 - protein, 217 aa, Chlamydia trachomatis
NTLIESDLMSKTPLSIAHPWHGPVLTRDDYESLCCYIEITPADSVKFELDKETGILKVDRPQKFSNFCPCLYGLLPKTYCGDLSGEYSGQQSNRENIKGDGDPLDICVLTEKNITQGNILLQARPIGGIRILDSEEADDKIIAVLEDDLVYGNIEDISECPGTVLDMIQHYFLTYKATPESLIQAKPAKIEIVGLYGKKEAQKVIRLAHEDYCNLFM

SEQ ID NO: 620 - protein, 348 aa, Chlamydia trachomatis
SFYYLCSCSRKEGNSYVRWDQDTLPADSHRCGVIIGSGMGGLRTLDEGIEKLSAGNRKLSPFFIPYIITNMAPALIAMDYGLMGPNYSISTACATANYCIDAAYQHLIEGRADVIVCGGTEAAINRVGLAGFIANRALSERNDAPEQASRPWDRDRDGFVLGEGAGILVLETLDNALKRGAPIFAEVLGTYKTCDAFHITAPRDDGEGITACILGALNKAGIPKERVNYINAHGTSTPLGDLSEVLALKKAFGSHVKNLRLNSTKSLIGHCLGAAGGVEAVATIQAIQTGKLHPTINVENPIAEIEEFDVVANKAQDWDVASPVAMSNSFGFGGHNSTILFSRYEPSL

SEQ ID NO: 621 - protein, 119 aa, Chlamydia trachomatis
  VARIANT (1)...(119): Xaa = Any Amino Acid
MDSFCLNLLKVIVKAIDNKKGRNPVVLDVQNISQLTDYFVFVEGNVGVHIKAIADTIIEELKKLKVYPLNVEGLSHSDWVVIDYGFIVIHLFVSSXREQYCLEELWKDGAIITSDCLAS

SEQ ID NO: 622 - protein, 586 aa, Chlamydia trachomatis
CIARANFDYQLFFLSRLTLTNSYHMDIPEQGSNTPEVEQAACCNQEAAENDRAKDKLSSSEISAEAVQSCESMEAFEQVVALAERSSIEEKILFALEQMGALLKGADQNSDLKLFWNVRKFCLPLFQQLEDPVQRANLWGRYTELTREGRYIKTLQDEEGAFLVGQIELAISCLESGVQGFFSKTEKEEISEEDRAALEIPSLSAHKDFYLSTHADLRWLGSFSSQIINLRKELMNISMRMRLKSQFFQKLSVLGNKVFPRRKELTEKVSELFAQDVEAFVERYFSRASRESLKKSVFFLRKEIKRLQQAAKYLSISSGVFSSTRLGLSQCWDQLKGLEKEIRQEQSRLAATSAENMKEVQGRLDQVEVLLQENEEVHKIRKEIEAISKHIRGISLVHDDVVLLKGRIQTLLGEVREREAVIEKEMKELQAKAEQARAEAIQALENEVQSFCDQCNEGDLPEGAKERCQELKEAVKKMAYLPYAKKVALDNQINAAQRSVLARLEEQMLACPDEKVLNMRQVLEQRMLRRKELKAKFECDKKLLGGSGLDFDRALQYSAMVEEDRKALEELDAAIIELKRQIQQFV

SEQ ID NO: 623 - protein, 372 aa, Chlamydia trachomatis
VLTKKTIGSQSLLWQCIIVNGFMGSPARTSFQEGLRLFLYSPLEELRIHADSLRKQRYPQNTITYVLDANPNYTNICKIDCAFCAFYRKPRSSDAYLLSFDEFRQLMQRYVQAGIKTVLLQGGVHPQIGIDYLETLVSITKKEFPSLHPHFFSAVEIAHAAQISGISTEQALERLWEAGQRTIPGGGAEILSERIRKQISPKKMGPDGWIQFHKLAHRLGFRSTATMMFGHVESPEDILLHLQTLRDAQDENPGFFSFIPWSYKPNNTALGRRVPHQASPELYYRILAVARIFLDNFDHIAASWFGEGKEEGVKGLFYGADDFGGTILDESVHKCTGWDLQSSEKEICAMLLQAGFTPVERDTFYRPLSLAR

SEQ ID NO: 624 - protein, 220 aa, Chlamydia trachomatis
  VARIANT (1)...(220): Xaa = Any Amino Acid
SPHSRRRDRFLFPYFSIRSAIWAFSRFCIAGXLTLEAQERGISALYQELELLDPVYAATITKHDKNKIIRALEIIRKTGSKVSSYAWQSTVNESKEYHCRGWLLSPDPELLRHNILERCDQMLEEGLLDEVQALLAAGIKGNSSASRAIGYREWIEFLDLGSPPDLFEITKQKFITNTWRYTKKQRTWFKRYSLFRELRPMGMTLDDMAKKIAQDYFLCG

SEQ ID NO: 625 - protein, 87 aa, Chlamydia trachomatis
MSSSSSSGAATGFAVCSDPQKSFSKMFKRTVILLAGPTGSGKTAVSLKLAPLVDGEIISVDSMQVYQGMDIGTAKVSLADRKRFRIT

SEQ ID NO: 626 - protein, 310 aa, Chlamydia trachomatis
SNDEILDGRSLYLLSSNKGFSLFFYLKKQFFLDSSRCTLEVILPPRSPSFLVHIWRLFFAKGPNYSLPYAFLCIFVSVLVFLPIGLWLTLPSFLNFKHSLTPIKTLFLTCTEPPCLPEPFFSDILHLSADSPPALQTFSTKSAEHFLNELGVFSFISIEKVPDHKGLDISYALHTPLAFLGNQTHTFIGYEGQTFPALPFFQSLELPTVFFSQQALSQTRIPHQTLSIVTSLIDQLQMDPPSIIDLSQIDHYPGEFVVSLSSGTLLRFRKDSFLPGIQHYQQALSLGAFSPQQAVICDLRCEDYLLLKRK

SEQ ID NO: 627 - protein, 96 aa, Chlamydia trachomatis
LDFMEDFAAYIVKNLVTDPNAVEIRSSEDKASATLKLEIHAASEDIGKIIGRKGQTIQALRTILKRVGARLQKKILVELAQPENGSLTDEEVLSLD

SEQ ID NO: 628 - protein, 616 aa, Chlamydia trachomatis
  VARIANT (1)...(616): Xaa = Any Amino Acid
RRSRASSGFFERFALKTQQICWYNGYCPRLRSCLQGHTFGLDSSCDLHILSYYQEGWRLYFTAKYQDVVYADIEVQLVGMHNVLNAAAAMGIALSLGIDEGAIRNAFRGFSGVQRRLQRKNSSETFLFLEDYAHHPSEISCTLRAVRTAVGQRRILAICQPHRFSRLRECIDSFPSAFKDADEVLLTEVYSAGEEAEDISYQELAEAISQESIVKCTHIPFHELQRHLEQSIRVHDVCVSLGAGNIVNLGEKLRDFEPQKLHLGIICGGKSCEHEISVLSAKNIAKHLSKSFYDVSYFLITREGLWESVSSLETAEDSGKSVFDPEIAQRLEKVDVVLPILHGPYGEDGAMQGFLETIGKPYTGPAIAFSAIAMNKVFTKRFMSDLGIPVVPYLPLTLAGWNQEQXKWLAHIVEAFSFPMFVKSSHLGSSIGVFEVHNVIELRDAINEAFMRDNDVFVEENRLGCKEIEVSVLGDGSGAFVIAGLHERRGSGGFIDYQEKYGLSGKSSAQIVFDTDLSKEIQEQILEAADKIYRLLLGKGSCRIDFFVDEEGNFWLSEMNPIPGMTETSPFLTSFIRKGWSYEQIVHQLVIDGLQRFNQRQRLISTSFVDQAFAIQ

SEQ ID NO: 629 - protein, 268 aa, Chlamydia trachomatis
SNHCISLFVNLYRLMMKSLFYHFIGIGGIGMSALAHVLLDRGYSVSGSDLSEGKVVEKLKNKGAEFFLGNQEEHIPEGAVVVYSSSISKENPEFLSAKSRGNRVVHRAELLAELAQDQISIFVTGSHGKTTVSSLITAILQEAKKNPSFVIGGLNQEGINGGSGSEYFVAEADESDGSIRCYTPEFSVITNIDDEHLSNFEGDRELLLASLKDLHSRLSRSVGIMDIVLACVHACKGILLDWTLLVIYIFYLIIKKDGDCTLQQSIKM

SEQ ID NO: 630 - protein, 328 aa, Chlamydia trachomatis
VMKKINKIVLAVGGTGGHIIPALAARETFIHEDIEVLLLGKGLAHFLGDDSEIAYCDIPSGSPFSLRVNRMFSGAKQLYKGYVAALQKIRDFTPDLAIGFGSYHSLPAMLASIRSRIPLFLHEQNIVPGKVNKLFSRFAKGVGMSFAAAGEHFHCRAEEVFLPIRKLSEQIVFPGASPVICVVGGSQGAKILNDVVPKALARIRESYSNLYVHHIVGPKGDLQAVSQVYQDAGINHTVTAFDHNMLGVLQASDLVISRSGATMLNELLWVQVPAILIPYPGAYGHQEVASNAKFFTHTVGGGTMILQKYLTEESLSKQVLLCFRSCNQ

SEQ ID NO: 631 - protein, 394 aa, Chlamydia trachomatis
ISGIIMKWFLISCLLGIFSLGLIMVFDTSSAEVLDRALSCSTHKALIRQITYLGLGLGIASFVYILGWKDFLKMSPMLLIFVGITLVLVLIPGIGVCRNGAKRWLGVGQLTLQPSEFVKYLVPCVAIECLTTKPSIRSSFKRFVALAFVALLFIPIMLIAIEPDNGSAAVISFSLIPVFIVTAVRLRYWLVPLLCVLCIGGTFAYRLPYVARGNRLQVYLHPELDIKGRGHQPYQAKIAAGSGGVFGKGPGKGLQKLTYLPEAQNDYIAAIYAEEFGFIGMLLLILLYMGFIYSGYVIAMRASLLSGAALAISITVIIGMQAFINLGVVSGLLPSKGVNLPFFSQGGSSLIANMCGMGLLLRICDEENQQNRIGSGGNRRAHYPCSSSKRDFYS

SEQ ID NO: 632 - protein, 133 aa, Chlamydia trachomatis
RNRTAVTIKTGIKENEITAADPLSGSIAINIMGINNRATKATNRLKLLRIEGFVVKHSIATHGTKYLTNSEGCKVNCPTPSQRLAPFLQTPIPGIRTKTRVIPTKISNIGLIFKKSFHPKMYTNEAIPSPNPR

SEQ ID NO: 633 - protein, 255 aa, Chlamydia trachomatis
AFGWDGRGSFMNRRNTMIVATTVNAVLLAVLFMTARHSEQEIEYPQKIAPIKILEPVPVVDKAPEKLEKKPEVIAKPSQVVRNPVVSKAELAAQFADKNPKTEKESSGGSKKISSTPVESTTPVAPEISVVNAKVVEKTPEKEEFSTVIVKKGDFLERIARSNHTTVSALMQLNDLSSTQLQIGQVLRVPKTNKTEKDLQVKTPNPEDYYVVKEGDSPWAIALSNGIRLDELLKLNGLDEQKARRLRPGDRLRIR

SEQ ID NO: 634 - protein, 179 aa, Chlamydia trachomatis
NHWYLHDKYNYCCAYLLAKIEFPISETSFIEAVATFNKPPHRMEYLGQKQGIHYINDSKATTVSATETALLGVGNQAIVILGGRNKGCTFSSLLPALRKAAKSVVAMGECAQEIARDLEEFPVTVVKNLSEALLCAEEQAVPGDVIVLSPACASFDQFRSYEERGAMFKHLVGMEEVLL

SEQ ID NO: 635 - protein, 244 aa, Chlamydia trachomatis
  VARIANT (1)...(244): Xaa = Any Amino Acid
MGLERVVVIGLGVSGRSIVXFLAQKGVCVLGVASPKSLHALQNCPYIXKNIWRTKSSLHRWIMLSSPGVSKEHPWVQAAIASHIPVMTDIQLAFQTEKFTERESLAITGTTGKTTTILFLEYLFKRSGIPAFAMGNVGIPILDGMQNPGVRIVEISSFQLADQEKSYPVLSGGMILNISDNHLDYHGNFSEYFQAKQNLALCMRNPDDLWVGDERFYGHLYLEEVQKYMRLLDKESALKPLVLA

SEQ ID NO: 636 - protein, 351 aa, Chlamydia trachomatis
REFLIRASHNKTRKQMLPLTYVVKAFSIGLFFSLFLMKPLISWLKKQGFQDHIHKDHCEKLEELHKDKAYIPTAGGIVFVFASVLAVLLLFPIQLWSTWFCIGTILLWGALGWCDDQIKNRRRVGHGLSAKHKFLIQNCLAAGVVLPIMFAYKESFLSFHLPFLGIVSLPHHWWSYLLSFAIATLAIVGTSNSVNLTDGLDGLAAGAMVIACLGMLVVACTNGAPWAFICCVLLATLAGSCLGFLRYNKSPARVFMGDTGSLFLGAMLGMCAVLLRAEFLLLFMGGIFVLESLSVIVQVGSYKLRKKRVFLCAPLHHHYEYKGLSEKAVVRNFLIVELICVVVGIIAVFVD

SEQ ID NO: 637 - protein, 205 aa, Chlamydia trachomatis
NGRFLLSSDSFRRVLISAPDGDIELPAVFPYSPAYMNFIIAVALAWITNVPMDRLEQVSQSLFLPAMRFEQQEHNGIRVINDAYNASPDAMLAALDAVPVPPEGGKIIFILGHMAELGRYSDECHIAVALARKAVTKAHIIFFVGEKWFPVRDIVRDADCQIGFYSAVSEIMDTVKALVQQGDVVLLKGSRSLELETLLPCFSIS

SEQ ID NO: 638 - protein, 284 aa, Chlamydia trachomatis
MRPILLEEWSSLLLGMEIPRSGKKVTGVAIDSRLVLPGDVFFALPGNRTSGHLFLKQAAQSGAVALAAVVASDYHGPSYGLQLLRVADPREALRAAGRTQGALFHGEVIGITGSVGKTTTKNFANQLLSSVYKVFMSPKSYNSQLTLPLSVLMADGDEDFLLLEMGVSEPNNMKNLLEIIEPTIGVITHIDVQHAMHFLDKGAQGIVEEKSLLLERCGLQLIPKDSSWFQFFAKKNSAAERFSFSMSNETADFYYRAIHSEESLLVLLMGTLSCLPYFRILQRI

SEQ ID NO: 639 - protein, 440 aa, Chlamydia trachomatis
PLQEYPAMPHDNNEMHRNTIHQLFTGLDKAYQIVKGFYGPAYSSSSKDFFKGRGYHILSRIELSDPFERIGVYFARSLAKRIHKRHADGVISSVILLRAFLKASIPFIDQGLSPRLLASALASQKEAVCAYLHSHSFLLKDASKVLGLIRSHLPDPLIGEAFAEAVAYTGHEGAVALSQRSGSTLHLVKGIQTQKGYRMPSFFPHDSFHENPIVAPKIFVTDQKIHCLFPFLPLLKKFSEEQTPLIIFCKEIAPDPLATCIANRIAGLLDVLVVTIPDTTLLEDIALLTGTTVFSSPPFSNKPPIELPLLGSCTWAELSRDHTLLVCENLVPEVVKLKVRQLDHAIHNSEDETSRKLLKKRKHRLENSIAIIPVKQDTAPLHELALKTLNSTQESGFVLGGGGLFFTLLRASLPLQSILKKNKLLFRFYRPVPHSLGTTG

SEQ ID NO: 640 - protein, 129 aa, Chlamydia trachomatis
TQHKNLVSSWEAEGSSLRYSEPLFLFRAFSRRTSCCSDFTDPCRTLLEQLVNSVYMDGKLVADKLCSLGTPSLGFNVVSQQIEDMISAGIIAPLNAVLDIFSCSLHTAVDLLLASFTTPPTPAAKEKKT

SEQ ID NO: 641 - protein, 300 aa, Chlamydia trachomatis
  VARIANT (1)...(300): Xaa = Any Amino Acid
IGFSINHRFSMPNKPSHAFRLIHCSDIHFCVLPKNPFQCFNKRFKGLLRQLIGGVSFQAFAISQRFPQLVKQLEADSVCVTGDMTITALDTEFRFAKEFLSRVESVAPVYIVPGNHDVXTHRALKKQTFYSYFPNKELQTHRIAFKKLTPTWWLVLLDCSCFNGWYTANGEVTDSQLLALEQFLSSLPASEHVIVANHYPLSPTTRPAHDLLNYAPLKSLLMNSPSVRLYLHGHDHYVELDHLPPLVVNSGSLTLPSNARFHIIDLHPEGGYQIATAALTNLKETSTPLTISIEENTISL

SEQ ID NO: 642 - protein, 101 aa, Chlamydia trachomatis
PFLSKKIPSLYKSSALNLRITNLEGLPMKEKKVLELSPEATLLKKLRDRAISQQETQKRKAWVEKLAAMPESTRDYLEPQAHLEPSQLFRKVAERLLEEGA

SEQ ID NO: 643 - protein, 190 aa, Chlamydia trachomatis
MVRVSTSEFRVGLRVEIDGQPYVILQNDFVKPGKGQAFNRIKVKNFLTGRVIEKTFKSGESIETADVREQQMRLLYTDQEGATFMDDETFEQELIFWDKLENVRQWLLEDTIYTLVLYNGDVISVEPPIFMELTIAETAPGVRGDTASGRVLKPATTNTGAKIMVPIFIEEGEVVKVDTRTGSYESRVSK

SEQ ID NO: 644 - protein, 290 aa, Chlamydia trachomatis
FMTHQHKKISEETIACDMLERYTGSTIQEFQPYLLLTNFGYYVDVFAEIYQVPVSRGSMFSAAHAPQIHTSIIDFKLGSPGAALTVDLCSFLPNATAAIMLGMCGGLRSHYQIGDYFVPVASIRKDGTSDAYFPPEVPALANFVVQKMITNILEAKNLPYHIGITHTTNIRFWEFNKEFRRKLYENKAQTVEMECATLFAAGYRRNLPLGALLLISDLPLRKDGIKTKESSSAVLNSHTKEHILTGVEVFASLQKKSGPGIKKTKGLPHMEFGQADDSLSEQTGVSDGDF

SEQ ID NO: 645 - protein, 201 aa, Chlamydia trachomatis
FDFCWRGWTYTSAYRANHVAAGYSRAKSDSSADANEVKGAWLAALESAGPTALILSRQNLPTLKETKRSFREGVRKGAYILVKEEGDRPDYTLCASGSEVHLAIEVAQSLMALDKRVRVISFPCWELFERQDVEYRESVIGGDLGLRVSIEAGTALGWYKYIGSNGLAIAMDGFGMSGAPNEVAETCGFTVDNIVQRILSV

SEQ ID NO: 646 - protein, 221 aa, Chlamydia trachomatis
KFLASPRRKVFRSSAVKMFFAAKQQEGKKLQEEWQERFRVWSKQAPEQHQEYLRLIQEISIQELEEILNLIDMPESIAGRAASNKVIQVLAEDIPSLVGGSADLSSSDGTWIAKEGTISASDFLGRNIRYGVREFGMGTIMNGLAYSQVFRPFGGTFLVFSDYLRSAIRLAALSKLPVIYQFTHDSIFVGEDGPTHQPIEQIMSLRAIPGLRVIRLRMRMK

SEQ ID NO: 647 - protein, 295 aa, Chlamydia trachomatis
MAGNSDLDIDILEKIAGTIKQLSIESIQKASSGHPGMPLGCAELAAYLYGYVLRYNSKDSRWVNRDRFVLSAGHGSALLYSCLHLAGFDVNLEDLQQFRQLQSRTPGHPEFRETDGVEATTGPLGQGVGNAVGMALSLKMLGARFNQPANSIFDAKVYCLAGDGCFMEGVSHEACSFAGSLGLDNLVLIYDYNEIILDGTLHDVSIEDTKQRFLAYGWDVFETDGHDFESLHQVFTQIKKSQCKPTLIIAHTIIGHGSPKEGTNKAHGSPLGEDGVAQTKSFWHLPEEKFFVLRQ

SEQ ID NO: 648 - protein, 199 aa, Chlamydia trachomatis
  VARIANT (1)...(199): Xaa = Any Amino Acid
MSDPLVYSFLKPRASSLQKVPTKLCSLKLVDSVFGQIFLYCCELKNGLPMLSNTLRSNFLKFYANRNHTPVASSPVFPHNDPSILFTNAGMNQFKNIFLGKEQTSYTRATTSQKCIRAGGKHNDLENVGHTSRHLTFFEMLGNFSFGDYFKQDAISFAWEVSLSVFNFDPDFIYATVHEKDDEXSLFGKNIFRQTEFFV

SEQ ID NO: 649 - protein, 724 aa, Chlamydia trachomatis
  VARIANT (1)...(724): Xaa = Any Amino Acid
XFALWEKYLPTDRIFRLTDKDNFWSMADTGPCGFCSELLFDRGEKFGKAASPLEDVDGERFLEYWNLVFMEFNRTSDGTLLALQKKCVDTGAGLERLVSLLAETKTVFEADVLRHLISKIENLSGTTYSPTEAKGAAFRVIADHIRSLSFAIADGLLPGNTERGYVLRKILRRAVNYGKRLGFNRPFLADVVPSLVDVMGEAYPELSASVTQIQEVLTTEEEHFFKTLQRGGNLLQQVVKSSASSAKISGEDAFKLKDTYGLPIDEIALLAKDYNYAIDMDTFEKLEVEAKERSRKNTKKTKNDSDSVFQDLDPTNTSEFIGYDTLSCDTFIEGIIKYNEIASSLEEGDEGAIILRTTPFYAEKGGQIGDSGEIFCESGTFLVSHTIAPKAGLIVHLGKLSQGSLTTTMAVTAQVNQNLRKKTANNHTGCHLLHKALEMTLGEHIRQPGSYVDSQKIRLDFTHNKALSPEDLLAIETLVNEKIRENDPVTIREVLYSDVMSSSEIKQFCGDKYGDIVRVVLAGFSHELCGGTHAQATGDIGYFRITKEHAVATGIRRIEATTGEDAENIARGQDVDLNEIATVIQSPKDQILVKIRSVMEEKKDLAKQVADLENQLVQQQVKTLLTSCEKICDTSYLVYYLTEEEGQRIQHYANAIHKEIPTNFISLWITEKNGRYIVLSRVSDDLTKRGVQAHTLLAELLAPYGGRCGGKAISAQGSSAEYLK

SEQ ID NO: 650 - protein, 1086 aa, Chlamydia trachomatis
  VARIANT (1)...(1086): Xaa = Any Amino Acid
QNFKTMDFDPTSIDFSSFPLLKDTKLPSLVENLHSGARSFVIAKLFKELKRSIVVITTPAKLDDLFEDLTTLLAESPLEFPASEIDLSPKLVNVDAVGKRDHILYSLQKQSAPVICVTTLKALLERTPSPESMIRDHLELRVGEELDPDTLLDLCKSLGYRHEALAREKGDFAFRGGIVDIFPLSSPEPFRIEFWGDRVSSIRSYNPSDQLSTGKLSQITISPATAIIPTDKLSYSLLDYFKAFPLCIFDGLSSLEDNFSDIAGILASLPKRFMPIQDLCQRILKEFTPLFFEEKTFPNLISHKDTGFSIEAFHKKISVQRVSLPFIYPPALIETSGEQNPLLAFLKTFQDFCAGRTLSLALYCSNTKSLKEAHDLAAACIPNTQIYDHPTTLSSSFALVEAGFAAVSLSEFAASKVLRRQKQRNYFSTTTEEVYIPVPGETVVHLHNGIGKFIGIEKKPNHLNIETDYLVLEYADKARLYVPSDQAYLISRYVGASEKAPDLHHLNGAKWRRSRELSENSVILYAEKLIQMEAQRSTANSFIYPPHGEEVIKFAESFPYEETPDQLKAIDQIYADMMSDKLMDRLICGDAGFGKTEIIMRAAVKAVCDGHKQVIVMVPTTILANQHFETFSQRMAGLPITIGLLSRFSQGKTMKKTLEDIAQGRIDILIGTHKVINKAIEFHNPGLLIIDEEQRFGVKAKDSLKERFPTIDCLTVSATPIPRTLYLSLSGARDLSLITMPPLDRLPVSTFVMEHSEETLSAAIRHELLRGGQVYVIHNRIESIFRLGETIRTLIPEARIGVAHGQMHADELASIFYKFKTQQTNVLVATALIENGIDIPNANTILIDHADKFGMADLYQMKGRVGRWNKKAYCYXLVPHLDRLSGPTSKRLEALNKQEYGGGMKIALHDLEIRGAGNILGTDQSGHISAVGFNLYCKLLKKAVALAALKHKQKPMLFHDDIKIEFPYHARIPEDYIDLASMRIEFYQKIGNAESEEELEAIEEELRDRFGPSPEAISWLFALARIRLIAQEYHLSSIKGTGNALYIQQYHDKDKQIQKTLPYSLSPTPELLVKEVQESVEKAFPK

SEQ ID NO: 651 - protein, 136 aa, Chlamydia trachomatis
SRIIDSGEGVLSNKAFSVVTQITGALCFCREYRIWSLFPTASTFTSLGDKSISEAGNSRGDSANRVVKSSNKSSSFAGVVITTIERLSSLNSFAMTKDLAPEWRFSTKDGSFVSFNKGKLEKSMLVGSKSIVLKFC

SEQ ID NO: 652 - protein, 337 aa, Chlamydia trachomatis
RMPMTGFYETISPRDQQRPPIWFLRQVGRYIPQYQELKRNRSLKDFFLDTESIVEATLLGPSLLGVDAAIVFADILSILEGFSVDYRFAPGPEVSYSPHEPLIFTKDPQETFSFLLEAIQQLTKRLTVPLIAFAASPFTLASYLIEGGASRDYPKTIAFLYQYPDRFKALLDEITLGTATYLQMQVQAGAAAIQLFESSSLRLPPHLFAKYVVAPNTKLIRQIKQTGNPPISLFCRCFYQEFLSLYAIGADTLHPDYHVELPEVYRQIHSPGSIQGNFDPALLLLPQDALIAHLEAYLAPLKQQSHYIFNLGHGILPQTPIENVQAVVSCLTSISTS

SEQ ID NO: 653 - protein, 320 aa, Chlamydia trachomatis
MFNINFNFLKGLHQPAPRYTSYPTIVDWESSSDYGYTALERLAQEQDPLSLYFHIPFCQSMCLYCGCTVVLNRKAEIVDHYIETLIQEMRLAFSLLGGKKPVSRIHFGGGTPSRLSRAQFERLFTHIHRFFDLSNIEELAIEFDPRSLREDADKPLFLHNLGFNRVSLGIQDTQWEVQEAVRRRQSYEESLLAYQLFRDLKFTGINIDLIYGLPKQTQSSFKQTIEHILDMRPDRLALFSFAHVPWAKPHQKALRTKDLPSMEEKFAIYSQSRHTLIQEGYQAIGLDHFSLPDDPLTIALKNKTLIRNFQGTLFLLKKIF

SEQ ID NO: 654 - protein, 149 aa, Chlamydia trachomatis
FPRYSLPPEEDLLGFGISATSFIRGIYLQNVKDLREYSETIQASKLATVKGKILSQDDKIRKWVIHTLMCSFSLSKLEFEQRFHERFDRYFADSYDRLCGMESAGLIRQDSSSLQVTPLGELFVRVIATAFDHYFLKNIVEKPLFSKSI

SEQ ID NO: 655 - protein, 424 aa, Chlamydia trachomatis
MKHALIVGSGIAGLSAAWWLHKRFPHVQLSILEKESRSGGLIVTEKQQGFSLNMGPKGFVLAHDGQHTLHLIQSLGLADELLYSSPEAKNRFIHYNNKTRKVSPWTIFKQNLPLSFAKDFFARPYKQDSSVEAFFKRHSSSKLRRNLLNPISIAIRAGHSHILSAQMAYPELTRREAQTGSLLRSYLKDFPKEKRTGPYLATLRSGMGMLTQALHDKLPATWYFSAPVSKIRQLANGKISLSSPQGEITGDMLIYAGSVHDLPSCLEEIPETKLIKQTTSSWDLSCVSLGWHASLPIPHGYGMLFADTPPLLGIVFNTEVFPQPERPNTIVSLLLEGRWHQEEAYAFSLAAISEYLQIYTPPQAFSLFSPREGLPQHHVGFIQSRQRLLSKLPHNIKIVGQNFAGPGLNRATASAYKAIASLLP

SEQ ID NO: 656 - protein, 856 aa, Chlamydia trachomatis
  VARIANT (1)...(856): Xaa = Any Amino Acid
KILHRSFQNGLLRCPHDEKSLQSSLKRNKQVFFHMNIYRFISGSCSWFLIGWGICFGADVPLSFGHQCADVRKAMQEGKPLLPIFDAFIRRIVNDSSSLSEKDWETATWLICEYIRGSLKRGEQELCSELVKPLFSLAVMPPQSKARIKQVWQVLNPQGASLKDLVRLLESSGCSSSPQDHLLLSLYNMTLHSSYENKKAEILFAREQKNYQDALRLCEELQENLTSGLCSPLSTVYEVEQAFLKRISLAIRWEQEKELQGSPSIELLLAYCSAEESYAEAVEQLIKKIELGSLDRSQEVDAILFAHALSKLPWEETLGEHELEVLISGGHYLTSIYSQHAYFSLLEQYFKKSQIQEISRLLDFGKTVFVETHKKYPEYLFFLGKYWFYLRDFSRAEEAFSSVIRYADRLGVSLAETYEYLGCLACYKGHYASAKEFFLKAYKGWGREDAGIGLYLLAVLEKDPILCQQVREQVSLSFSHQEFLKWMDRNFLPEPGKEGSSFFKVLGSSRXLSEEEFYGXLLKEMISRXHREKLSCSPIQRLVYDQLDREIQLRLTETLIQTEDLLVRRKLSLWRALYEGSFVSWGSAHQNQTLFEKSILQCFSALSQQDPSAIQQIAEAFSSGASLWQSSLRMVWAVSHTSENPISKAYSLGISDRPWGDRLYLLQYSLEQYLSGDTELLEYLTQFPELFPNSPLLPLVYYLQARGEGDPIRKIAWLTKALETFTENSLLAKEMKAWAPLYYLMRMDLAETYLYLGNVSKSDTLFEAIQEEWDAPHHPYVKLIDPPHIRVSLEMRWVSGLAHVYEAIQATEQRNALLISHIEKRFFQTRPRQEYIGKMLTFTSSLCRELLADASW

SEQ ID NO: 657 - protein, 127 aa, Chlamydia trachomatis
MALKDTAKKMTDLLESIQQNLLKAEKGNKAAAQRVRTESIKLEKTAKVYRKESIKAEKMGLMKKSKAAAKKAKAAAKKPVARGATKTVAKKACTKRTCATKAKVKPTKKAAPKTKVKTAKKTRSTKK

SEQ ID NO: 658 - protein, 437 aa, Chlamydia trachomatis
SLLFFLLSFPFSQRQVLANKSTTSHLLWRKNLSLSLGFKLLSCYRNCKHFGVCGGCSSPQMEYASSLKTKELALHNLFAPLIPSQNILPVIPCSPLLRGRNKMEFSFYQTVDGEKTLGFISPSKPKKGIPITECLMIDERAMDILNITRSWWTAHPDLSAYYPPLNKGSLCTITVRVGNISNDFMIILTTSGREEFAVPLNIIQEWQQSLLDSGLPITSIFWEEKLSARNSPTTFRTTHLYGAPFLKQQLSIDGRSSLFHIRPRSFFQPQSLQAEKIIQTIKEFIDPCGEETLLDLYCGAGTIGILLAPYVKKIIGVELVPDAVASAQENIQLNSVASPMEVFLEDAKQFCKRNENLPSPDIVVIDPPRCGMQNKALKYLLRMAPKKIVYVSCNPLTQIQECSVLVEQGYQLRHMQPIDQFPHTNHLENIVLLERLS

SEQ ID NO: 659 - protein, 162 aa, Chlamydia trachomatis
  VARIANT (1)...(162): Xaa = Any Amino Acid
SFGKYCALRKAFLKQESLIPNAVPSGKGLIPLSSCVNLSFLTLIKGTSMYSRLFFSILXFLGCCPALFADTDSPQRATFGQPAVMLGIAIVFFYFILWRPEQXRRQAMEKRKSELAVGDKVTAMGIVGTIAEIREXTVILNIASGKIEILKTAISEILKAEK

SEQ ID NO: 660 - protein, 131 aa, Chlamydia trachomatis
ISGIAIPSPCGGKAACKQCKVRITKNADEPLETDRSTFSKQQLEQGWRLSCQTKVQHDLCLEVEDRYFNASSWEGTVVSNENVATFIKELVLSVDPSRPIPFKPGGYLQITVPPYKTNTFGLEADYGSPIL

SEQ ID NO: 661 - protein, 267 aa, Chlamydia trachomatis
ILRALFLLNLEAIYKLPFLLIKPILSDWKQTMDPQYYSDWETFHLFDQVIDNLSLDTDSANKAYSLASYPAELPLIKFNVARGIATPSFVDQAPDPTIPWGVCSSYIFSLKPGDKVMVSGPYGESFMKENNRPVIFLIGGAGSSFGRSHILDLLLNKHSDRELTLWYGARSLKENIYQEEYEKLEKEFPNFHYHLVLSQPLQEDLDQGWDKNDPIKTNFLFKAFELGQLSHLPNPEDYLYYVCGPALHNSSILTVLDNYGVSALLLF

SEQ ID NO: 662 - protein, 660 aa, Chlamydia trachomatis
MGKERKKASVSLFSTKQSLLLKHACYLALACFSGLSLWSFQHNQPYTQNWIGLLGWSLSSFLLYNFGVAAFLIPLNFGWLSFLNMKRTPAPLAFRKAAAFGAIPVCCAVLLSMISPAQNLPQFLATRVPMVVMDLQPPKAYLGGIPFYLLYDGNSFSLKLLIGAVGTGLIFLAILLCAIFYLIPKSFVLKKKALLDDLLKFLKNKFYACWNACKKLLKNLVNNKSYVPEPSLRVPSSPSVALAKKEMLKLPTPVISLPLENKDLHDDSSVNRTIFLTPPHPTKRTLSPQKRTDLPNLLPKDSASAPAQTSYKPLPTPSPFVLAGDAPDLPQYHLLSKRNVRRPESLLEELKKKAAILQQTLASFGIEAAIGNICSGPTLAAFEVLPNTGVKVQKIKALENDIALNLQASSIRIIAPIPGKAAVGIEIPNPDPQPVNFRDLLEDYQKGTQRLQVPLLLGRKANGDNFWTDLATMPHLIIAGTTGSGKSVCINTIVMSLIMTSPPTDIKLVIVDPKKVELTGYSQLPHMLTPVITESKEAHSALIWLVARGEMELRYEILRFLGLRNIQSFNSRTRNVDIEASYDKEIPEKMPFIVGIIDELSDLLLSSSHDIETPIVRLAQMARAVGIHLILATQRPSRDVITGIIKANSLLESPLKLPTK

SEQ ID NO: 663 - protein, 181 aa, Chlamydia trachomatis
SCRNPPNLSNTTPFSRCDHRNNQSKFPSRIAFKVANKVNSQIIIDEPGAENLMGNGDMLVVSPGSFAPVRVQGAYICDDDINKVIKDLCSRFPCKYVIPSFNTYDDPGSMDPEDLDPLFNQAKTLVLQTGNASTTFLQRKLKIGYARAASIIDQLEEARIVGPSEGAKPRQILVQLSNQDD

SEQ ID NO: 664 - protein, 263 aa, Chlamydia trachomatis
SMEGFCPIASGSKGNCAYLGTRSCKLLIDLGISKQAVTEALHSMGIHPEDIQGIFVTHEHSDHIAGLRSFIKTYRTPIICNIETARSLRQLLDLCPTFKIFTTGHRFSLEDLRVQTFNVPHDAVDPVGFIFQYSGMKLGFCTDLGWVTSWITHLLCDCDYLLIESNHDPEMVLRSSRPESCKQRILSKQGHISNAECGALLQRVLTPRIKKIYLAHLSLECNTAEQALNTVTSAIQEITDVHPVIAQSSGITDPIFFSAPSLV

SEQ ID NO: 665 - protein, 260 aa, Chlamydia trachomatis
YGRASFEYSDVCHSRDHRCSSRNCSKFWHYRSYFLFCSEPCMTTNSTQDTLYLSLHGGIDSAIPYPVRRVEQLLQFSFLPELQFQNAAVKQRIQRLCYREEKRLAVSSLAKWLGQLHKQHLRAPKNPPVAICWINSYVGYGVFARESIPAWSYIGEYTGILRRRQALWLDENDYCFRYPVPRYSFRYFTIDSGMQGNVTRFINHSDNPNLEAIGAFENGIFHIIIRAIKDILPGEELCYHYGPLYWKHRKKREEFVPQEE

SEQ ID NO: 666 - protein, 156 aa, Chlamydia trachomatis
IQETSIMQLTSQAFSYGRPIPKKYSCQGVGISPPLSFSDVPREAKSLVLIVEDPDVPPSVREDGLWIHWIVYNLSPVVSNLAEGAQIFAVQGLNTAGEIGYCPPCPPDAKHRYYFYAYALDVVLSDEEGVTKEQLLEAMDGHIIATAELMGTYEKD

SEQ ID NO: 667 - protein, 455 aa, Chlamydia trachomatis
  VARIANT (1)...(455): Xaa = Any Amino Acid
MLQFLKQINHFLTSFCVFPLILCLGGILTWKLRGLQFTSLGMSFRLMLNNQQEQAGAEGEGVSRYEAVAGMLAGNFGTGNIAGMAIAVASGGPGALLWIWIVTLFAAIVQYAGAFLGCKYRQFQKESQEYIGGPIACLGYKMGSRFXAVAXCVASLITAFSAGSLVQVNSIISLCADGVSAKIAVGILLALSVYPILAGGNTRVLRFSAKAIPFVAGFYFLFSVIVLAMHCDKILPALQLVFSSALGVKAGIAGVGGYTLGQVISTGLNRAIMATDGGSGMVSILQSNSKSTNPVTDGLVTLLPPVIVAVVCSITMMVLLVTGAYDSGELGVLMVMNAFKSSLGMLGGSVVLISMILFGYTTALSWFACAEKSLEYMIPGKRANLLLKAIYIAIIPMGGVLGMQFIWALSDLGFCGMVIFNSISLIALFREVIATRYEVALLRKEAQAQSDPLRQ

SEQ ID NO: 668 - protein, 119 aa, Chlamydia trachomatis
CLLLLISLLLLWLWLRGKLKAHYRVLERSILLHLLQALAEDPALIAGMKKMQGRDWVWNIFITELSKVFSQAASLGLSALQTFAAFASTLGLDSGTVTSIVDGERWAELIDVVIQNPAI

SEQ ID NO: 669 - protein, 214 aa, Chlamydia trachomatis
YYKFIFNFGRFMKKFIYKYSFGALLLLSGLSGLSSCCANSYGSTLAKNTAEIKEESVILREKPDAGCKKKSSCYLRKFFSRKKPKEKTEPVLPNFKSYADPMTDSERKDLSFVVSAAADKSSIALAMAQGEIKGALSRIREIHPLAFVTSSCRRSCFNCWNEKDARTGLGLEYLYHRIKQSFFSSSIFRAFSVADVCRVRVDLRIRLGDRYLNC

SEQ ID NO: 670 - protein, 429 aa, Chlamydia trachomatis
CPCFLSTSTSRNVPSSTTKIGSEVWIEQKVRQYPELLWLVEPSSTGASLKSPSGAIFSPTLFQKKVPAFDIAVRSLIHLHLLIQGSRQAYAQLIQLQTSESPLTFKQFLALHKQLTLFLNSPKEFYDSVKVLETAIVLRHLGCSTKAVAAFKPYFSEMQRETFYTKALHVLHTFPELSPSFARLSPEQKTLFFSLRKLANYDELLSLTNTPSFQLLSAGRSQRALLALDLYLYALDSCGEQGMSSQFHTNFAPLQSMLQQYATVEEAFSRYFTYRANRLGFDGSSRSEMALVRMATLMNLSPSEAAILTTSFKTLPTEEADTLVNSFYTNKGDSLALSLRGLPTLVSELTRTARGNTNAEARSQQIYATTLSLVAKSLKAHKEMLNKQILSKEIVLDFSETAASCQGLDIFSENVAVQIHLNGTVSIHL

SEQ ID NO: 671 - protein, 85 aa, Chlamydia trachomatis
SKKTPDLIRRSSFSTPFYSFPIRENNDAISKAVFMPEAPKLGPLIPARSQAASILGAVITENVIGRQKSKDRRLTPAATLSAICS

SEQ ID NO: 672 - protein, 99 aa, Chlamydia trachomatis
IPCAIKKLLSTSGQFHAVVACGVLIQGETSHYEHIADSVAAGVSRLSLDFCLPITFSVITAPNMEAAWERAGIKGPNLGASGMKTALEMASLFSLIGKE

SEQ ID NO: 673 - protein, 306 aa, Chlamydia trachomatis
SGSDSESFVRPGHVFPLISQPGGVVQRPGHTEAAMDLMRLAGMQPCGIFAELVNPDHSMMRQQQVLAFAEQHDLTVITVDDLITYRYTYDSLVTKISSARLPTKYGDFSIYVYESIIDGTQHFALVKGDIHEQEAVPVRVHSECLTGDILGSCRCDCGAQLDMAMRYIAEEGLGVIVYLRGQEGRGIGFGHKIRAYALQDLGYDTVDANLQLGFPIDAREYGMAAQVLKDLQLTSVRLITHNPRKFFELQRLGIHVLDRIILPVSISTENEGYLRTKKERMGHWLDLPVLDDVEEEYETVERMSCR

SEQ ID NO: 674 - protein, 138 aa, Chlamydia trachomatis
LRMFTYEAGIASVQQAIKDVAEGKFVIVIDAASRENEGDLILAGEKVSTEKMSFLLSHTTGIVCASLSREQAKSLDLPAMVQDNQCAFKTAFTVSVASPASSGVTTGVSASDRTRTVQLLADPAATASPLFDQGMFSL

SEQ ID NO: 675 - protein, 261 aa, Chlamydia trachomatis
KRRTRLQAAGIPVYVGVGSQEAKTSLQPYLYQRERGLPWVVMKTAASLDGQTADRGGSSQWISGELARADVGKLRAESQAIIVGARTVCLDNPRLSARFPHGDLYERQPLRVVVDSRGTVPLESRVFDLSSGSTLFATTQQCPKEYIQKLKDLGVEVWESSSHQVDLKGLLRYLAERGCLQVLVEGGAQLHSAFWQQKLVNAGVIYWGPKFLGDQGQPMLRDLQLSLVTAEHVRITETSLVRDSVKTCFECLEQESVDKKG

SEQ ID NO: 676 - protein, 170 aa, Chlamydia trachomatis
  VARIANT (1)...(170): Xaa = Any Amino Acid
RNXXXLFFEDGFRTLLVPCVLIVYPTSLHLFRYLIFQVEYMEVLSEQQLFFMRKAVALGEKGRIFAPPNPWVGCVIVKNGCVIGEGWHQGIGSPHAEVCAVQDQKCSLEGAEVYVTLEPCCHFGRTPPCVDLLIKSKVAAVYVGLLDPDPRVCKKGVPVCKQQGFPFMLG

SEQ ID NO: 677 - protein, 422 aa, Chlamydia trachomatis
  VARIANT (1)...(422): Xaa = Any Amino Acid
YARNQKSAKAVFKKKXPXISLERLLDLDKTVRQLKADSEALLAKRKVLSGQIHKAKVANENADALIQEVNTIADQLVAFETTLQEQEALLEDLMARLPNYPDEDVPVSPDKTGNQMIKSHGEVPTFPFPPKHHMQLNEALQILDFKLPAKTTGSGWPAYCNEGVLLEWALLTYLLNKQQAHGFQLWLPPLLVKRDILFGSGQIPKFDGQYYRVEDGDRSLFLIPTAEVVLNGFHSQEILNEQDLPLCYAAFTPCFRREAGAGGAHERGLVRVHQFHKVEMFAFTTPEQEEVVYQKMLHVVEEILSELQLPYQLSLLSTGDMSFTAKKTIDAEVWLPGQKAFYEVSSISKCGDFQARRSETRYRDAQGKLHFVNTLNGSGLATPRLLVAILENYQQADGSVVIPSVLRPYMNNQEILLPKTVR

SEQ ID NO: 678 - protein, 180 aa, Chlamydia trachomatis
PLMEKSYSQLGSVGFFIPAVSEAQAAWAYIELTHRNMLQEKKEIETNPEQERIELAVLYANQGFQEPLISQMLDFVCSDSSLLLSTMLREELHIQLEDYPHPLKQGNVKALGGILGLLLFAPITLAVSYTIAAILASFMIGVLFAVKTRLIKNAITPAIVWGVGMFITAISLCCSLIRLF

SEQ ID NO: 679 - protein, 453 aa, Chlamydia trachomatis
PLLLFDPIILVHTLSRWPMSPQLFSSPFSRELLSDFFESGMAEENSPLLSQKNRRLSQNLTLKSAYISLALYLGSLLSHWIGYQALSSLLLILTFFLAGTPALIKSFEDILDRTVNIDILMTSAAFGSIFIGGALEGALLLVLFAISESLGAMVSGKAKSTLASLKHLAPTVAWVVQQDGSLQKVLVQNVKIGEIIRVKSGEVVPLDGKIIHGASSINLMHLTGEKIPKSCGIGDTIPAGAHNLEGSFDLQVLRIGAESTIAHIINLVVQAQSSKPKLQQRLDRYSSTYALTIFAISACIAIGGSLFTTLPFLGPDGAFYRALAFLIAASPCALIIAIPIAYLSAINACAKHGVLLKGGVVLDRLVSCNSVVMDKTGTLTTGDLTCSGCEDFGPESPLFYSCVLAMEQSSSHPIAQAIVNYLTEKQVRSLPATQCTTIPGEGVRENLTENKPL

SEQ ID NO: 680 - protein, 207 aa, Chlamydia trachomatis
TASRTPQQAQERGDTCSIACLGKRVSLFYFRDVPRHDAANIVSYLKKNGYPVCMLTGDHRISAENTARLLGIDEVFYDLTPDNKLSKIQELAKSRQIMMIGDGINDAPALAQATVGIAMGEAGSATAIEAADVVLLNQGLSSLPWLIDKAKKTRRIVSQNLALALAIILFISGPASMGVIPLWLAVILHEGGTVIVGLNALRLLKNT

SEQ ID NO: 681 - protein, 379 aa, Chlamydia trachomatis
MKKTKYLRQVNLWVFVVIILLMSISVIVISSQDPSSMLVHTSRGLFSAKSKKQLDHFALGWCAYFICLYVDYHQFKRWAWVLYSLILFSLIGLFFVPAVQNVHRWYRIPIINLSVQPSEYAKLAVVIMLSYILEMRKARISSKTTAFVACIIVGIPFLLILKEPDLGTALVLCPIALTIFYLGNIYPPLVKVCSVLVALGMFCSLLIFSGIIPHDKVKPYALKVLKEYQYERLSPSNHHQRASLISIGVGGLKGQGWKSGEFAGRGWLPYGYTDSVFPAIGEEFGLLGLLFVLWLFYNLVCFGCRTVAVAVDDFGRFLAGGVTVHLVMHVLINVSMMSGLLPITGVPLVLISYGGSSVISTMASLGILQSIYSRRFAKY

SEQ ID NO: 682 - protein, 184 aa, Chlamydia trachomatis
MKEIYYEIARTESTNTTAKEGLSLWDPYALTVITTREQTAGRGKFGRVWHSTDQDLLASFCFFLSVNNVDSALLFRIGTEAVMRLGESLGIQEAVMKWPNDVLVQGQKLSGVLCETIPVKTGTCVIIGIGVNGNVGADELLGINQPATSLQELIGRPVDMEEQLKRLTKEIKHLIQTLPLWGRE

SEQ ID NO: 683 - protein, 245 aa, Chlamydia trachomatis
MAKVRLNKFLASAGVASRRKCDEIIFAGSVTVASNGRVATGPFVTVDEEFDSVEVGGQRIGAEKKVYFMVHKPLGYLCSSERKFPGSKLVIDLLSHCPYRLFTVGRLDKETSGLILVTNDGEFANRVIHPSFGITKEYLLKVSRDVTARDLETLMAGTVIDGKVVRPVSVKKVRRGTIKIIVNEGKKHEIRLFAEAAGLQLLELKRIRIGSLVLGGLPYGKYRELTDSELDSCLSGKSVALVALA

SEQ ID NO: 684 - protein, 264 aa, Chlamydia trachomatis
MTLLILLRHGQSVWNQKNLFTGWVDIPLSQQGIQEAIAAGESIKHLPIDCIFTSTLVRSLMTALLAMTNHSSQKVPYIVHEERPDMSRIHSQKEMEQMIPLFQSSALNERMYGELQGKNKQEVAVQFGEEQVKLWRRSYRIAPPQGESLFDTGQRTLPYFQERIFPLLQQGKNIFISAHGNSLRSLIMDLEKLSEEQVLSLELPTGQPIVYEWTGQKFTKHAPSLGKQPTSHPSFRNGERGFSTLRRRIFVQRKYLHSDFTSRS

SEQ ID NO: 685 - protein, 387 aa, Chlamydia trachomatis
LYTNGRDKNSRNTLLLLVNNQQAIPPSEMVKEAFQRYADVFSYSANTSILTLQAEAEASARKLTGCQEKAFTFHFILHYPNVTAIIVAALLENQNAFQGRNHLLVPSCEQQFIINALCRRQNLGTTYDWVTSKNGRVKESDLAEALSPRTLLFSISAANGMTGFLEAIPELAALCKERGVIFHIDLSDILGRCALPAELYQADILTFSSQSLGGIGPSGAMFISPALTKYFSLWLPSNPQVPTCLSSLAAFSLACQERTTAFSSLVLSAISSRAALKQALSAIPQVEFLLEDSAPRLPNVAVFAIPGIPAESLGFFLSQKNIFVGLGYERFQPLSQILQSSGISPFLCHSALHVSFTERTPTTHFSALATALQEGISHLQPLVTQSL

SEQ ID NO: 686 - protein, 234 aa, Chlamydia trachomatis
TWRTLSHDQEDEEIQLVIGKQGHLLMGNTLLFYWLVDKTNGIIREAKFQYFGHPYLLVLAEATCSLVIGKTFAEAYKITINDLDQEVRGHANPSIFLEDLSPLYHLVIDALDIAIEQCVDIPVNDSPFPFKDALSQLSEGNPYSTEEWGALSHDEQLSALNTMMKEKIAPLVAVDSGDVRIVHFEGLTVTIAYSGNCSSCLSSVGSTLNSIGQLFRAHVYPLLEIKVDEQSLLF

SEQ ID NO: 687 - protein, 342 aa, Chlamydia trachomatis
ELTSWRMPVLPRFLKNKIASTKSLGYLLAAILIGFIMLYKPSSPQPTPTVASTEKKPSHWLKLSHLGNLQSIEIQAKKEQLEKDLTLFEPVLQATVALALSQEEDSLAEISVILSLPQASTLSPSLVHSITDYLTRSVPGLTKEHITLSDQHGNLYSPLFEQSNTLLTTSLERSLQTILPQTHFALNYIPVADEGHLQLLVDEDYLNTLPKGARVKLLSHMQEILSAFSEMHPSVDIVPFLKPVAHKTSRLSSIVLSITIVLLSLGILGFATFYLAFHTYDHVSQQKEKIQSINIPKLIEMMKRESPEKVALILSYLDSAKAEELLNKLPEEMKSAVLKLRT

SEQ ID NO: 688 - protein, 178 aa, Chlamydia trachomatis
EHKHLEDYVASPHLRSLACLDNSQLPIETPLFEQKALSHELLSLIQVFRKLSVHLLSEIEKLSQKLKPELLELAVLVCEKFLYRKLACTEELALLISAALQHHLATYAVSPIKIGLHPEDLSNLSKWLILHDVPLLKNIEFIADPLCKKASYKIELPSGILRQDIGEELSHLLSVLTP

SEQ ID NO: 689 - protein, 434 aa, Chlamydia trachomatis
MTHLQEETLLIHQWRPYRECGILSRISGSLLEAQGLSACLGELCQISLSRSDPILAEVIGIHNRTTLLLALTPIYYLAIGAEVVPLRRPASLPLSNHLLGRVLDGFGNPLDGGSQLPKTNLSPLFSSPSSPMSRTPIQEVFPTGIRAIDALLTIGEGQRVGIFSEPGGGKSSLLSTIAKGSQQTINVIALIGERGREVRDYVNQHKEGLAAQRTVIIASTAYETAASKVIAGRAAITIAEYFRDQGARVLFTMDSLSRWIESLQEVAIARGETLSTHHYAASVFHHVAEFLERAGNNDKGSITSFYAILHYANHPDIFTDYVKSLLDGHFFLSPQEKSFSSPPINVLTSLSRSSRQLALPHHYAAAQELLSLLKAYHEAIDIIQLGAYVSGQDAHLDRAIRLLPSVKQFLSQPYSHYSAIHETIEQLCQLLKHE

SEQ ID NO: 690 - protein, 119 aa, Chlamydia trachomatis
FFFGLVVFVCRHKHLSKTFSGPDAVYIEKFALFVNVLNVGHIHGYMTDIGIVCALLRKFSRCAPVFVVSRCSIVESAFFTVSNRVRFLKSSIVSSLDRSWSFLFMFQQLAQLFNSFMNS

SEQ ID NO: 691 - protein, 455 aa, Chlamydia trachomatis
MTDSSYVDLSFLLDQLLPIQQEHLLEYWPSLSPQQRLRLGTQIAQIDIPFFLRQQALLQNPQASHQEYTPLSPVHYAGDNPAYAQLGFQLLQRGKVGCVVLAGGQGSRLKFDGPKGLYPVSSVKKKPLYQLVAEKVAAASKWVGRPLPLAIMTSPLNHKQTLSYFATNDYFNLSPSQVDFFCQPLWPLLSLSGDLFLESEDRLSLGPTGNGCLSTLLQSSGIWDKWHQAGIEMVSVIPIDNPLALPFDRELVGFHAAEHNDVTIKTTLRQSAQEDVGVLIELAKQKIAVVEYSTLTTKERCAKTTEGDLTYKLANIGLYCLSMDFLAQTAYQPLPLYKANKHAKQLHPSTTEKNAWKFEEFIFDLFQYSEHSQAIVYPRHECFAPLKNYEGNHSPATVREAMRKREHALFTAVTERKLSPNTIFELEADFYYPSSHTSLEWETKIFFQETIIEAS

SEQ ID NO: 692 - protein, 336 aa, Chlamydia trachomatis
GLMKETIAYLGMGMWGFSLANLLANNGHRVVGWARNPALIEQLSVQRRHPAAPHISIPQNLSFTYHMEEALDGATMIVEGVTSAGMRPVLTQLKALTELRVPLVITSKGIEQNTGLLLSEIALEIFGRPAAQHLGYLSGPSIASEVLRGCPCSVVISAYNPDTLKQIHRAFLTPTFRVYPNSDLKGVALGGALKNVIAIACGISDGFRFGDNAKSGLVTRGLHEIRKFATIMGCRPDTLNGLAGLGDLCTTCFSAFSRNTLFGKLLAEGLTPEQAKTKIGMVVEGVYTALSAHQIATHHRIDMPITTSVYRVLYENLDIQEGIAQLLQRDTKEEYL

SEQ ID NO: 693 - protein, 340 aa, Chlamydia trachomatis
MSSKLVNYLRLTFLSFLGIASTSLDAMPAGNPAFPVIPGINIEQKNACSFDLCNSYDVLSALSGNLKLCFFGDYIFSEEAQVKDVPVVTSVTTAGIGPSPNITSTTKTRNFDLVNCNLNANCVAAAFSLPDRSLSAIPLFDVSFEVKVGGLKQYYRLPMNAYRDFTSEPLNSESEVTDGMIEVQSNYGFVWDVSLKKVIWKDGVSFVGVGADYRHASCPIDYIIANSQANPEVFIADSDGKLNFKEWSVCVGLTTYVNDYVLPYLAFSIGSVSRQAPDDSFKKLEDRFTNLKFKVRKITSSHRGNICIGATNYIADNFFYNVEGRWGSQRAVNVSGGFQF

SEQ ID NO: 694 - protein, 80 aa, Chlamydia trachomatis
LDMRGNLLLISLEGEVKRRGFGGLELESSGDVHSALASPSSFYVVEEVIGDIVCRSDADVSTMRAGNFTNFKFEVSEAIF

SEQ ID NO: 695 - protein, 395 aa, Chlamydia trachomatis
RAKTIMRNHPIPEGQKYFVPTIETAAPRERRVSPAEVAADYTQLHEAATYLQVFQDLLNDAHQLGLNKEFVESLRQDFLKTGSEMSLMQALWTEESQREARKRERKELQQQLESKVLGPQALTTAKELHPVDDSIVNKMPFQSAFAYILLDKYIPAQEEALYALARELNFSGYAQTLFSPVLELVKSFNNAPIVYNLGSYIGQTAGTANFKYGYQMVLDRYETETGQLRKDIKNAENAKQQLAQIIKNVEANNSLTTEHKTQLKDMANGYIQTLDVCISQMQELSTGLRGLSFIPGRDEYNPAYEIMGSSFSVVTLQNLEGKVVDGEINISSGETKGGLLNFFTYFLADVQNFGDLAQTNQLMLELQMRAMHQQWSLVTASLKLLHNVYRTLASS

SEQ ID NO: 696 - protein, 110 aa, Chlamydia trachomatis
GTDFWRNMPDEVDEAFTAKIGSKEFDTWIQQLTTFESAVIEGGRNGVMPGGEQQVLQSLESKQQDYTSFNQNQQLALQMESAAIQQEWTMVAAALALMNQIFAKLIRRFK

SEQ ID NO: 697 - protein, 214 aa, Chlamydia trachomatis
KSEVEPSSLNYFNAMVEAKKTFVETSPIQMVYSSLMLDKYLPNQQYILETLGSQMTFSNKAARYLNDIIAHAVSFQTANVYYSLGMYLRQMNQQEFPEVISRANDTVKKEIDRSRADLFHCKKAIEKIKELVTSINADTELTSSQRAELLETLASYAFEFENLYHNLSNVYVMVSKVQISGVTCLMKWMRLLLLRLDRRNSILGFSSLQHLKVL

SEQ ID NO: 698 - protein, 85 aa, Chlamydia trachomatis
AFGDYNGVYLFDNKGLATNLFNPTFFFDVVSLMTADPTKTMSRQDYNKVITASESSIQKINQAITAWELAIAECGTKKAKSNHPV

SEQ ID NO: 699 - protein, 400 aa, Chlamydia trachomatis
PESRSMLLQCICRSVFFFQQLDEKSKGLKRALGLLEEVDLEKFIPSLEKSPTPITTGTTSKISADGIEIVGELSSETILADPNKAAAQVFGEGLADSFDDWLRLSENGGIQDPTAIEEEIVTKYQTELNTLRNKLKQQSLTDDEYTKLYAIPQNFVKEIESLKNENNVRLIPKSKVTNFWQNIMLTYNSVTSLSEPVADAMNTTMTEYSLYIERATEAAKLIREITNTIKDIFNPVWDVREQTGIFRLKGAEYNALEGNMIQSLLSFAGLFRQLMSRTATVDEIGALYPKNDKNEDVIHTAIDDYVNSLADLKANEQVKLNGLLSLVYAYYASTLGFAKKDVFNNAQASFTDYTNFLNQEIQYWRPRETSSFNISNQALRTFKNKPSVIITAYIFLIIKD

SEQ ID NO: 700 - protein, 601 aa, Chlamydia trachomatis
  VARIANT (1)...(601): Xaa = Any Amino Acid
MTGDWISKITHSGLKSWIEEVIALVSPDDVRLCDGSEAEYQQLCQQMQDAGVMTPLNPELHPNCFLVRSSPSDVARAEQFTFICTKTQEEAGPTNNWRDPQEMRAELHALFRGCMRGRTLYIVPFCMGPLNSPFSLIGVEITDSPYVVCSMKIMTRMGASVLAMLGSNGTFYKCLHSVGKPLAPGEKDVAWPCDPEHMRIVHFQDDSSVMSFGSGYGGNALLGKKCXTLRLASYLGHQQGWLAEHMLIIGVTNPEGRKKYFAAAFPSACGKTNLAMLMPKLPGWKVECIGDDIAWIRPGNDGRLYAVNPEFGFFGVALGTSETTNPHALATCHADSLFTNVALTADGDVWWEGKTTTPPQGMIDWKGRAWVSGGEPAAHPNARFTAPLDHCPSLDPQWNNPQGVPLEAVIFGGRRTETIPLVYEALSWEHGVMMGAGMSSTTTAAIVGELGKLRHDPFAMLPFCGYNMAAYFEHWLSFATKGLQLPRIFGVNWFRKDEHGQFIWPGFSENLRVLEWIFRRTDGEDAIAHRTPVXYLPTAEGLNTSGLDLSEDALRALLTVASPAQGWKAEVSNIRKYCSIFGADMPQRILEELSRIESELK

SEQ ID NO: 701 - protein, 368 aa, Chlamydia trachomatis
MSPYRSLYKIKHLSNRLYNKALGRFDRVFNFFSGNVGIDLGTANTLVYVRGRGIVLSEPSVVAVASPAQTHAVLAVGHKAKAMLGKTPRKIVAVRPMKDGVIADFEIAEGMLKALIKRVTPARSMFRPKILIAVPSGITGVEKRAVEDSALHAGAQEVILIEEPMAAAIGVDLPVHEPAASMIIDIGGGTTEIAIISLGGIVESRSLRIAGDEFDECIINYMRRTYNLMIGPRTAEEIKITIGSAYPLGDQELEMEVRGRDQVAGLPITKRINSVEIRECLAEPIQQIIECVRLTLEKCPPELSADLVERGMVLAGGGALIKGLDKALSKNTGLSVITAPHPLLAVCLGTGKALEHLDQLKKRKESLV

SEQ ID NO: 702 - protein, 774 aa, Chlamydia trachomatis
YSYPGSSVWFLLRERFASIPKFIAELSNVEALNVFSTLPYTEELQGVCDISYLDGELEARLFFLYDGQKVPATSFSLQYQEVRTFVRPDGILARNLVEERKILEEVFSGFVYDERDGAFHVKSEKKIVEFMTETIPNNQHRITFNCPETLSDQFIYDETVFDLIFRAGEDINYYEAELKVHGLLKGISLDLLWDCVSAKKRFLELPKKGGQLKKARRGKASASKLPCILVLDLEKIAPVIQIFNEIGFQVLDDFVDQCPLWSLSGISPESFKDLPVNFSMTEDLAEIQKQIRGEVDFEFQEVPSQIQATLRGYQKEGVHWLERLRKMHLNGILADDMGLGKTLQTIIAVTQSRLEKGGGCSLIICPTSLVYNWKEEFRKFNPEFKTLVVDGIPSQRRKQLASLEEYDVAITSYNLLQKDIDIYKDFLFDYVVLDEAHHIKNRTTRNAKSVKMIRACHRLILTGTPIENSLEELWSLFDFLMPGLLSSYDRFVGKYIRIGNYMGNKADNVEALRRKVAPFILRRMKEDVLEDLPPVSEILYHCHLTESQRELYQSYAASARQELSRLVKQEGFERIHIHVLATLTRLKQICCHPAIFAKDTPEPGDSAKYDMLMDLLSSLVDSGHKTVVFSQYTKMLGIIRQDLEAKGIPFVYLDGSTKNRLEIVQQFNEDPGLLVFLVSLKAGGTGLNLVGADTVIHYDMWWNPAVENQATDRVHRIGQSRSVSSYKLVTLNTIEEKILSLQNRKKGLVKKVINSDDEVVSKLTWEEVLELLQI

SEQ ID NO: 703 - protein, 305 aa, Chlamydia trachomatis
GITRDFCRCSDSRGGTKRSGTPKRNLREYNHAANVLSENPFFLPLEYSEKDSAGLAVLFVPQKNEGEVFSPNQPIEFQLVLRLPGRSKPFYISNIKTFLEGVLYQEPIVFSGRRFFFTLQSFSASDRKLIDLLIRYARYATGSSEEKLLKSAFLTPASLGMILSKMFEHQMAESGGSQLGERECFQGIFCGNLEEPLLWSVSPAKMKFHLDYFDTPYKALLMKPLIVVDEEELQPEQAVLLESNYPGIIHKNVYHHFLPQIKRAHLRTFAGLRDIAIPEALFGSFCENALPVFRNLLRNCPMSRL

SEQ ID NO: 704 - protein, 140 aa, Chlamydia trachomatis
  VARIANT (1)...(140): Xaa = Any Amino Acid
HTXRLEKSYFAQGAVVSAKILSMNGETVCISAQIRGSYDNVYECEIEVASPRAESDTVDSNCDCSYNYDCQHVVALLFYLEQYFNEMVVTYSKEADLSSNEEVSKELQETFVVAAIREEERRDREHQKEIFGNTIMLLMF

SEQ ID NO: 705 - protein, 444 aa, Chlamydia trachomatis
VSSRDFSNDLFSINIEENAGCVVSAKVQANPLVTQKCHKEALKTVKKNVVLPGFRKGKAPDNIVESRYSTQVEQELRRLFLRASFEALSQMCDRKPLSPKAVRSSAIDTCNPVNGGSVSFLYEAFPVIPSLPWEQLSLPDPEPVKEISEEDLENGLKNVAYFFATKTPVTRPSQEGDFISLSLYVSKRGDENSTPVAIFENKYFKISEEDMTDSFKARFLNVSTGHRVEEEIGSEDIQSFLNGDLLTFTVNAVIEISSPEMDDEKARELQAESLEDLKKKLRIQLENQAKEAQHQKRFSDAEDALAQLIDFDLPESLLREREELLSREKLLNARLVKYCSDSELEEQKQALLEEAKADARKAVKLLFLTQKVFSEKGLSISREELQYMMDVCSRERFGGYPPKDISNEMIQELVLVALARDRLTYRKAIEAISSEKKDLEVVPS

SEQ ID NO: 706 - protein, 209 aa, Chlamydia trachomatis
LRGSTHMTLVPYVVEDTGRGERAMDIYSRLLKDRIVMIGQEITEPLANTVIAQLLFLMSEDPTKDIQIFINSPGGYITAGLAIYDTIRFLGCDVNTYCIGQAASMGALLLSAGTKGKRYALPHSRMMIHQPSGGIIGTSADIQLQAAEILTLKKHLSNILAECTGQSVEKIIEDSERDFFMGAEEAIAYGLIDKVISSAKETKDKSIAS

SEQ ID NO: 707 - protein, 418 aa, Chlamydia trachomatis
  VARIANT (1)...(418): Xaa = Any Amino Acid
QKKNLAVCSFCGRSEKDVEKLIAGPSVYICDYCIKLCSGILDKTPAPATQEIATSSTSSPTSLRVLTPKEIKRHIDSYVIGQERAKKTISVAVYNHYKRIRALMQDKQVSYGKSNVLLLGPTGXGKTLIAKTLAKILDVPFTIADATTLTEAGYVGEDVENIVLRLLQAADYDVARAERGIIYIDEIDKIGRTTANVSITRDVSGEGVQQALLKIIEGTVANIPPKGGRKHPNQEYIRVNTENILFIVGGAFVNLDKIIAKRLGRTTIGFSEETDLAVTNRDHLLAKVETEDLITFGMIPEFIGRFNCIVNCEELTLDELVEILTEPANAIXKQYRELFEEENVKLIFEKEALYAIAQKAKQAKTGARALGMILENLLRDLMFEIPSDPTVEAIRIEEDTITQNKPPVIIQKSPEAIA

SEQ ID NO: 708 - protein, 412 aa, Chlamydia trachomatis
  VARIANT (1)...(412): Xaa = Any Amino Acid
MTQSTLEVAKKIVRKLRNAGYQAYFVGGSVRDMLLGRPIEEVDIATNASPTIVTTIFPDTLSIGAAFGIIAVKENGQLFEVATFRSDEDYEDGRHPNRVVFASMKDDAIRRDFTINGMYYDPFLEKLFDLVEGRADLERXIIRAIGNPKQRFLEDKLRILRAIRFAATLGFALDPQTEQAIIKELPSLPNSVALAPERIWQELKKMLRTAPYESLQLLTKLKVLPILFPELKVSSSGFLRSAIAFAQKIHDSQIPEIALLLPLFREVDKEKALEAFSRLRVSNKELKLLEDWYAALPQFLSKQNDKFFWAHFFASETSSLLLSLFLSMQRSPDEQELFIARIHDLKTRLAAFIERIQSGAPLVSAQDLIAKGITPGRLLGELLREAEALSIEHECSDKEKILSLLKSKGFWK

SEQ ID NO: 709 - protein, 493 aa, Chlamydia trachomatis
SLFMRIAILGRPNVGKSSLFNRLCRRSLAIVNSQEGTTRDRLYGEIRAWDSIIHVIDTGGVDQESTDRFQKQIHQQALAAAEEASVLLLVVDIRCGITKQDEELAKRLLPLKKPLILVMNKADSQQDLQRIHEFYGLGISDMIATSASHDKHIDLLLERIRQIAQIPVPSVEEQDVVQEDELPSEEAAISLHAFADETLFENESLSQEEASFLEELVAQTATPAPVDRPLKVALIGHPNVGKSSIINALLKEERCITDNSPGTTRDNIDVAYTHNNKEYVFIDTAGLRKTKSIKNSVEWMSSSRTEKAISRTDICLLVIDATQQLSYQDKRILSMIARYKKPHVILVNKWDLMFGVRMEHYVQDLRKMDPYIGQAHILCISAKQRRNLLQIFSAIDDIYTIATTKLSTSLVNKVLASAMQRHHPQVINGKRLRIYYAIHKTTTPFTFLLFINSNSLLTKPYELYLKNTLKAAFNLYRVPFDLEYKAKPARKSN

SEQ ID NO: 710 - protein, 198 aa, Chlamydia trachomatis
KNKNLLLEIIKTKISYFLEILIPMHYEPYDEFEPDNELDHLICESDKTKPLDAYHDTGVYIEEDDRENGDLLIVLGKSILNGAIRQFYISDHNYAYTRGYYQGCWEGWFNIPPKKITTAEYDCDQLLQPDLLLTTNVEKLIHAPEDFPAQNANLDNIIICMTALNGEHRVQFLIGDNHRSFWIRHHDGESWSKWSTFI

SEQ ID NO: 711 - protein, 154 aa, Chlamydia trachomatis
CRCGTDYIGDLLIEAFDVKFSAMLAEFTEIIGSAANAQGICNDILRSVIISHIDEEWKVHLVDMDLLRSEVGLRSVGQKDPLIEFKNESFLLFEGLIRDIRIAIVKHLFALELSLTRSDRPDNAIPTVALATAFHNHDNFRPMELTIVGEEEES

SEQ ID NO: 712 - protein, 128 aa, Chlamydia trachomatis
FAISGPPEGEAMSDPMFDRLIETAQKRVEGRNYTIRKHTLEYDDVMNKQRQTIYAFRNDVLHAEDLFVVAKEQIEHVALALAFLILKDAHADHCSLPKIEEWLSYSFPVKLDDQEIRRLGDVDAVQTT

SEQ ID NO: 713 - protein, 536 aa, Chlamydia trachomatis
SAGSPPEKRKAIYQCDVVYGTASGFGFDYLRDNSIATRKEEQVGRGFYFAIIDEIDSVLIDEARTPLIISGPGEKHNPVYFELKDRVAELVYFQREMCNHIAIEARKVLDPFLGTDVLPKDKKVMEAISEACRALWLVSKGMPLNRVLRRVREHPDLRAMIDKWDVFYHAEQNKEECLEKLSSLYIVVDEHNNDFELTDKGMLQWIEKIGGAAEDFVMMDMGHEYALIEEDATLSPADKLNRKIAVSEKDTQRKARAHGLRQLLRAHLLMEKDIDYIVRDDQIVIIDEHTGRPQPGRRFSEGLHQAIEAKEHVTIRKESQTFATVTLQNFFRLYEKLAGMTGTAITESREFKEIYSLYVLQVPTFKPCLRIDHNDAFYMTEREKYQAIVAEIISAHRSGKPILIGTESVEVSEKLSRILRQNRINHTVLNAKNHAQEAEIIAGAGKVGAVTVATNMAGRGTDIKLDEEAVAAGGLYVIGTSRHQSRRIDRQLRGRCARLGDPGAAKFFLSFEDRLMRLFASPKLNTLIRHFRSSRR

SEQ ID NO: 714 - protein, 107 aa, Chlamydia trachomatis
  VARIANT (1)...(107): Xaa = Any Amino Acid
ERMPAFGRNSGGGIWVSSAVGYGSLRCADSGXIAMHKGFITEMQTGEGKTLTAVMPLYLNALSGKPVHLVTVNDYLAQRDCEWVGSVLRWLGLTTGVLVCREPTREA

SEQ ID NO: 715 - protein, 121 aa, Chlamydia trachomatis
  VARIANT (1)...(121): Xaa = Any Amino Acid
MMDFLKRFFGSSQERILKRFQKLVEEVNACDEKFSSLSDDELREKTPQLKQRYQDGESLDKLLPEAYGVVKNVCRRLAGTPVEVSGYHQQWDMVPYDVQILGXSLCIKALSPRCKPGKERH

SEQ ID NO: 716 - protein, 469 aa, Chlamydia trachomatis
ENVSLHKNKDLKRFFWYCKREKTQKLCIMWLIVAWTLLACLAMALVFKAYRHVISFRSYVNQVMRDVRLSVDLKEWAVAEMRLAPILKKRQYRRKYLFEYIRILRELERFEEAEKLLGEAKKLKLAGAHFFLEVAHKAFRHGAYKEAAHAFSLLSAELMGEREVARYTISLVYLGEVDAACRIIEPWIGPLAHQEVFISVGHIYFATKRYADAIDFYRRARSLGSCPIDVLYNLAHSLRICGQYVDAGMLFRELLGDPVYKDEAMFNIGLCEQKLGNSKKALLIYQNSELWVRGDALMMRYAALAAADQQDYQLAEHCWTLAFRCQSYADDWNCCVHYGLALCHLKKYAEAEKVYLRVIQKTPDCLVACKALAWLAGVGHATMISAREGIAYAKRALQIKRSPEVLELLSACEAREGNFDVAYDIQAILAERDTTAKERERRSQILKNLRQKLPIDQQHIVEVSLLLAA

SEQ ID NO: 717 - protein, 301 aa, Chlamydia trachomatis
MAAREMLYVNRETGKVEQERIICSSLVKFFIETRIGRALYSVLCKNSLFSRIVGWCQRLRVTRYFIKPFVTKYRICIEESASPLHDYASFNDFFVRKLKPDARPICQGEDICVTPADGAYLVFPSMADLSLFTIKNKPFSLESFLGDPQLAHQYAQGSMAIARLAPFDYHRFHFPIAGIAEAPRRINGHLFSIHPLMLKRNFEVFTENKREITIITSKEFGEVAYVEVGALNVGSIHQTFSPGSYVKKGAEKGFFAFGGSTVVLLFQPQRIIFDADLVGYSAQGLETRCRMGQSLGKRFSS

SEQ ID NO: 718 - protein, 446 aa, Chlamydia trachomatis
MLRNDTITAIATPPGEGSIAIVRVSGPDAISISDRIFSGNIAGYASHTAHLGTVSHNAVCIDQALVLVMRAPRSFTGEDIVEFQCHGGYFACSQIVASNALLAEGARAALPGEFSQRAFLNGKIDLIQAEAIQQLIAADNIDAFRIAQNQFQGHTSQAISSISSLIIEALAYIEVLADFPEEDIETEDSLPKHRIMEALSITDELLSSFDEGQRLAQGTSIVLAGLPNAGKSSILNALTQKNRAIVTDIPGTTRDILEENWVLQGKNLRLIDSAGLRETENLVEKEGIARAREAMSQAEGILWVVDASQPLPEFPTILYQKPTILLWNKCDIVSPPQIEVPFQQISVSAKTGEGLLELKQALQKWLNTTQLGKSSKIFLVSARHHSLLHSVYTCLTAALNGFTEHLPNECIALDLRQALHSIGNLSGSEVTENVLGEIFSKFCIGK

SEQ ID NO: 719 - protein, 226 aa, Chlamydia trachomatis
PLMKSLNVQAKRAFIISTLNRLFPNPAPSLTGWQTPFQLLIAILLSGNSTDKAVNSVTPSLFAKAPDAQSMSMLAPSEIYSLIAPCGLGERKAAYIHALSHILVDRYHQETPHTLPELTALPGVGRKTASVFLSIYYGENTFPVASPTHILRLAHRWQLSNETESFSCRKRFSTVIWTKALSEIAFTTHLLCKSVLSSAPPQHRCVSYLLFLTDRLTSFLTESSIS

SEQ ID NO: 720 - protein, 194 aa, Chlamydia trachomatis
KVSYFLNANGLLRRSNRLPILFYRDQKGNFSSWDDFTHDVQTQKSGRETDMPDSLRGRVEEDAASQMIVEVLLAFLDNQDMYLSVSFEILRNFLEEKVLSKRSLSPRSHEAIKKIKDLYLVSPEDFQTFIGGVITESLFQEEDQLVVGCMIFSQEGRELFDSWKGISQTYPHDMLYTQAFLAEVVLHVVNTTFI

SEQ ID NO: 721 - protein, 171 aa, Chlamydia trachomatis
NNTDYVKNRQKDLNPYMLLDSRFPTDYYLRILELVIRDASCKLVYNRRLHMLEAIPLDQKLSTDQEGESSILREVISELLAHSGESYAISAQLLAVIDIYLKQEQPSNSWFARIFRKRERARKRQTINKLLLLKSILFFERQRPVKKVESVADSILQRSKGKFFVLGRFYT

SEQ ID NO: 722 - protein, 255 aa, Chlamydia trachomatis
  VARIANT (1)...(255): Xaa = Any Amino Acid
ASIWKRRVARRNENYDVKKAEEQQGIVQYLQDSKMPALTRAYRHLRAFNSACLRTIREFFATIFRALRDAYYRHCTRSGINFCGADKDSLEVLVAVGLLLRMATLRSFEHVGGNYEDRLVNNDAPVTGAGRTLVYDAVDDIESILNTRTNWPQHVMIGFSRGLVQLCATPYNATSQECFKSIVRLEKEDPSSDYSQALLLAGIIDRLAEKAPMAAKYVLDALRVARGTSELIGELIILDLLPPVWKVGRGXYSLL

SEQ ID NO: 723 - protein, 99 aa, Chlamydia trachomatis
  VARIANT (1)...(99): Xaa = Any Amino Acid
ALYGGNSGPEGFSSASRGDEIDDVPDSEEGELEERVSDHAESIITESSETLFRTTSSSGVSEDLQQHVSLEESPRQRGFLGRIRDAVXFYLEASCCTKE

SEQ ID NO: 724 - protein, 339 aa, Chlamydia trachomatis
NLIKIVGIKSYCFGGGFMSIRPTNGSGNGYPSINPSNDNQDGLVQSTSGPNYGGHTVSSRGGFQGICVRIADLFRNCFSRNRGTTTPSRPVITQADIYHPTIFGQGAQPIVSTGDKKLDSAIIQADLRAQNKQTLATHIQSKLGSMEGQSPQDYKAGAYSALRLMLFTPGETTVSSERERQACVTGRDLWEQAAGDLATNGNTDGLMLMANLSVGGKHVPAGHLREYMNTVKGTFTDENEATDPTVDAILDLAAKIDATEFSSPGSGPVILNYIGNCGQVVLENEKMNQLVLEDQNGQDPQRVQDNSKELQKLLENARKTDPELYFQTLTVITSSVFLD

SEQ ID NO: 725 - protein, 403 aa, Chlamydia trachomatis
MDKLSIRDLSLEGKKVLVRVDFNVPIKDGKILDDVRIRSAMPTIHYLLKQDAAVILVSHLGLPKGGVFEEAYSLAPIVPVLEGYLGHHVPLSPDCIGEVARQAVAQLSPGRVLLLENVRFHKGEEHPDEDPSFAIELAAYADFYVNDAFGTSHRKHASVYRVPQLFPDRAAAGFLMEKELEFLGQHLLVEPKRPFTAILGGAKMSSKIGVIEALLSCVDHLVLAGGMGYTFLRAMNRQVGNSLVEESGIPLAKKVLEKAQALGVKIHLPVDAKVAKQCDSGEDWRELSIQEGIPEGLAGFDIGAQTIELFSKVIQESATIFWNGPVGVYEVPPFDQGSKAIAQCLASHSSAVTVVGGGDAAAVVALAGCTSQISHVSTGGGASLEFLEKGSLPGTEILSPAQS

SEQ ID NO: 726 - protein, 121 aa, Chlamydia trachomatis
QNSARSNKKNTIESAAPAGTVINHESTISLMIRKLMARKPLANPIPNTDPTTTCVVDIGNPKEEAAAIVIAELIPTEKPRDGVNSVIFFPIVSITRQPHVANPQTKPSPPKDINTKRTFEE

SEQ ID NO: 727 - protein, 433 aa, Chlamydia trachomatis
DARREIGMWLLLVCVVVGGFYTAWNIGANDVANAVGPSVGAGALTLKQAVLIAAVFEFLGAVLLGDRVIGTIESGLVAPSGHVLSSQDYVFGMAAALLATGVWLQIASFCGWPVSTTHAIVGAVLGFGIILKEDAVIYWNSCGRVFVSWLASPIIGGYFAFLIFSFIRKAILYKKDPVSAMVRIAPFLSAIIIFALGLVLILSGAVAPVISFSPALRIVCGLSLFAFFFTIWGIRFFKLAILPQEVLPGTLLDRLLSKSTDYGRKYLIVERIFAYLQMIIACFMSFAHGSNDVANAIAPVAGIYRTLYPQSYSSKVLLVFMSLGGLGLVCGLATWGWRVIDTIGKKITELTPSRGFSVGMSSAITIAAASSLGFPISTTHVVVGSVLGIGFARGLRAINLRIIKDIVLSWFITVPAGAALSIVFFLLLRALFC

SEQ ID NO: 728 - protein, 164 aa, Chlamydia trachomatis
  VARIANT (1)...(164): Xaa = Any Amino Acid
WYEKRCKKTLGFGSISSCIPRSAVGDHFDTRFLSRXAEDIAILLTVKELQFYPEFEELFFEFLQKTVQSFEAVAKTIREMDRLLESSFGGNRADKTRVLVSEVSNLEHECDLLQRELMKVFFSDDFAIGTKGFVLWMQIIKGISGISNNSEKLAYRVSMTLEEK

SEQ ID NO: 729 - protein, 103 aa, Chlamydia trachomatis
  VARIANT (1)...(103): Xaa = Any Amino Acid
MQVLASLFGQSPFAPLQAHLELVSSTINVLFPLFSALKEGDYERVGVLAQLVSSKERQADGMKNDVRRHLASGVFLPVFRAALLEIISIQDSLADXLRISQFC

SEQ ID NO: 730 - protein, 321 aa, Chlamydia trachomatis
MCAQPLLQVKNLSVSLNRNRVSFLAVDSLSFDVFPGQTLAIIGESGSGKSITAQSLMQLLPEESFSLSGEALFNKENLLDRKNTNAKVLFGSKISMIFQNPLASFDPVFTIEQQFHEVIRTHLGISNKMAHEQMLAVLRETGFQDPERCIKLYPHELSGGMLQRMAIAMTLLTSPDLLIADEPTTALDVSVQYQILQLLKTLQKKTGMSLLIITHDMGVVAEMADDVFVLYAGRMEEYSSVQEIFHSPAHPYTEDLLASRPSQYRQQTFVPIAGQPPHYTRLPKGCCYSPRCRKAQPICFEKSPDSLSLNDHHRVRCWLHE

SEQ ID NO: 731 - protein, 270 aa, Chlamydia trachomatis
GAGYMNNPLLLQASRLTKHYYKRSFWFQKKKVALATTPLNQVSFSLPRHKIIGLIGESGSGKTTLALGLAGLIPLTSGHLILNDKAIPLHNKKGRQYLSSQVRMVFQNPRSSLNPRKTIFDTLSHSLLYHRLVSKEELGATVEKALSLVGLSTDYLYSYPHQLSGGQLQRISIARALLGAPQLIICDEIVSALDLSMQAQILNMLTSLQQQARLTYLFISHDLAVVARGSFCSELIIMYKGQIVETGATEEIFCNPQHSYTRMLLHSQLP

SEQ ID NO: 732 - protein, 288 aa, Chlamydia trachomatis
ENIVSRLPSEDTLLEVASNIEDIRVSPFQPRRTFLEEDLKELVLSIKTVGLIHPPVVREIRNGDKVLYYELIAGERRWRALQLAGYKTVPVVLKQVLADDMAAEATLIENIQRVASNLNPLEMAEAFRRLIVVFGLTQDKVAKKVGKKRSTVANYLRLFSLPQEVQEKMNSGEISLGHAKVILSLEDENLRQILSQKIISCKLAVREAEMEAKRLVKGKGASLKEDSSSQPSSRLGFCQERLATTFGYPVTVKPQGRRICVSFFVEGEEALEALEKALTTSSSEAILT

SEQ ID NO: 733 - protein, 407 aa, Chlamydia trachomatis
RNRIFTMYNVKKDFPIFKNQGDPYVYLDSAATTHKPQCVIDSIVDYYSSSYATVNRALYTASHDITFAHWQVRSKVGSWIGAQYDQEIIFTRGTTSSLNLLAIAANDSWLAGGTVVISEAEHHANLVSWELACQRSGATIKKVRVDDEGMVDCNHLEQLLKQGVQLVSLAHVSNVSGAVLPLPEIAHLVHRYEALFAVDGAQGVGKGPLNLSEWGVDFYAFSGHKLYAPTGIGVLYGKKELLESLPPVEGGGDMVIVYDFEELSYQEPPLRFEAGTPHIAGVLGLGAAIDYLQALPFSITDRLTELTHFLYEQLLTVPGIQIIGPKQGAARGSLCSISIPGVQASDLGFLLDGRGISVRSGHQCSQPAMVRWDLGHVLRASLGIYNDQQDILLFVEALKDILRAYRS

SEQ ID NO: 734 - protein, 396 aa, Chlamydia trachomatis
TMWGTHQQRQIHPDARLADVTRSVWRQYQRDHVFREACSWLKEMTQEDSWIYCVGGCEIGAISPEERSATCVFVNGCFAPSLSVLPAEIIVAPLREARAFFQKHDEEDVVEELHSLLRGEEGTVIYIPEGRELQTPLFVQHHYVCSEEENKKTVSVPYIVFVLGKGAAISIEMGMSALPDNVYLFGKTLCFLGEEAELVLTMKPLPKGTERIIWAHHVEVERRGACALIQDMRSMGKGWFRNSFFLKGEAAHGESLVKVLGGDFLGVHNTMHHDDRETTSRQNIRSILEEGSFSFEGGIYISPRGTLSNAYQKHDTLLLSNRASASTFPRLEILTDDVKASHGATVGSLNAHLLTYLRSRGFSLIEAKQALQKSFLTLDIEKPYFPKLQKQDLYHV

SEQ ID NO: 735 - protein, 253 aa, Chlamydia trachomatis
VMYMYVVKKKRSLEGLSLSIHPGELHIIMGPNGAGKSTLAKVLSGDESVEVSSGTMTLAGQDLLELSPEERAHAGMFISFQHPPEIPGVNNRIFLKEACNACRKARNQVVLDDAAFEELLTHLEEVYGFPGFHFFSNRNVNEGFSGGEKKKNELWQMLALEPKMVVLDEPDSGLDVASPALKGICSVLQRYRQQHPETAFCIVTHNPRLGDLLQPDHVHILLNGRVVFSGDMHLMEELERKSYQELLDVVTQE

SEQ ID NO: 736 - protein, 94 aa, Chlamydia trachomatis
LHAGDSMLVGERCGAYTDPQIVVNNGESCVEHEAATSKLREDQLFYLRSRGFNTEEAVSLVVHGFCREVIELLPLEFAREATKLLMIKLENSVG

SEQ ID NO: 737 - protein, 247 aa, Chlamydia trachomatis
FSEALFRIVVPARDNFFAALNSAVFSDGSFVYIPKGVCCPMEISTYFRINDKESGQFERTLIIAEDDSYVSYLEGCTAPSFSSHQLHAAVVELVAHNRSVIRYSTVQNWYPGDRKTGKGGIYNFVTKRGLCAGEHSKISWSQVEVGAAITWKYPSCILKGENSVGEFYSIALTNGKMQADTGTKMLHIGKGSSSTIVSKGISAEESHNTFRSLVSISSQAVGSCNYTQATLCLLESAAGLIRIHKLL

SEQ ID NO: 738 - protein, 172 aa, Chlamydia trachomatis
MDAPVDKFLQQQEYPYGFVTPIQSEGLAPGISEEHIEQLVHLRGEPKFLLDFRLKAFRLWQKMEEPTWARLRYPPIAYDDIVYFSAPKTKKPLGKLEDADPEILETFKKLGIPIDEQKRLLNVQDVAMDLVFDSVSIGTTFKKTLEDAGVIFCSFREAIHNYPDLVKRYLGS

SEQ ID NO: 739 - protein, 150 aa, Chlamydia trachomatis
VIYFLEIRFWVVAREGFGVFLRLVLVFWVGHYNLGLCYLTLDKTRLALKAFQESLLLNAEDADAHFYIGLAHMDLKQNEQAYDAFYRALGINLDHERSHYLLGYLHHMQGESEKAETELSFLVAKESVFAPLLQKTVSSSVFLSKKETLF

SEQ ID NO: 740 - protein, 196 aa, Chlamydia trachomatis
QGTTMEEAEKHLAKEFLCSGINLFLSGEYEQAEERLKESLELDSEAGLAYCYLGIIALETGRTAEALVWCKQGLEAEPGDSYLRYCYGVALDKADRLEEAIGHYQVYAELHPEDIECLFSLGSAYHRLLRYEEAIACFDRIAQLDPWNPQGLYNKAVILSDMEDEEGAIDLLESTVKRNPLYWKAWVKLGYLLSRN

SEQ ID NO: 741 - protein, 1066 aa, Chlamydia trachomatis
MKRKRRTPLSVPEKANRLLVGFIIALSIITLRIWHVAVVQHEKKKEEAYRPQRRSVPEHCDRAGVCDRFGKTLAENVLQYNVGISYRAIRDIPTRVWHTDEQGNKRLVPVRKDYIKKFADFLAQELHMDRDFVEDTIHAKASVLGSVPYILQTNVSERTFLRLKMLEKDWPGLHVESSVRRHYPEGRTVADLLGYVGPISAEEHRKITRELGNLRECIRAYEEGEDPKFPAGISSVDQVRKLLHELEMHAYGLNSLIGKLVVEAFCDRKLRGLIGKRSMLVDRRGNFIQEMEGSSVGSPGRTIQLTISTELQAFAHELLAEHERGECFTIIDSGVSNNILPPFFPWIKGGAIVAMDPKNGQILAMASSPRYDNNDFINMKDSPNQEECRSSVLRWLENLEYIGEVFDRRVPLRRERLDPLSGKYFDEELSFSYRAFLDFILPDTSKVKQMLCEKGSIGLSIYLQGTIEQLLEMFECEEKECGLVFDVLFPKEDGHEIIGEVTSLKRQKQFKAILAEREEEVQAFRERLGSIFADLSANYDKILFLDLLRTAVDPEKVSISLLAEIGHMSVLDFVDYQGHFIALRKSFAKLMENAFIDHDFTAWREEHFTQFIKQKRDEELERKQRYPTPYVDYLVEERSRQYALFCREHMDSFITFLLSEIEPPLGNPYYQEIACWRQELRSGAYPALEWREHYDFLHKHLSQTSYDLCELFAAFREFSELKRPLYGQYPLTLTRNIEQIEQDLIASFYPLYGYGHLSAHAFGQAATLGSIFKLVSAYSVLVQHLSDQEDLSKLLVIVDKQSLGLRSGKPHVGFFKDGSPIASFFKGGILPGNDYSGRGYIDLIAALEMSSNPYFSLLVSEYLSDPEDLCEAAKLFGFGEKTGIGLPGEYAGRVPIDVAYNRSGLYATAIGQHTLVVTPLQTAVMMATLVNGGIVYQPSLIQGEWYQGSFSPEQAKKKREIFLPDSIVDLFKRGMHNVIWGQYGTTRFMRQRFAPERLARIIGKTSTAEVIARVGLDRERGRMKLKDVWFAAVGYEDEALSHPDIVVVVYLRLGEFGRDLRLWQCV

SEQ ID NO: 742 - protein, 394 aa, Chlamydia trachomatis
MKKLLKSVLVFAALSSASSLQALPVGNPAEPSLMIDGILWEGFGGDPCDPCTTWCDAISMRMGYYGDFVFDRVLQTDVNKEFQMGAKPTTATGNAAAPSTCTARENPAYGRHMQDAEMFTNAAYMALNIWDRFDVFCTLGATSGYLKGNSASFNLVGLFGDNENHATVSDSKLVPNMSLDQSVVELYTDTTFAWSAGARAALWEYGCATLGASFQYAQSKPKVEELNVLCNAAEFTINKPKGYVGQEFPLDLKAGTDGVTGTKDASIDYHEWQASLALSYRLNMFTPYIGVKWSRASFDADTIRIAQPKSATTVFDVTTLNPTIAGAGDVKASAEGQLGDTMQIVSLQLNKMKSRKSCGIAVGTTIVDADKYAVTVETRLIDERAAHVNAQFRF

SEQ ID NO: 743 - protein, 282 aa, Chlamydia trachomatis
LELPCKLTLKELLESGAHFGHQTSRWNPKMKPFIFEEKNGLYIIDLAKTLGQLKKAVSCIQKTIDQERSILFVGTKKQAKQIIREAAIECGEFFASERWLGGMLTNMATIRNSVKTLNRIELDLEASNSGLTKKELALLAKRHRKLLNNLEGVRHMNSLPGLLIVIDPGYERIAVAEAGKLGIPVMALVDTNCDPTPINHVIPCNDDSIKSIRLIVNTLKDAVIDAKKRLGVEILSPVRPAERPAEEAVEELPLPTGEAQDEASSKEGVLLWADIDNCEALK

SEQ ID NO: 744 - protein, 287 aa, Chlamydia trachomatis
LRGIEMSDFSMETLKNLRQQTGVGLTKCKEALEHAKGNLEDAVVYLRKLGLASAGKKEHRETKEGVIAARVDERGAALVEVNVETDFVANNSVFRAFVTSLLSDLLDHKLSDVEALARVMSSQEPSLSVEELKAVTMQTVGENIRISRAFYTPVNSGQSVGIYSHGNGKAVAIVFLSGSENQEALAKDIAMHIVASQPQFLSKESVPQEILEREREVFSSQVAGKPQEVVEKITQGKFKAFFQEACLLEQAFIKDPEVTIQGLIDRAAKASGEPLRVEHFVFWKMGA

SEQ ID NO: 745 - protein, 245 aa, Chlamydia trachomatis
MMKKRVKRVLFKISGEALSDGDSSNKISEKRLSRLIAELKVVRNADVEVAVVIGGGNILRGLSQSQSLQINRVSADQMGMLATLINGMALADALKTEDVPNLLTSTLSCPQLAELYNPQKASDALSQGKVVICTMGAGAPYLTTDTGAALRACELKVDVLLKATMHVDGVYDQDPRECADAVRYDHISYRDFLSQGLGAIDPAAISLCMEAGIPIKMFSFARHSLEEAVFNTVGTVISSAEGGQL

SEQ ID NO: 746 - protein, 178 aa, Chlamydia trachomatis
  VARIANT (1)...(178): Xaa = Any Amino Acid
MTLASAEKEMAGVLTFFQKETRGFRTGKAHPALVETVTVEVYGTTMRLSDIASISVSDMRQLLISPYDAGTVSAISKGILAANLNLQPIVEGATVRINVPAYGRIPTRSNKQLKRKSEEAKVAIRNIRRTFNDRLXKDDNLTEDAVKSLEKKIQELTDKFCKQIEELAKQKEAELATV

SEQ ID NO: 747 - protein, 246 aa, Chlamydia trachomatis
QGFESPWGHYKKKCGSLAQRLEHLTFNERVEGSNPSRPISFSKRSSLLIKKISFLCFFLLLLKVPRCICTAFDMDHTEESPALCYNCQQPATICFTEISENITSRCYVCNSCPYPSRYYDRETILASPTHEALILECGNCKTKWCIRDTDELLLGCHLCYRTFKSLILSRLLRYQAISSYTSEKANNFHIGRGLGNSEQPIINPAMRLIALHEALQETLRREDYEQAAEIRDQINQLKNQNTTDAP

SEQ ID NO: 748 - protein, 301 aa, Chlamydia trachomatis
  VARIANT (1)...(301): Xaa = Any Amino Acid
PNSFRLSKVRKFFVLPLKDLPIWQRECLLEHYLFPYHLGSCLEGEALIVNQAGTLLAGINLRDHVVIHGVDFVWQPEVLLQKLIDLDIRLQQSLSFAFSSDFGFLTADPLRCGTALIARAFVHVPALKYGDALSELLVPYQREFASSSLLPLSQESLGDILCLSNICSLGLSEEQILSSLRLVVSKILSAEKEARNQLVKENXTEXKNRILRSVGMLTHSCCLDLQEALDATSWIQLGMSMQWIEDSENHPLWNPLFWDLRRGHLALYNQDTANRSIEKEVIAQIRAKATKPQAERLIIRI

SEQ ID NO: 749 - protein, 666 aa, Chlamydia trachomatis
RVRILKKSDNTVNFEDISILELLQFVSKISGTNFVFDSNDLQFNVTIVSHDPTSVDDLATILLQVLKMHDLKVVEQGNNVLIYRNPKLSKLSTVVTDGSAKDTCEAVVVTRVFRLYSVSPSAAVGIIQPLLSHDAIISASESTRHIIVSDIAGNIEKVRELLQALDSPGTAIDMSEYDVQFANPAALVSYCQDVLGAMAEEEAFQIFIQPGTNKIFVISSPRLTAKTIQLLESLDIPEMAHTLDDVTSPAAALGSSGAANPKSLRFFMYKLKYQNGAAIAQAIQDIGYNLYVTTAMDEDFINTLNSIQWLPVNNSIVVIGNQANVDKVVSLLNGLDLPPKQVYIEVLILETSLEKSWDFGVQWAALGDEQGKVAYASGLLSNTGLTDPLRNQSLPVALNPGNISLPTPGQLAGISDMMYGSSAFGLGIIGNVLSHNGKSYLTLGGLLSALDQDGDTTVVLNPRIMAQDTQQASFFVGQTIPFQTTSTVIQETGSVTQNIEYEDIGVNLVVTSTIAPNNVVTLQIEQTISELHSAQGVLTPVTDKTFAATRLQVPDGCFLVMSGHIRDKLTKIVSGVPLLSSLPLIKGLFSRSIDQRQKRNIMIFIKPKVISSFEEGTALSNTEGYRYNWESERGSLEVAPRHAPECQHIPKVQAESNFKMLEIEAE

SEQ ID NO: 750 - protein, 277 aa, Chlamydia trachomatis
QKSLSLNTYQLKKSPVASNIVTSNIGSKILRIIQNNKKLGLLSALVVLDAALLSVNSRSGEGLIGQSASLPNYHEAEQQIAACPKNIAKNLAKKSSPGAKPTVGAPSPARPVSVKAAPAKPQAPVAQTRHFKKSHQIFSPNFTQSSQQVNKLEERRRPLESRYLQGAAKQAAAAKEKKALEQEVSKQEEEASKLWEEKQSYARRAVNAINFSVRKQIEEQQKTISNPGNDQTLPGKKDPHTSGEPVIQTVQDCSQDQEAREKSSRAIKQTFSDVSGS

SEQ ID NO: 751 - protein, 185 aa, Chlamydia trachomatis
YAYIWKRSRILVLYAPGNCSFALSMMKQFLNQREEKAKDIQTVIKSMDTLCKTMHIPICKEGISCCCFIFFLEELMCFSCGKTDFSLKKQTGGVQRFQAESQGIGEETPLEIHEQSFLWEPGDELIVHTPKARDLVYLYCPSFLKLQDRGQIDIFCETDNLQKGIRQKYDRSLYPSTLISLKRVR

SEQ ID NO: 752 - protein, 331 aa, Chlamydia trachomatis
VFMLRSGVSFSSSKTNYLLTRELSRKVGLTVYQGVDEHSSRPVVIKTLVSPGIHDRRFLRAFEEEARIMQLVTHPAFVRLEDRGECEQGRYLVSEYILGSSLRDSILSSQISLDKAISIVLQVAQVITTLHRHGVLHLDIKPENIVLSQSGEIKLIDYGLSAWQFNHWGSPAYMSPEQSRQEPPSPASDVYSLALLAYELIMGQLALGKVYVSLLPSKISKILIQALQPSPAARFSSMQEFAEALQDYLLHDVHEDYRKKDHVVAQIEQWHNQRAWLSPEKLSAPEEICVHIYSQKEPCYLHNIYYDMLTSGNVAEFWFSTLQETVVLRLA

SEQ ID NO: 753 - protein, 95 aa, Chlamydia trachomatis
LKLQDCKRCNQKRRLKNLVKEVRQLPLPSATKIVAEVARYSLSVGEFLKLGPGSVLQFDGVHPTLGVDIILNGAQVGRGNIIALQDVLGIRVLEV

SEQ ID NO: 754 - protein, 125 aa, Chlamydia trachomatis
NYSAEPCRFLEEKDQAFDMQKVDLQTPITLAVEVGFCQISEEDWHQVVPGSFILLDACLYDPDTGDAGAFLSIQRTRFFGGRFLDKQSGSFKITGLQEMQPEEAPEEPSEGGPATPFAFGNKNRC

SEQ ID NO: 755 - protein, 200 aa, Chlamydia trachomatis
GIPMAVAAEPSSNWLKARDELLSSLQEQKEGMFSFPVFPKQECEQKLKDKFHMEEVELSFESRGLLSVAAAVQEYGERILLQPFLANPFESGEFYIVSSEEDLQALIGTIFNDSSLASYFYEKDRLLGFHYYFVAEICKLLQESPWIPSMSVKVTGDVAFSARALEGEYHVIQVSCCLDGSCIRFSILVPETTAQSLVDS

SEQ ID NO: 756 - protein, 284 aa, Chlamydia trachomatis
FMELNKTSESLFSAKIDHNHPRTEAHEPRDQREVRVFSLEGRSSTRQEKADRMPGRTSSRQESSKSSEEGAVHESTAGVSSKEEEESKGDGFFTGGNPTSGMALVETPMAVVSEAMMETSTMTVSQVDLQWVEQLVTSTVESLLVADIDGKQLVEIVLDNSNTVPAAFCGANLTLVQTGEEISVSFSNFVDQAQLTEATQLVQQNPKQLVSLVESLKARQLNLTELVVGNVAVSLPMIEKIETPLHMIAATIRHHDQEGDQEGEGRQDQHQGQHQEKKVEEAHI

SEQ ID NO: 757 - protein, 119 aa, Chlamydia trachomatis
  VARIANT (1)...(119): Xaa = Any Amino Acid
ESLYAENSPLREQLDDGTTSDAILKMKAYIKVVAIQLSEEEEKVNKQKENVLAAXKELERAEVELTKRRKEEEKTRLHKEEWMKEALKEEARQEEKEQDEMGQLLHQLLKQKQRESGEN

SEQ ID NO: 758 - protein, 442 aa, Chlamydia trachomatis
  VARIANT (1)...(442): Xaa = Any Amino Acid
MEEITTEFNTLMTELPDVQLTAVVGRIIEVVGMLIKAVVPDVRVGEVCLVKRHGMEPLVTEVVGFTQNFVFLSPLGELTGVSPSSEVMATGLPLHIRAGEGLLGRVLNGLGNPIDTETKGPLENVDAIYPIFKAPPDPLHRAKLRTILSTGVRCIDGMLTVAKGQRIGIXAGAGVGKSSLLGMIARNAEEADINVIALIGERGREVREFIENDLGEEGMKRSIIVVSTSDQSSQLRLNAAYVGTAIAEYFRDQGKTVVLMMDSVTRFARALREVGLAAGEPPARAGYTPSVFSTLPKLLERAGASDKGTITAFYTVLVAGDDMNEPVADEVKSILDGHIVLSNALAQAYHYPAIDVLASISRLLTAIVPEEQRRIIGRAREVLAKYKANEMLIRIGEYRRGSDREVDFAIDHIDKLNRFLKQDIHEKTNYEEAAQQLRAIFR

SEQ ID NO: 759 - protein, 231 aa, Chlamydia trachomatis
IRERVGYSMIDPLKLFPNFDGDKESAAVNKPSASPMPSELSKNVASFSLGGGGAALDSTVSTEKLSLMAMMQDKNSQLIDPELEEALNSEELQEQIHLLKSRLWDAQTQMQMQDPDKLASEHVDALGVIVDLINGDFQAIAEHTQQTVKQGNGDEEKSVTRKIVDWVSSGEEILNRALLYFSDRNGERETLADFLKVQYAVQRATQRAELFASILGATVSSVKTIMTTQLG

SEQ ID NO: 760 - protein, 154 aa, Chlamydia trachomatis
NKRWVMADLDVFKEDFALLFEAGMVAIKQGDEASAKALFQALQVLDPEHTAHELGSGLLHLHKMELTKAEVLFRAIVEKDPENWSAKAFLSLTLMMIVLQQGSSFEVRRSSLERCLQLADQVLESCEVESTRALAKSVLDWHDGLVAKSGGPLN

SEQ ID NO: 761 - protein, 90 aa, Chlamydia trachomatis
TVKERVSMASGSCSAFNFNQMLDGVCKYVQGVQQYLTELETSTQGTVDLGTMFNLQFRMQILSQYMESVSNILTAVNTEMITMARAVKGS

SEQ ID NO: 762 - protein, 103 aa, Chlamydia trachomatis
NIKLSTINRQFEVYLILPGRNKSMFNMENSAAKGEKAARQLFDLEQDMHDVAKAHEVNANVQSKVQTLTSSLREGAFKESFEKQQTLLAGICSSSKGARTYQP

SEQ ID NO: 763 - protein, 769 aa, Chlamydia trachomatis
  VARIANT (1)...(769): Xaa = Any Amino Acid
MLPRPVSVDGTVITAPVLLKDGVSFVMGSCQVSFFKGEEVEGDIELSFQTEGGNEGEPAAQGSSSVSSEGPKKETGNPSLPSETKVSGEVSSSAIAKEQELAVFFLASVEKEPGTPKEVSEPKVSSQEGQTPSVTGEKKDLELPLASQEQPKQTTPSGSGEPTQSQNASMEENRTSPDQNQQPQLSSASESGSQSPENQEQQPSQTPPPSPETPEPSGEPNSATEENSPSPMEKASVTEEGSSGTSEEEKEGEEDTAESAANEELKAEASQEEEKKEEDKXEVLAPFNVQDLFRFDQGIFPAEIEDLAQKQVAVDLTQPSRFLLKVLAGANIGAEFHLDSGKTYIVGSDPQVALADIVLSDMSISRQHAKIIIGNDNSVLIEDLGSKNGVIVEGRKIEHQSTLSANQVVALGTTLFLLVDYTAPSDTVMATISSEDYGLFGRPQSPEEIAARAAEEEEEKRKRATLPTGAFILTLFIGGLALLFGIGTTSLFHTKEVVSIDQIDLIHDIEHVIQQFPTVRFTFNKNNGQLFLIGHVRNSIDKSELLYKVDALSFVKSVDDNVIDDEAVWQEMNILLSKNPEFKGISMQSPEPGIFVISGYLKTEEQAACLADYLNLHFNYLSLLDNKVIIESQVMKALAGHLVQSGFANVHVSFTNGEAVLTGYINNKDADKFRTVVQELQDIAGIRAVKNFVVLLXAEEGVIDLNMRYPGRYRVTGFSKCGDISINVVVNGRILTRGDILDGMTVTSIQPHCIFLEREGLKYKIEYNK

SEQ ID NO: 764 - protein, 137 aa, Chlamydia trachomatis
  VARIANT (1)...(137): Xaa = Any Amino Acid
AREHMLEKLIKNFVAYMGVASELEFDADGSYVLPISSLVRMRVRQNADEEIIISAFLGEIPAFMDIEKAYARMMEGNLFGQETGGAALGLDSDGHAVLVRRVPGEVSQEDFASFIGGVLNYAEAWLEDLGLSKTEQX

SEQ ID NO: 765 - protein, 348 aa, Chlamydia trachomatis
MMRGSLRSKEETVMVREGEERIGNRVLLGVIGVSYRETTLQQREQVLHILQQAQGSFRPEVFQEERDYVLLATCHRVELYSVAPAELFDSLAQEIKLLGVSPYFYRNQDCFAHLFCVAGGLDSLVLGETEIQGQVKRAYLQAAREQKLSFALHFLFQKALKEGKVFRAKGGAPYAAITIPILVDQELRRRQIDKKASLLFIGYSEINRSVAYHLRRQGFSCITFCSRQQLPTLSMRQVVREELCFQDPYRVVFLGSLELQYALPHSLWESIWDIPDRIVFDFAVPRALPSHTVFPHRYMDMDQISDWLREHRKEVNSAHLDSLREVAYRYWNSLNQRLERHDCVGANA

SEQ ID NO: 766 - protein, 607 aa, Chlamydia trachomatis
MRKKTAYSESSIISLASLDHIRLRAGMYIGRLGDGSQAEDGIYTLFKEVVDNAIDEFVMGYGHTIHITGDAHELSIRDEGRGIPLGKVIDCVSKINTGAKYTQDVFHFSVGLNGVGLKAVNALSQHFSVRSVRNKKFLKASFSKGILLHTEQGATQDPDGTEVVFSPDHELFENFSFQVEFLKKKIRQYTYLHPGLTIIYNGERIVSTRGLLDLFEEEVQTPLLYSPITFQYSDLAFLFSHTETSSEQYFSFVNGQETTDGGTHLVAFKEGIVKGVNEFFGKNFSSQDIREGLAGCIAIKIASPIFESQTKNKLGNTNIRAELAKRVKEAVLSSLKKNPSSAERIQEKIKLNEKTRKNAQFLKQELKDKQKKLHYKIPKLRDCKFHLTDNSLYGKNSSIFITEGESASASILASRNPLTQAVFSLRGKPMNVFSSKEETIYKNDELFYLATALGLHKDSLQNLRYNQVILATDADVDGMHIRNLMITFFLKTFLPLVASNHLFILETPLFKVARGHKDATFYCYSEEEKLSTIEHIGKKESSLEITRFKGLGEISPKEFKSFIGADMRLTPVSLPDTETLDTLLQFYMGKNTKERKLFIIENLVTNL

SEQ ID NO: 767 - protein, 502 aa, Chlamydia trachomatis
ESCYQPLAINELMSDLSDLFKTHFTQYASYVILERAIPHVLDGLKPVQRRLLWTLFRMDDGKMHKVANIAGRTMALHPHGDAPIVEALVVLANKGFLIETQGNFGNPLTGDPHAAARYIEARLSPLAKEVLFNTDLMTFHDSYDGREQEPDILAAKIPLLLLHGVDGIAVGMTTKIFPHNFCDLLEAQIAILNDQPFSLLPDFPSGGTMDASDYQDGLGSIVLRATIDIINDKTLLIKEICPSTTTETLIRSIENAAKRGIIKIDSIQDFSTDLPHIEIKLPKGIHAKDLLRPLYTHTECQVILTSRPTAIYQGKPWETTISEILRLQTETLQNYLKKELLILEDSLSRELYHKTLEYLFIKHKLYDTVRSMLSKRKTSPSSSAIHNAVLEALTPFLDTLPAPDKQATAQLAALTIKKILCFDENSYEKELACLEKKRSSVQKDLSQLKKYTVLYIKKLLETYRQLGHRKTKIAKFDDLPTERVSAHKKAKEPAALDQEENF

SEQ ID NO: 768 - protein, 82 aa, Chlamydia trachomatis
DLLRMKEFLAYIVKNLVDKPEEVHLKEVQGTNTIIYELTVAKGDIGKIIGKEGRTIKAIRTLLVSVASRDNVKVSLEIMEER

SEQ ID NO: 769 - protein, 150 aa, Chlamydia trachomatis
LILEIPAPTAVFSFVIDEQLTGRLDKGLVSYNGAYSRAFYQQQIELGRVRVNGRVYTRVSHPLSLGDVVEVELIEEEEPSSLIPEDIPLDKVYEDDMILVINKPRDMVVHPAPGHTQGTVVHALLHEIGERLKQELPRGAMAPRDCTSLR

SEQ ID NO: 770 - protein, 124 aa, Chlamydia trachomatis
RNGSSTTRFKENAFGIQRLMEIRYFLARPLLEEEVCRLANNRKNFLFDAEKYLIPICYKQTIYLAKPLSRFPMTQEVWELHVQHVISLLKQQFGILTDHAPILLACEARQVVLLESLDSFVNIS

SEQ ID NO: 771 - protein, 117 aa, Chlamydia trachomatis
KILLTQVKYRKIFVLGESLVMDTQFIASRSVRNQGVTSVSGQVKEELMSPSNMTFEGPVRSLDQLRQALIAKMGEQKGQEMYDRFIQSLLISTFTTVHKEMDRAQRASKKMRSVYRD

SEQ ID NO: 772 - protein, 271 aa, Chlamydia trachomatis
MFPENKMLLIAGPCVIEDNSVFETARRLKEIVALAPYASSVHWIFKSSYDKANRSSVHNYRGPGLRLGLQTLAKIKEELDVEILTDVHSPDEAREAAKVCDIIQVPAFLCRQTDLLVTAGETQAIVNIKKGQFLSPWEMQGPIDKVLSTGNNKIILTERGCSFGYNNLVSDMRSIEVLRRFGFPVVFDGTHSVQLPGALHSQSGGQTEFIPVLTRSAIAAGVQGLFIETHPNPSSALSDAASTLSLKDLERLLPAWVQLFTYIQEMDAVSV

SEQ ID NO: 773 - protein, 128 aa, Chlamydia trachomatis
  VARIANT (1)...(128): Xaa = Any Amino Acid
MLFLYDXXLFHGIWCVVVLILCACVTALAVVKMGDFTNPTLVHQDSVTPAPPFLKIKKLGVRKRIISPEKQLFYCTIDKSCMELHFSNTSLHCRELLSHLTGCLQTEXADPLCFLEVLEDFLITKIIL

SEQ ID NO: 774 - protein, 239 aa, Chlamydia trachomatis
MSVLSVCNLIKKYNKKPVTNDVSFQVNAGEIVGLLGPNGAGKTTAFYQTVGLIRPDSGKILFKNTDITKKPMDYRARLGIGYLAQEPTIFKELTVKENLICVLEIIYKTRKEQTHLLNALIDDLQLTTSLHKKAGSLSGGERRRLEIACVLALNPSVLLLDEPFANVDPLVIQNVKYLIKILASRGIGILITDHNAKELLSIADRCYLIIDGKIFFEGSSAQMIANPMVRQHYLGDSFS

SEQ ID NO: 775 - protein, 377 aa, Chlamydia trachomatis
  VARIANT (1)...(377): Xaa = Any Amino Acid
IGGTFPRTPLIFEEIALLSEEQNQVLKTVLNSCFSLVCGGPGTGKTFLAVQMIXLILAQIPSAQIMVASPTGKASAHLHSVLTSQGIVGDSVEVVTIHKFLKDMRRGRSPVDLLLVDEGSMVTMNLLHGLIKTIRGESRGETIYADRMVIFGDANQLSPIGIGVGNPFHEVVSEFSKQACFLSTSHRAKHKELQELASAVLRKELIPFQPLPSRQEAIRRLSFAFTQAAKEGVSLCALTPMRQGLWGFLQLNRLLFNEMQEKHPRAPIPIIVTERYETWGLTNGDTGVLDPVTEQLRFMNGEILHQADFPYYSYNYVMSVHKSQGSEYDRVIVILPKGSEVFDSAILYTAITRTKQHVEIWADREALEAIILKRGRY

SEQ ID NO: 776 - protein, 140 aa, Chlamydia trachomatis
IHSTTAKRKIFPVNVNQHVQDIVPSLLAQHILLPFDIAFAQKHLSQEEFSQEAEAFLATASALLRCGYPYFSICDETIHPTLPGISNKQLFQWFQLLSSRIKEELFEVVNHKIYLRSLFLLREKVFHKLHRLAGRFHVHL

SEQ ID NO: 777 - protein, 416 aa, Chlamydia trachomatis
KLIGARRYAEGRIVINSIFNKIFSREYAWSVDMYNRLVLMLGQSYLLELQEGVRSDLLPEYYETILFYQKQMKGFDAGAYKTFFPESMLVPTIMQHIFVIPETQLPLFMDALLMWENSYVHPDYSLVLERMKPAVLQDGIHTQKICQAIADSKIKKLKEKLIELFSDELVFCVSQGNTVCADQYLALLKTLDPRSSWGHKLLLSEKEIVNMVCEDDAQYSRLKDYLLLWEEQDIADVDRQQLVHYLFFSAKHLWRGGQEEACLRLLKEILLFSQNEKACLNRTLRLVKDFYTQALAMRNFTHLVWIENFLDEVGLPKTLASDAEIANCLADAQYLFSKGDYRLCIVYSSWLARVAPSTEALQLLGLSLVEQKEYTEALEVFQKLPLGEDAWNSQVHKASLLCYKYIARQQKEKSFP

SEQ ID NO: 778 - protein, 193 aa, Chlamydia trachomatis
VVRVFLLVVFLLSCFSAGGRSYVFFSSRDDSPSHYDHTHRTVARLREGSTLSEGLSMEQEQMYLLCCQGFSLQIQRKFQESKEIFSRIDKRKTSAPFVLQRELLEGRILNAYFLNNLSLMAECIAELERVSGSEAHLLFFKALHAHRTKQYNLAVDVLSRWFGHVDQTKPLCLDTNVYELFSPYVLEEIAAES

SEQ ID NO: 779 - protein, 386 aa, Chlamydia trachomatis
LSLKYCKLTPRNIRGRRWQPLKVESSRQRNKGVYMSVPDRKRALEAAIAYIEKQFGAGSIMSLGKHSSAHEISTIKTGALSLDLALGIGGVPKGRIVEIFGPESSGKTTLATHIVANAQKMGGVAAYIDAEHALDPNYAALIGANINDLMISQPDCGEDALSIAELLARSGAVDVIVIDSVAALVPKSELEGEIGDVHVGLQARMMSQALRKLTATLARTNTCAIFINQIREKIGVSFGNPETTTGGRALKFYSSIRIDIRRIGSIKGGENFDIGNRIKVKVAKNKLAPPFRTAEFDILFNEGISSAGCIIDLAVEKNIIDKKGSWFNYQDRKLGQGREAVREELKRNKELFHELERRIYESVQASQAPAAACVDSESREVAEAAK

SEQ ID NO: 780 - protein, 178 aa, Chlamydia trachomatis
  VARIANT (1)...(178): Xaa = Any Amino Acid
MKNIVEQKRCLRREGLAKREQLSVQRRDEAARELMHFVMQTIXQGFVLSYIPFRSELDVRGINAWLAQENRLLLPKMQGMDIVPIALPFTMIESLYSPKDLNQIEGEEIEAQQIAAALIPAIVFDQNKFRLGYGGGYYDRFLSKYPYIWTIGVGFKEQLLAYLPREEHDVPLDQLYLT

SEQ ID NO: 781 - protein, 434 aa, Chlamydia trachomatis
VGRSRGGLGTMCVSRSLRWCLCFLLLCGWVDAGVYDKLRLTGINIIDRNGLSETICSKEKLQKYTKIDFLSPQPYQKVMRTYKNAAGESVACLTTYYPNGQIRQYLECLNNRAFGRYREWHSNGKIHIQAEVIGGIADLHPSAEAGWLFDGTTYAHDSEGRLEAVIHYEKGLLEGISLYYHANGNVWKECPYHKGVAHGDFLVFTEEGSLLKKQTFCKGQLSGCALRYEPGSQSLLSEEEYKQGKLRSGKYYDPLTKEEIACVVNGKGKQVIYGKYAIIETRQIVHGVPHGEVLLFDEHGKSLLQAYSLINGQKEGEEVFFYPGGEGRKMLLTWSQGILQGAVKTWYPNGALESSKELVQNKKTGILMLYYPEGQVMATEEYVDDLLIKGEYFRPNDRYPYAKVEKGSGTAVFFSATGGLLKKVLYEDGKPVIH

SEQ ID NO: 782 - protein, 111 aa, Chlamydia trachomatis
ERKTMGIWVYLGSNNHNNTGMSSSSIWSSFWKENNVLFSPKVCSCHDKRLSSKKAFRSLTARLLTTQAVAGSLARASRSLFKKTRFSPWAIQLGKLACLCAAFSRAFLIAT

SEQ ID NO: 783 - protein, 159 aa, Chlamydia trachomatis
CTNRSAREGIMRRLGVWVLLLLASGAASLPAIGAWCWRQRTAEAWENLLIDMRDFQSKRERSSQVAIKNARLKAAHKQASFPNWIAQGENLVFLNKERDALAKLPATAWVVRSRAVKDRKAFLEDNRLSWQEQTLGEKSTLFSFQKELQIDDEDIPVLL

SEQ ID NO: 784 - protein, 97 aa, Chlamydia trachomatis
IPPTVPTNQEVMEVLGRMTANLPSVSFSHYLYKLEDIPSEERPLGGYRAYISLQGAANDEDFASFIDQLSAWIGARVLSKKLADRQFDVRIALQGRG

SEQ ID NO: 785 - protein, 227 aa, Chlamydia trachomatis
MDFKLPIYCIGVTQSAENVTRIAILQKTCKGWSLCRCEKLTETGALSWPKRFLSSKVVLSLQGQETLVKSVSSSLKSKKNFLKMVYAEQEATAAFPLKDLVIAHDLGEWNSAQERVVTLWMLQRQSVALATALLEEKGGFATHISCRAKDLFSALQQSLLRNLETYFFVYEGLDETVCLFVQEGSVLLSRSFKNDSESLLDDLLASFAYVQEVYTASFIRDPRRLSI

SEQ ID NO: 786 - protein, 334 aa, Chlamydia trachomatis
MAPSIFIKNLPLKSPVVYAPLAGFSDFPYRRMSAEYRPALMFCEMVKMEGLHYCPQRTLRLLDFAESMRPIGGQLCGSRPDLAGESAKILEGLGFDLIDLNCGCPTDRITKDGSGSGMLKTPELIGKVVEKMVEVVSVPVTVKIRSGWDFDHINVEETVRIIKESGASAVFVHGRTRSQGYQGPSNLEFISRAKQAAGDDFPVFGNGDVFSPEAAKTMLETTHCDGVLVARGTMGAPWIGKQIEDYLTTGTYSSPSFSTRKQAFVQHLQWIEEYYQSEEKLLTDTRKLCGHYLILSPKVRSLRANLAKASSSQEVYQLIDGFEELTEEEELLSE

SEQ ID NO: 787 - protein, 265 aa, Chlamydia trachomatis
NRLSKCHKGKLVKIWAKNRYFFGCSEYPTCDYKTSEEELTFDKNEYAEDTPWDAPCALCGGEMKVRHGKFGSFLGCENYPKCHYIVNLFKKGEAGAEPEATVHCPAEGCTGHLVKRRSRFNKMFYSCSEYPACSVIGNSVDAVIEKYAGTPKTPYEKKPKAKKSIASTKGKAAKTVKKSSATTKKRATKAYTPSAALAGVIGADPVGRPEATKKLWEYIKEKGLQSPQNKKIIIPDSKLQGVIGADPIDMFALSKKLSAHLIKEE

SEQ ID NO: 788 - protein, 617 aa, Chlamydia trachomatis
LCERLRSRLLALCMKKSLIIVESPAKIKTLRKLLGEGFIFDSSLGHIVASPLPAKGFGIDIENGFVPDYQILEGKEEVIRKICAEAKKCDVVYLAPDPDREGEAIAWHIANQLPKDTKIQRISFNAITKGAVTEALKHPREIDMALVNAQQARRFLDRIVGYKISPILGRKLQRWSGVSAGRVQSVALKLVVDREYAIERFVPVEFWNIRVHLKDPQTQKTFWAHLHSVNGKKWEKEIPEGKTSDEVILIDSKEKADEIVALLESATYVVDRVESKEKKRHAYPPFITSTLQQEASRHYRFSSSRTMNIAQTLYEGVDLDSQGAVGLITYMRTDSVRTDPEAVKQVRKYIEGHFGKEFVPSSPNVYATKKMAQDAHEAIRPTDVTITPESIRSKLTEDQYKLYSLIWKRFVASQMISAIYDTLAIRITTNKGIDLRATGSCLKFKGFLAVYEEKRDEEGDEEENIHLPKLNERDVLTKEELEAEQSHTKPLPRFTEASLVKELEKSGIGRPSTYATIMNKIQSREYTLKEGQRLRPTELGKVVCQFLETNFPRIMDIGFTAGMEDELELIADNKKPWKQLLQEFCELFLPFVVTAEKEAFIPRIVTEIDCPNVIKGN

SEQ ID NO: 789 - protein, 350 aa, Chlamydia trachomatis
VFPGPNDIGSQENVKDICSLDPTNYVNSSCYSRSFPHQPIGTPLFFGKKPVLTYGEVSKLISSKTDPEPFSYCRPTFLRAALNTLEFLSSPPSSDPYDDLLQLNKEGFLAGPEEEKQAFFLRVERTLAEAPVHPTPFPIEFQKLFDVNPSFLEVVYSNESLDAWEAGCTWITDNRVSIQLRKGFQKASFWFGFFSKEEVLSHEAVHAVARGMKFYEPIFEEVLAYSTSKHFWRRFFGPLFRSAGETHFFLFFVLFGAFLFPWFPWIGLSCILAPNMFFFFRLFRTQILFRKAKKKIRKLLGIEPLWVLLRLTDREIRLFATQPLAVIEDFARKEKLKSVRWRQIYQSYFT

SEQ ID NO: 790 - protein, 81 aa, Chlamydia trachomatis
IDTLLSVIHVHPASQASKLSLEYTTSKKEGFTSKSFWNSMGKGVGCTGASANVLSTRRKKACFSSSGPARNPSLFNCNKSS

SEQ ID NO: 791 - protein, 499 aa, Chlamydia trachomatis
PPFQVVWQIGFKREMIILFTRVIEIFCAILGVYFFHIHSVVGGYFVLVLMACHSAIFGPAKMGILPEMLPIEELSKANGAMTAATYSGSILGSCLAPLMVDLTKDFVTNSYELSACFCVVSSVLSLFIALGIRASNVKNKGQKIAYVSFRNLWQVFQETRNIAYLMISVFLVAFFLFVGAYVQLQIIPFVEFTLGYSKHYGAYLFPIVALAVGMGVGSYMAGWISGKDIKLGFSPLAAIGVGLSMMVLCLLSFSITAVLILLFCLGLVGGIYQVPLHAYIQFVSPEHKRGQVLALNNFLDFSGVLLAAGFVRLLGAGLRLTPDQSFLYMGSLVVCFAILSLWMLKEHVYRLLLTRVLKRQLGTSFSSPKAEEVWCFFVPATSYKETRRILALFPKTVRSCVFILDKALQPGWTSYLIPHCVPTIFSYGVEGQAFAQWIDRQVVEVKALLKRQPSLGVVCLGNQAQSQFFFSQLQASGLAVQSGTLVQDSELKYSLHLAN

SEQ ID NO: 792 - protein, 744 aa, Chlamydia trachomatis
KKLIEIVIYNCKKMCNDQCTERSFPRNNTHECKPMNELSHSQSTFSNYPEVLLAKLAQDLFSINQTPMTKRWILVPSSDTDHWLRRELVKASSNHIFMGTHIFASFDAFVKYLFTGTRLVDLSTPDHITLPLTIYNLLKESSFNSSSEVSYSHLQKLSSIFKKFYTFSQEPSTNNPYYKNLFAQLKDSYTPLETIFSSILDHPPEYPCSLHIFGYPQLPQHVASFFVALGKYFPVHFYCFSPSAAYFGDLLSDKAMAALSPRIPEPHQETWEKYVLTDRLALLANLAHKSQSLQNFFLDYSVPYEELFQPYEKLSSLHIVKDSFFHLQPIDQKLFSNSPQTIFVRQAPSASREVHQLFSLVSQLLHSGVPAQEIFILSSNLSKYETLLRGIFEPHLPLYLTKTEKTQTRTLKNKLLLVVTFLFSKGSLNDLLRILSHPDLLSPLETTKMGFLTHKLTHYWKSLSQKDSPLTQLIHRILDEYPFIDDTGSVNEAETWEVVVPLLHTLQQVTASYIESKDKTYEEHSRLIFSALENIFFLSTEEYALLVSLSKTLQPFVRSSCSLTIFIEFCLDFLSHIPGHSQLYNQPGPFVGSLNSLSLIPKGYTFILGANKKDHSLDTSFLIDPSLIQEDFLFSSTEDEDNLHFLQTIVSTKHQLHISYLSSSKNPALPSSALQNICWMLCLFKKNIFLGNFMLKKTFLLNRCISLTRFTTGWLKSPRYKTRPHPCLSLIQLRRYLHTYPYNI

SEQ ID NO: 793 - protein, 382 aa, Chlamydia trachomatis
LSLFIQESSITELCFAKHLLDAVPIQEEHLSGKLYAKENFSSEPLHQSYQVYYRMAQVSPLQNKAPSLFKSDTTKTLPSHLSLQHLIKAFKDPLNFFLSTQHGFSFHPKALFSKSEKVFPSPHDAKAFWNHLLSSKTPLPTTNYLSAFTESLYTDVQDSVSKRLETLQKDPATTPFSVVFSDQLFHDPLHPNDQQVPPLLLSLPLKNIHLQGTIHGVCSKGVYLFSMHPGEAFKKTQKTHGFPKDAFELESYLESYLSLALLQASHLLPKEATILRVTPHDIEPILPPFSSPESYLIRAIHLYDLLQNQAVPLPSAQAWEYIKKTDSASQCIKKLLDSEEDPLTSSFWWFHNRDTEEICSELSNDVLSQLLSLFINQDSQQN

SEQ ID NO: 794 - protein, 1026 aa, Chlamydia trachomatis
  VARIANT (1)...(1026): Xaa = Any Amino Acid
MSSFDIFSPTASVSGKFFLEASAGTGKTFTIEQVILRSLLEGSIEQTKNILVVTFTNAATNELKLRIQASLKQALSLFSQALSHPGTPLPPYISSSETKVKQLYMKIRNSLATLDEMNIFTIHGFCRFTLEQHFPWIQPIQPSSIFSEPQTIQQYILDYLRKNLWDTVLSPKQYAFLSYHHRATTQQTRHLIERLLQDYTSTPNLALSPLSITLQKLKAWVSCYQHLAPLSLEEMQAFSLRFKQSDLSIERELPAFVQQFETNPYSLDMLFFPGMVQKFQEENRNKKKLSAPASPLDPFFQDWIQLAHPFCQKEPIFHTLLKSVQQHLKTHCAQSYSHDESIATLESLLDHNDTVVSQLRKQFQLVLIDEFQDTDKRQXQIFSKLFASPDYSGSLFLIGDPKQSIYEWRNADLPTYLQAKHSFPKEARLILDTNYRSTPXLMQGLNHLFSLPTPFLETPQNILYHPLHSKGSSEISYSEFSPIHFFSSEDIQEETLWISKTASYLRSAYSIPFGNMAVLVQDYPQALKLITHSTIPMAYCKEKRIFDRTESPYLLILLLEALLYPENQQKIQAILMSRLFQLSSTEIHQHLKTFSSLFFTLNRHLYHYSLLATFYKLMGENVLSQTIGETLLQTPLGDIIFQELEALCLYLDKTTENPHHKLLHLINILITGKYDEELSFSSQSNDENMIKITTVHSSKGLEYDVVFCSCLNKAKEKTPSVHMREMYVACTRAKKFLFIPFSPIEKRSLSTKKLSALANYANVTKHHSVPHLVETLTSSSPELFSSSFQPPESSLTPDRERLPQQTYFSLPHLPSRTIHSFSSTVENLHFSEPIQELSPSLLFPGGSLTGTLIHKLLESLAGNFAACFEEIFNKAQTLLKNTPLEGYESIIAEKIYTVFSTTLPFSSGSFALRNIHPHNIRVEETFLLQEEGELWQGIVDLFFEHKGRFFIIDWKTSFLGDETSCYSPDQLHLYIQRQGLDRQERLYRKAAKRFLHQFNSSLQVEMAFVFIRGLDDKGNGFLQPGR

SEQ ID NO: 795 - protein, 157 aa, Chlamydia trachomatis
TPSNYSQIKPKISGRSLGLKSIGGNTKKSTVEQSGAKDCAFIFKEQDPSLLGRTSLTVATRSPGGKTPSNPVVTRTSPTSIVFPSTKPKSLPLSIEASGFQIGSPRPQTIPRRAKSFCSDRDKESSRACKRCKASCLSLSAKADAGRLATFLANVRS

SEQ ID NO: 796 - protein, 345 aa, Chlamydia trachomatis
VLLTVLLRLMNTLGPYHKRVRFITYLFVAFGIIVSWNLPRSAYESIQDTFVRVCSKFLPFRQGSDSQALVEETQCFLLKEKIRLLEERILSMEEAKQSPPLFSEILSSYFQSPIMGRVIFRDPAHWGSSCWINIGKRQGVKKNSPVVCGKVVVGLVDFVGEAQSRVRFITDVGIKPSVMAVRGEIQTWVVKDQLRTLARNVANLPASAFADSDKQEALHLLQALEDSLSLSEQNDFALRGIVCGRGDPIWKPEASILSGSDFGFVDGKTIEVGDVLVTTGLDGVFPPGLLVATVNEVLPKSEGSCSLKIKAQSLAPDCSTVDFLVLPPMDFNPNDRPDIFGLIWE

SEQ ID NO: 797 - protein, 377 aa, Chlamydia trachomatis
RGFIVSLFEQLPSFSPDSILGLAQAFQEDPREDKINLLLGTYEREKKRYGGFSSVRKAQSVFFDDEKDKNYLPIKGSSTFLEEMAALCFGELDANRWVGVQAIGGTGALHLGASVYANASLAGKVYIPSQTWGNHSRIFSHQGLALEYYPYYDQETKELDLQGLKAVLRSAPETSLVLLHCCCHNPTGKDIPLSEWPEIITIIKERDLIPFFDMAYLGFASGIEEDRRPVQLCIEAGVTTFVAGSASKNFSLYGSRVGFFGAIHQDKQDLNRILSFLEEQIRGEYSSPAREGVAIVTSILSNPYLRQEWELELNGIRQSLEEIRSSFVIAMRNVAGHSFDFIASQKGFFGYPGFSKEQVLFLREELGIYTTAAEDSI

SEQ ID NO: 798 - protein, 134 aa, Chlamydia trachomatis
VPSNKLILSSRGSSWKACAKPRIESGEKEGNCSKRLTIKPLYSALLLTVFFSSKMTACCPKSCKHDNLVSSLGVLAQLVERNNGIVEVSGSIPLCSNFCLIPYRRNFLDLVLLALKQYSFSNSFSNHFLGQFRF

SEQ ID NO: 799 - protein, 735 aa, Chlamydia trachomatis
CNIALFCYSAYISGLKRGAIVDYLENLQSLIENHPSDFFSLWEEYCFNDVVKGDELVVLLEKIKGSTIAPAFGKIAESVIPLWEQLPEGEEKDKVLSLVFDVQTTNSKNLLEIALQQVKKYEDSANYKEALRIVGLRDGITFSHCLGRFALLMHLSEGNFVFHQGGWGVGEIMGVSFLQQKVLVEFEGVLTAKDISFETAFRMLVPLRKDHFLARRFGDPDAFEAFARKEPVAAIECLLKDLGPKNAKEIRNELVELVIPEEDWSRWWQSAKIKMKKDARILAPASSKDPYVFDPKGFSFVSQLQASLSGSNDANKKITSCYAFVRDLGSELKDESNRQSVIKELKALDLPADSALLIQRAMLLSEFLGEKAPELEYENIAKLSEDQLFDIVNNIEILSLQKSFLALIHSCSPVWVPVYTKLFLTTSTSMLREQVFKVLNADKEARENILKKVFAMIEQPLLYPELFVWLFARVVDGEDGLFAESDKKEIERQMLASALELMHKVATTPQKDLGKKLYSFLVGQRFLVIRQIIDQASIEYLKEFVLLSSKCPQFTQGDLGVLRSLAEVVQPALKRGTLEEEENILWTTSDSFTRMKNKLQSLVGKEMVENAKEIEDARALGDLRENSEYKFASERRARLQEEIRVLSEEINRAKILTKDAVFTDSVGVGCKVVLESDQGDKVCYTILGPWDANPDEKILSLKSKLAQEMVGKAVGETVLFQGKKHKIKEISSIWD

SEQ ID NO: 800 - protein, 150 aa, Chlamydia trachomatis
NIEIFVMKNNSAQKIIDSIKQILSIYKIDFDPSFGATLTDDNDLDYQMLIEKTQEKIQELDKRSQEILQQTGMTREQMEVFANNPDNFSPEEWRALENIRSSCNEYKKETEELIKEVTNDIGHSSHKSPTPKKTKSSSQKKSKKKNWIPL

SEQ ID NO: 801 - protein, 461 aa, Chlamydia trachomatis
MKIVVSRGLDLSLKGAPKESGFCGKVDPTYVSVDLRPFAPLPLEVKVTPGDQVTAGSPLAEYKLFSGVFITSPVDGEVVEIRRGNKRALLEIVIKKKPGISQTKFSYDLQSLTQKDLLEVFKKEGLFALFKQRPFDIPALPTQSPRDVFINLADNRPFTPSVEKHLSLFSSKEDGYYIFVVGVQAIAKLFGLKPHIISTDRLTLPTQDLVSIAHLHTIDGPFPSGSPSTHIHHIARIRNERDVVFTISFQEVLSIGHLFLKGFVLGQQIVALAGSALPPSQRKYLITAKGASFSDLLPKDIFSSDEITLISGDPLTGRLCKKEENPCLGMRDHTITLLPNPKTRESFSFLRLGWNKLTVTRTYLSGFFKRKRVFMDMDTNMHGEKRPIIDAEIYERVSAIPVPVALIIKALETQNFEEACRLGLLEVAPEDFALPTFIDPSKTEMFSIVKESLLRTQKRMW

SEQ ID NO: 802 - protein, 342 aa, Chlamydia trachomatis
VYNFMTRLPLLKRPRRNRKSAAVRSIIQETQLCSSDLIWPIFLKDGSGIREEIESMPGVYRWSLDMVSKELERLCTIGLKAVILFPVIDANKKEQFGSYASHPYNIVCKGIQAIKKSFPELCVISDIALDPFTTSGHDGIFHNNYVINDESVRVYGGIAVMHAEMGADIVAPSDMMDGRVKHIREQMDQMGFVNTGILSYSAKYASALYGPFRDALSSHLQSGDKRTYQMDPANVQEALLECQLDEEEGADMVMIKPAGFYLDVIVKARENTHLPVVAYQVSGEFSMIMAACLHGWLNKESVIKESLLAIKRAGATAIISYATPWVLEWLAKDALPFERSVL

SEQ ID NO: 803 - protein, 238 aa, Chlamydia trachomatis
ANLLYRSFLMLSKEGGFSEEQRARLSHFVTNLDSPIFALKNLPEVVKGALFSKYSRSTLGLRTLLLKEFLDGEGGNFLDDDQQDCELGIQKAVDFYRRVLDNFGDDSVGELGGAHLALEQVSMLAAKILEDARIGGSPLEKSSRYVYFDQKVNGEYLYYRDPILMTSAFKDVFLDTCDFLFNTYSDLIPQVRSHFEKLYPKDPEVSQSAYTVSLRAKVLDCLRGLLPAATLTNLGFFW

SEQ ID NO: 804 - protein, 304 aa, Chlamydia trachomatis
GFFGNGRFWQNLLHRLQDNSLVEVRNIGEQSLTELMKIIPSFVSRAESHHYHHQAMVDYRRALKEQLKSFAHRYGEEREISKEAGVKLVYGDPDGLYKIAAAYMFPYSEHTYAELLDICRNIPNEDLMRILESGASFRENRRHKSPRGLECAEFAFDITADFGAYRDLQRHRILTQERQLLTKKLGYTMPSQLIDTPMEAPFRGAMEKADQAYRLIAEEFPEEAQYVVPLAYNIRWLFHINARGLQWLCELRSQPQGHESYRKIAIDMAREVIQFHPAYELFLKFVDYSETDLGRLQQESRKKS

SEQ ID NO: 805 - protein, 86 aa, Chlamydia trachomatis
EKMKTLIDNNIVRFKNISKTKQGIFVNFQVKGERGGASFTASIAVDIDAADVSAGDSLETIIERCALIGIREFQKCEFQFDGIICL

SEQ ID NO: 806 - protein, 227 aa, Chlamydia trachomatis
MAGPKHVLLVSEHWDLFFQTKELLNPEEYRCTIGQQYKQELSADLVVCEYSLLPREIRSPKSLEGSFVLVLLDFFDEETSVDLLDRGFWYLIRPITPRILKSAISLFLSQHSLHSVPESIRFGPNVFYVLKLTVETPEGSVHLTPSESGILKRLLINKGQLCLRKHLLEEIKNHAKAIVARNVDVHIASLRKKLGAYGSRIVTLRGVGYLFSDDGDKKFSQQDTKLS

SEQ ID NO: 807 - protein, 246 aa, Chlamydia trachomatis
IPSYACIRSLVMVLSASLFSPEEFLYPEIVSQAEFVWSILTLLEEKLASHTFSGIHGHLEEGVYLKNKETIEIQEGAYVESGAYICGPCIIGPYTQVRHGAYIRGGVITSSHCVIGHCSEIKNSYLGHHAKAAHFAYVGDSVFGSRVNLGAGVRCANFRLDGKTIFFHHSGERYDTKRKKLGAFLGRGVSVGCNTVLNPGCYVASATKILPKSNHLLRNNLCQTKVDEKKKAVAWIWIISAFIDRK

SEQ ID NO: 808 - protein, 129 aa, Chlamydia trachomatis
LDMDYFSVYRSKVEKKLRDSLGDFGNTQGGLRDPIEYALLGGGKRVRPLLVGLFAEGIHKERDVLDTAIAIEYIHTSTLIADDLPCMDDDDMRRGKLRFTKLLMKLRLSWLRMLLFQLLMHEFVRMQKR

SEQ ID NO: 809 - protein, 199 aa, Chlamydia trachomatis
RQASVHKAFDEASALLASYALIPAAYARIRKNAKALKAVVSCEQDVEEAYEDILELIELRFGVGGILGGQYEDVFFHDFSKENVLGIIKKKTGALFEIACVSGWLFGGGERESSTLVAEFAEHFGLLFQIRDDLADLSQDDQEEKHMNYALLFGEVAAKELLDHSFESCIKNLHLLQERGLECSEPLEMLCKNVFCGWK

SEQ ID NO: 810 - protein, 105 aa, Chlamydia trachomatis
KSPPIAGEGIRVFGAARDVVQKCVLWMEINTFYANLAAEDFGRGAHRTWASLFFMLVGFLVLLGNSSVQLLDKGVFYGKACFLSLQRKLEYEELESILLNNILYG

SEQ ID NO: 811 - protein, 164 aa, Chlamydia trachomatis
PKSIDPAKTPVMMYCTGGIRCELYSALLLEKGFKEVYQLDGGVIAYGLKMGTGKWRGKLFVFDDRMAMPIDEADPNVSPIARCSLCNTDSDTYYNCANTDCNNLFICCESCIATHKGCCSEECSQAPRIRAFSAERGNKPFRRKHLCPTIEQSCCLKEQENQPA

SEQ ID NO: 812 - protein, 170 aa, Chlamydia trachomatis
DVFMEKNYYALAYYYFGPVSNPYEEIALHKQLFKTMDVSCRIYISEEGINGQFSGYQPDAERYMAWLKQRPDFASIKFKIHHIEENIFPRVTVKYRKELVALGCSVDTTKQGKHISPEEWHEKLQENRCLVLDVRNNYEWKIGHFENAVLPDIETFREFPDYADRLAKEH

SEQ ID NO: 813 - protein, 209 aa, Chlamydia trachomatis
MARYCGPKNRIARRFGANIFGRGRNPLLRKPNPPGQHGMQRKKKSDYGLQLEEKQKLKACYGMILEKQLVKAYKEVVNKQGNVAQMFLEKFECRLDSIVYRLGFAKTIFAAQQLVSHGHVLVNGKKVDRRSFFVRPGMQISLKEKSKRLAIVTESLENKDQSSLPAYLSLDKAAFKGELVVAPELDQIASQLPLPVNVSVICEFLSHRT

SEQ ID NO: 814 - protein, 290 aa, Chlamydia trachomatis
MFILPPPQEPLLGAHTSAAGGLHNALYEGRDIGATTVQLFTANQRQWKRRALTQEMVDQFRIALNETSLSYIMSHAGYLNNPGAPNPEILEKTRVCMHQEIADCISLGISFVASNFHPGAALSDSKESCLDRAITSFSQMAPLFENHPPLVVLLETTAGQGSLIGSSFEELAYLIQGIKALIPIGVCLDTCHIFAAGYDISSVAGWEQVLKHFDAVIGLSFLRAIHLNDSVFALGKNKDRHAPIGEGCIGSDSFCFLMQDERTRMLPKYLETPGGPDLWTKEIRYLQKVC

SEQ ID NO: 815 - protein, 356 aa, Chlamydia trachomatis
VMRKDDEGSLVRSLFNLLSGTFFSRLTGMLREIVMATYFGADPLVASFWLAFRTIFFLRKLLGGPILGLAFIPHFEFLRAQNISRATFFFKSFSRFFCYSAILFTLIIELGLCVWCSCVTGSLFDTLFLTIILLPSGIFLMMYTVNSTLLHCEKKFFSVGLAPSVVNVLWIGTVFLARNYDPRNRIFGLAVVLVVGFILEWAITLPGVMKFLGQSKEVPQERDSIRALIAPLSLGLLSMGIFQLNLLCDMWLARYINEVGPLYLMYSVRIQQLPVHLFGLGVFTVLLPAISRCVQDQEHQQGYDLLRFSLKLTVAVMVVITMGLLLFALPGVRVLYEHGVFPYNSCARYCRSSKRV

SEQ ID NO: 816 - protein, 219 aa, Chlamydia trachomatis
RWGYCFLLCLGYECYMSTECFLTTAVHAIVEVLRGYSGSIIPMALAPLVSALFYARRNYKVPMLVGIIAAVVNMVLNVIGCLVCKQVAVLAYATSLASWGQLAMLWYCAGKSLPTYKGLMWRTFKESGKTVITTILAAVITIGVASNIVTHTTYVVFIEPLTVPTKPLVSFLDQCGVFFAESALFLSVLFGLAKLLKTEDLVNLTSFQYWKGHQSILRN

SEQ ID NO: 817 - protein, 132 aa, Chlamydia trachomatis
ALLDNKIQTMGRLYEMSNFAKDIMKKYFYKGFVGALLLACGSTNLAFAQASSMDSQLWSVEDLDSYLSSKGFVETRKRRWSFTFSWRCPRSMDLCKRGILRQLRLLLNLFYLSIVIVVNSICMWITPLLIVG

SEQ ID NO: 818 - protein, 372 aa, Chlamydia trachomatis
  VARIANT (1)...(372): Xaa = Any Amino Acid
LEMSALDGFMQKRHLETTQTPTKPILPINRYRSEFNLYVDYTAANSWMTSKMNWVTIAGGESSAAGLDINRAFLGYRFYKNPETQAEVFAEIGRSGLGDIFDSDVQFNSNFDGIHLYAARRISEKLPFTMIVHGGPFVVNMAEKEYAWVVEAILNKLPGNFVVKTSVIDWNTLTAKTNDPADASTAQPAKPNTKYDYLVWQWLVGKSTAMPWFNGQTKNLYTYGAYLFNPLAEIPENWKQSTTTPATKITNGKENHAWFIGCSLGGVRRAGDWSATVRYEYVEALAIPEIDVAGIGRGNQMKYGFAQAIKQGLDPKESNGFTNYKXVSYQFVMGLTDSVSFRAYAAYSKPANDNLGSDFTYRKYDLGLISSF

SEQ ID NO: 819 - protein, 352 aa, Chlamydia trachomatis
  VARIANT (1)...(352): Xaa = Any Amino Acid
GFFIFLYCMESGPESVSSNQSSMNPIINGQIASNSETKESTKASEASSSASSSVSSWSFLSSAKNALISLRDAILNKNSSPTDSLSQLEASTSTSTVTRVAAKDYDKAKSNFDTAKSGLENAKTLAEYETKMADLMAALQDMEANSDPSNDHTEELNNIKKALEAQKDTIDKLNKLVTLQNQNKSLTEALKTTDSADQIPAINSRLEINKNSAHQIIKELKEQISNYKAVLTDVEKVIKEFSEAGIKLGQALQSIVASPAGDQSQAAVLQARQSNSPDNIAATKKLIDAAKTKVNELKQEHQEIADSPLVKKAEEQINQAQQDIQTITPSGLDIPIVGPSGSGXPQEVRQER

SEQ ID NO: 820 - protein, 333 aa, Chlamydia trachomatis
  VARIANT (1)...(333): Xaa = Any Amino Acid
WFGYSYRWSEWVRXSAGSAAGALKSSNNSGRISLLLDDVDNEMAAIAMQGFRSMIEQFNVNNPATAKELQAMEAQLTAMSDQLVGADGELPAEIQAIKDALAQALKQPSADGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQANQEEIMQKLTASISKAPQFGYPAVQNSVDSLQKFAAQLEREFVDGERSLAESQENAFRKQPAFIQQVLVASNIASLFSGYLS

SEQ ID NO: 821 - protein, 543 aa, Chlamydia trachomatis
KKYYWDRFATSTTVELRELAMNRIHRTQGSLTDYNSTLEAIAKKIAKPDSATIVSQVAQYEQFKMEQEALKALLVSFDQKADQRYRNLIQRLEQLDVDRQTGRSIESPHIQEKPMASLQSENQVVAQAVVQSDSSMPIFTGIKQSWAVRLVQGIREILDQLLVDTSLFTEEERGDLLAIRMDAASLQDKQERLSAEDIRSLLSLSNDVMRVLQKASVSSTRQLELIQSLIDIFGTEENLEQSFAQVRLENFQAILSVIKERLTEEEFRVFQEVSEEISSIQRTSESHLSPEHIEAIARVGGYLSAKIVESELKASQKVDLCQRIAAMYQEQVDAVQAYHSLEQDALFVNSRQHGYFVQVISLVSSLMHSLSPTSEEERILLNPAMMVSVLPTVRAIGLRFDFLTAEQQQMVNAAVSSLQQQQLDEFLGVLCAHLVVVNCQNKETGLLEGLEESFSETLSGLSNNFVLTAKMQDILQVCSLQGFVTLANGDRYELFSYNDSGEAVCDEIALGDGFHKVLGTMLAVALSQAEVFKARVRSIHSAS

SEQ ID NO: 822 - protein, 330 aa, Chlamydia trachomatis
RFLKQRYLKQECDRFILQADSEKNMIHKRMVQGEQKSLFLTKMQTELNAGKTIAQTKEVEASPLPSAVASVLIDHYMPKEVEFLEKISSRLYYGNKGSDIGNTILDAISLYVASNSATYFGFANYIGQPPVVGKTGENIFAGSADNAKAKLDEERKQVDVFLEITKAAKTTVTNQQSAVTDDDKLSTEQKAKINAELTQYTDMLNAINNSLTSLKTQLAPLSVSTVEGVDGVFEVKNGKPGENGKNWRLVLQTLEDTVVSGEVGSPTNIGMFQMQALVHSNQQAYADMGQNFQLELQMHLTSMQQEWMVVATSLQLLNQIYLGLARNLLR

SEQ ID NO: 823 - protein, 461 aa, Chlamydia trachomatis
  VARIANT (1)...(461): Xaa = Any Amino Acid
LLNRKISSMKRSRNLMTSQEVTTSVPFGLTLRLQQSSRLKTVTTDEVKQALTSQANTIVSDFSLAQTLKSTINKIVQENGEFKAKVDGIERQYTIFGPLKNDTSSNKATLNPILLNFGSIGFLPNITLAANNHAETSARAFFKFRALAQVESTKLDGTLQGSENFLQKINQLRKDLFSYQLLAQSYEIRSLPLPSAVASVLIDRYMPQEIDYLTQMKSDLYYSNFXSSVGNAMIEAIAQFVNGATYFNFASFVGQQPMTAMAXDTFSGSKETAEAKLALEKQQAKLYLQYATQALKVVQEQMERVQNDKVITNEQRLRITDALKGYADNLNAISGSLVLLQVYLNPLSVGVRNGNQRGNDTGTNPKGTFHVFRGKDQWQARLEILEDALVSGLPSNIISGGLFPLQASVQSDQQAYADMGQNYQLEMQMHMTAMQQEWTVVATSLQILNQIYLGLTRKLAS

SEQ ID NO: 824 - protein, 428 aa, Chlamydia trachomatis
KTLVEMCSMNIFNKINSVSKDYTKIEELFLPTHKNKTFCMNQVMQFQKTEIERSAIQNVLSLLDLDNDVKGKYEQLVASLSSSAPTTTSQPSDESAVITYDPPSSNPLYNASKQAWVHNVLVGFLSVVASNEAKTKATEIAGQQNPPQTDLKPLTDLFDSLTTLVDKANHRELSNEDLETFYLLPDQIFSAIQTFPFEGNQKVLFSNQLLDSFGEDASIEQVFADIRIEGLQDTLNMVQSRLSATEFESFKELQMIIDTLREYVEPFNDEGFDTILQTSKDLSSAIINSSLSSNDKIELCRNIADLYRDQVLSIKNLDNVLNETIYINARNSSLFSNICSLVEFIMGSFAPIGLNETTIEVTNASIAGALQAVRAIDTRFHELTPEQKNLVNETVKKLDDFSGGNYIGAFWAYFTSATVVSSKDCDNR

SEQ ID NO: 825 - protein, 206 aa, Chlamydia trachomatis
  VARIANT (1)...(206): Xaa = Any Amino Acid
ILGQLLYLERVYLRLNSANPCSDFKNQARPAIDMEELNSGLYVLRRLAVALEAGYXGVGSVVNPSNRVFPGGDWGVRRAAGGSTPAAGTISGSTXADIKQSTAKVLVTTITDSLNALIEDVPEVPMTQVTGVSSNLVLMESYQQKDSLNDTEQASVFASAYAPSDESIKTVIKKEQEKELQEGKDRVTAQLTAQGASDQVIEKSLG

SEQ ID NO: 826 - protein, 398 aa, Chlamydia trachomatis
RSLWADYEKYYVDEYFDTHVKEALWKHRASIGENIQEMLDQCLNLGLDVPDSLTKENINDANAKLVLQAWMEAFNNAMEVEPALGGSKEVIDSVLKMIPFAKQSSNLSDTDINTIYTQAALPPPEVMDYYLTRQDAGICKGEVVKAFQQATQNLQSVRSNVEEQIKELEVKKTSFLQAQASLESMLEGVKRLNDNQKFTSVRLTSVMECYAGLIALSQITDVLDSAGISLITQYVDKFLKLNNAHTAQTLAHVISYMAAYCEVAECTMASTIVSEDTVLQKVKDKWNELKKEKFFESFTLPDDNELKTNYITSTNNVCRANFSNFVNTVITEKINLTVAVREAQSLLTEFQGKASEYLNTFQSEINTLNQTYDTLDPAKASFNYFYREYTFFTCTGCR

SEQ ID NO: 827 - protein, 106 aa, Chlamydia trachomatis
IQPKLLLITSTGSTPSLRAQAVDSWIDSTSLGSAFIHLILNTQIPKQENFLNPLIQEVNFNNVAANAVNDLLSITNNFSTSSVYYNLSSYLVESKARKRFILWGFL

SEQ ID NO: 828 - protein, 201 aa, Chlamydia trachomatis
KARQGKDLFCGDFFEFMGALAKEHEYIVRDIKSCYRAEVFGEALLARVEALAQGHKVTDAKANSMRTQANLYLSFIRIIVEQLAVLDSLLRSLNYEVEKKDNNYDKDKYKITGPTDWISTLASLEGYAVNGFDNASLSGGLGPMHTLVQTDQHDYLTQSQTQQLNLQNQMTNIQQEWTLVSTSMQVLNGILSHLAAEIYSN

SEQ ID NO: 829 - protein, 300 aa, Chlamydia trachomatis
  VARIANT (1)...(300): Xaa = Any Amino Acid
FFLEVSTMAATVPIASPVGRLLSSATATTLRGNATSLRSKLSSVNDLFDLISSSCTLARVTPRTTVSXTQQQQLSTIETTLGSAKSASNAVQAXCGIVQLLTGGLFFKTNPDGSFHLDLVSQQRTLLSPLSLVSKVTRLASKVLGTVKFMGSQTFPVYQLGAHATGIGLSASAFGTVSPPSMSQKTQEKFSGTSNRINLQKEHLKKTASWHVLKELVQVCSTCFAASWTCWLRLSVSSAMQFLQHLWECTPLLLWVSSASYLLWEMLFFLSLFKVCKHHILEARRYISASXFLIRINFRC

SEQ ID NO: 830 - protein, 161 aa, Chlamydia trachomatis
WIFPPRSCFATKNPPVSTITCQQSNSFSQQSSRNREIHGLPNFPCLPVGCTRNWYWLICFCVWNCQSAFDVAENSREVLGNLKQNKPTEGTSKENGFMARLKRARASMFNLLCSILDLLAQAFCFISDAVSTAFMGVHTAFIVGIFCFLSALGNVILSIAF

SEQ ID NO: 831 - protein, 102 aa, Chlamydia trachomatis
LGEIMAPRKPSKKVGPQKRPSAEKRVITSKKKQLRNQSFKSKVRTILKKFELAVQSGDVESISAGLRSVYSIADKAVKRGIFKKGKADRVKSRASERACPAA

SEQ ID NO: 832 - protein, 447 aa, Chlamydia trachomatis
SIPKFAICRDIVWGCTAGMQYVMGRTNSMTRGFLNKRRVLEKCRTAKQKIHYCISRYFHYLPPVLAILLPIGSWPFLSEQQWWCGSFLFPVVSSLGWLFAIGRRERQLRAAAGQLLEAKIRKLTEQDEGLKNIRETIEKRQKETDRLKLHNDKLVEQLGQAREVFIQAKGRYDHMEELSRRLKEENQQLQMQLEAAVRERNEKILENQELLQELKETLAYQQELHDEYQATFVEQHSMLDKRQAYIGNLEAKVQDLMCELRNLLQLEMGAKTNLPGKPVASRDVVAQLVLEFRKIVFRVETTEAADSLTALRYTRTDPSAHNYSLACRQLFDGLREENLGMLFIYAPFAQRSFLPMLCLTDWTGYGLEDFLNRESDVVLEGFAQWERDLLTESRVERSGKIVIKTKAFGATPFYYCVVTLDKGPFAQHILGVLYPAKASFFTNLSYI

SEQ ID NO: 833 - protein, 573 aa, Chlamydia trachomatis
MRMDTLDSQAAEAAQEEEIQRKLEELVTLAKDQGFITYEEINEILPPSFDTPEQIDQVLIFLAGMDVQVLNQADVERQKERKKEAKELEGLAKRSEGTPDDPVRMYLKEMGTVPLLTREEEVEISKRIEKAQVQIERIILRFRYSTKEAVSIAQYLINGKERFDKIVSEKEVEDKTHFLNLLPKLISLLKEEDAYLEERLLALKDPALSKPDQARLNDELEKCRIRTQAYLRCFHCRHNVTEDFGEVVFKAYDSFLQLEQQINDLKARAERNKFAAAKLAAARRKLHKREVAAGRTLEEFKKDVARGMLQRWMDKSQEAKKEMVESNLRLVISIAKKYTNRGLSFLDLIQEGNMGLMKAVEKFEYRRGYKFSTYATWWIRQAVTRAIADQARTIRIPVHMIETINKVLRGAKKLMMETGKEPTPEELGEELGFTPDRVREIYKIAQHPISLQAEVGDGGESSFGDFLEDTAVESPAEATGYSMLKDKMKEVLKTLTDRERFVLIHRFGLLDGRPKTLEEVGSAFNVTRERIRQIEAKALRKMRHPIRSKQLRAFLDLLEEEKIGSGKIKSYKN

SEQ ID NO: 834 - protein, 130 aa, Chlamydia trachomatis
SCCLQGVLLYRLDIADFRVWVSIGVSEQERHYPQPVLVSLSLFFKEEPKAWSTDKVSDSVCYAELVSLIEEVATNNPCALIERLAKVLLEKIEKALAGQVSRIDLRVSKERPPIPDLLSPVSFSISREVP

SEQ ID NO: 835 - protein, 233 aa, Chlamydia trachomatis
RGAMTSWNFVCLSLGSNLGNRHEHIRRAYASLKKAGIRNLKSSVILETKALLLEGAPKEWDLPYFNSVVIGETQLSPDELIEEIKMIESRFGQDASLKWGPRPIDIDVLFYGDEAFSYHSDKCTIPHPKVLERPFILSMMASLCPYRRFRLEGSSCNGKTFAELAAIYPLTEEDALGSFGSATQIMGIVNITDNSISDTGLFLEASRAAAHAERLFAEGASIIDLGAQQPILV

SEQ ID NO: 836 - protein, 229 aa, Chlamydia trachomatis
FRGATTNPRVKDLGSVEQEWERLEPVLRLLAEGWGAAQQCPDVSIDTFRPEIIRRAVEVFPIRWINDVSGGSLEMAHLAKEFGLRLLINHSCSLPPRPDCVLSYEESPIEQMLRWGESQLEQFAQVGLDTSWQVVFDPGIGFGKTPVQSMLLMDGVKQFKRVLECPVLIGHSRKSCLSMLGRFNSDDRDWETIGCSVSLHDRGVDYLRVHQVEGNRRALAAAAWAGMFV

SEQ ID NO: 837 - protein, 165 aa, Chlamydia trachomatis
LGWYVCMIQATGIVAIDPRGVMGALGKLPWSYPEDLRFFAETIRNHPIIMGRKTWESLPDKYKHGRDIVVFSRRMHPPQCIGVSSFAEYGTLSLNHPFLIGGAELFESFFQQNLLKACFVTHIKKKYWGDTFFPITRLSGWKKECICNTEDFSIYYYENNSDQNT

SEQ ID NO: 838 - protein, 198 aa, Chlamydia trachomatis
SAVADARMCKAELIKKEADAYLFCEKSGIYLTKKEGILIPSAGIDESNTDQPFVLYPKDILGSCNRIGEWLRNYFRVKELGVIITDSHTTPMRRGVLGIGLCWYGFSPLHNYIGSLDCFGRPLQMTQSNLVDALAVAAVVCMGEGNEQTPLAVIEQAPNMVYHSYPTSREEYCSLRIDETEDLYGPFLQAVTWSQEKK

SEQ ID NO: 839 - protein, 250 aa, Chlamydia trachomatis
  VARIANT (1)...(250): Xaa = Any Amino Acid
NRGLIRTFFASGYVESRKEMMEVFMNFLDQLDLIIQNKHMLEHTFYVKWSKGELTKEQLQAYAKDYYLHIXAFPKYLDAIHSRCDDLEARKLLLDNLMDEENGYPNHIDLWKQFVFALGVTPEELEAHEPSEAAKAKVATFMRWCTGDSLAAGVAALYSYESQIPRIAREKIRGLTEYFGFSNPEDYAYFTEHEEADGRHAREEKALIEMLLKDDADKVLEASQEVTQSLYGFLDSFLDPRTCCSCHQSY

SEQ ID NO: 840 - protein, 437 aa, Chlamydia trachomatis
PMLHQHQTASVALCPALHLQQGLDMLQMPVAELATFVSQQITINPCFDLDSLDSPPESFSFFPISEQHPFTETLSAYLLRQIDTNFASSQERTIAQYIVGNLSPEGLFLENPSLVAADLNVSEHLFHKVWQRIQQLHPLGVGAPSLQSYWVSLLQTSPHKEALAIIRNHFPRLARCDFTTIARKMHATTTEILTFLRHAFASIPWCPAAGFSETLHPPAPALPDAYLSFSRNSSWDVSINKDCLPSIRLNDTVLDIYPSLPREEKDHLSQQIRAAKQLLRNVKKREETLLAILRVLIPYQEEFLLKKRTSPKAFSVKQIARELSLHEATVCRAIDNKTLATPVGLLPMRSLFPQAVGSCPDQSKATILHWIHQWISTEKHPLSDAAISQKIIEKGIPCARRTVAKYRSQLNIPPAHQRKHLCSVLTTTRTENSRHTI

SEQ ID NO: 841 - protein, 512 aa, Chlamydia trachomatis
  VARIANT (1)...(512): Xaa = Any Amino Acid
AXLRKLNLDKKLCNAMQFTISQAKNRLQSPEDLDSKEYPDPTRTVYAEYQEQLRAANALDFDDLLFLTEKLLRIPEVQQEYANHWKALLIDEYQDTNHAQYLIAKRLAAAHNNIFVVGDPDQSIYSWRGANISNILNFEQDYSQALVVRLEENYRSCGTILEAANALIQNNSARLEKTLRSVKGPGDKIFCFTGKNDRDEAEQVLEEISNLHSYKDIPLSDICILYRTNFQSQSFEAALLKRGYPYEIIGGISFYKRREIQDILAFLRLFSNNYDMAAFERTISLKKCGIGATTLAALMNYAKITDLPILQACWDVLEKKSIRLTKKQQQGLFSYLTHFHQMEQLYGNCDLHEFINETIRITDYLSILKEDPETYEDRKNNLEQLLAETQIWGKSSENLPGFLEDLALKSSADETASSHDRLKLMTIHNSKGLEFPVVFLVGLEENLLPHANSKGMHENIEEERRLCYVGITRAQEYLYLSRAKTRFLWGTERTMVPSRFISELPRALLKFV

SEQ ID NO: 842 - protein, 148 aa, Chlamydia trachomatis
  VARIANT (1)...(148): Xaa = Any Amino Acid
MHRVYAFSKIFFEPENIYYIHMLTSELNAAQVTAVTAPLQPVLVLAGAGAGKTRVVTHRILHLIEESRLDPKQILAITFTNKAANELKERIQSQCRELGYSDVPMVSTFHSLSVYILRRSIHLLDRQSNFVIYDQSDSXKLIKQXYAS

SEQ ID NO: 843 - protein, 229 aa, Chlamydia trachomatis
MHEAFTIEQLPPSWQEQLKDEWSQPYWSQLLAFLKSEYAQAKIYPKKENIFAALRSTPFDQVRVVILGQDPYHGEGQAHGLSFSVPRGQALPPSLRNIFQELHTDLGIRNESGCLQAWADQGVLLLNTVLTVRAGEAFSHAGRGWERFTDAIVTKLIQNRTHVIFVLWGNAARQKCNLLFQTKHQHAVLACPHPSPLAAHRGFFGCCHFSKINYLLKKQGKTMINWKIE

SEQ ID NO: 844 - protein, 79 aa, Chlamydia trachomatis
LEDRMIDGIQTCSFSPTHRLTAKSAVSIEMPLATQNLQEGALVNAKLEADFARAEQILTEMQEIRSSLERSLETLFPRE

SEQ ID NO: 845 - protein, 211 aa, Chlamydia trachomatis
MKILIASSHGYKVRETKAFLKKLGEFDIFSLVASPYPSYQPPKETGETPEENAIQKGLFAAQTFRCWTIADDSMLIIPALGGLPGKLSASFAGEQANDKDHRKKLLENMRLLENTIDRSAYFECCVALISPFGKIFKAHASCEGTIAFEERGSSGFGYDPLFVKHDYKQTYAELPEAIKNQVSHRAKALVKLQPYVETVLANHLLAGKESL

SEQ ID NO: 846 - protein, 423 aa, Chlamydia trachomatis
RKIRFPLSKRDPKEIMKTICKLVILALLFPNVSYALVQVGLERLFQEEKYLEKIRGKRVALISHSAAINRQGEHSLCVFNKHKGVCKLSALCTLEHGYFGASIAETPGYDPILEDIPVISLFASKEIPAEVIEACDVFVYDVQDIGVRSYSFISALLQVVKASASSKKELIVLDRPNPMGGNLVDGPLPDKEAFPAIPYCYGMTPGELALLYRARYAPKASVTVVPMRGWKRSMIFADTGLIWVPTSPQIPDAQSAYFYATTGIIGALSVTNIGIGYTLPFKVLGAPWMDGCKVAQELNKARLPGVHFLPFMYEPFFGKFKMEMCSGVLVVLQDPKQFLPMETQSVILGVLKTLYPKEVEQAFLLLDRLVPRRKAIQNLLGHSEFLNVCLHKKYITWPLRTMCAEGRKQFIEQRQPFLLPEYA

SEQ ID NO: 847 - protein, 535 aa, Chlamydia trachomatis
GLSNSFRDQEQGLQAVLRAARVISHMFSQTIGPYGFSTIVHNVQDTRTTQDSQSMLKDILFPDVFENIGMKLIRDTALGTRMRFGDGAKTTALLIEALLAEGMTGIQKGLDPHEIHRGMLLAEKKIQEVFYRETFPLSDLEHTVYVSSIARRFNSEIASVLSSAVGYGGKNGYYIVEEHEESETYWHAEEHAVWDFGYASPYFITHAETGTVEYSQVYILVSEHPLHYSNPSFLTFLQSVVQAGKTPLVIVAEAFDKELLAMLEMNQIERVFPVCAVKVSGKHARESLEDIAVLTGATLLPEMDFEDSEEERIANRLGFVALAGICVSSTSLCVPRETDNKQRVAEHCAFLQDKLSFHRKKSSARLRRRLARLSTGEVCIHIAADCIPQEEIGYITSSIRAMTESLRSGCLPGGGCAFIRAAREISVPLALSPSERFGFLAVLSAAEKPFRAIVTRSGRVEEEVFSEVFSQADWRVGFNGVSGFVEDIVSQGICDGASCIQHALSHAVGTTGLLLTSALFIASQEPMLREENSEE

SEQ ID NO: 848 - protein, 210 aa, Chlamydia trachomatis
VQILSGALFLSRRSTMGSLVGRQAPDFSGKAVVCGEEKEISLADFRGKYVVLFFYPKDFTYVCPTELHAFQDRLVDFEEHGAVVLGCSVDDIETHSRWLTVARDAGGIEGTEYPLLADPSFKISEAFGVLNPEGSLALRATFLIDKHGVIRHAVINDLPLGRSIDEELRILDSLIFFENHGMVCPANWRSGERGMVPSEEGLKEYFQTMD

SEQ ID NO: 849 - protein, 134 aa, Chlamydia trachomatis
LACGMKFTVAVFGEAEEGSFESAYLCSSLTDLHNNLGHGRDSPSGISLAVQAIMQGYDILFFRVKEEGFFIDSYFFGLHFLNTQTSLTNIVALALPGVGDFNIIEASLALCRKLKSLLLFSDQDLYDFLTFKDA

SEQ ID NO: 850 - protein, 177 aa, Chlamydia trachomatis
SAVFAGYSSRSRRTSSRLHAHHNELAMISERLDEQDTKLQQLSSTQDHNLPRQVQRLETDQKALAKTLAILSQSVQDIRSSVQNKLQEIQQEQKKLAQNLRALRNSLQALVDGSSPENYIDFLAGETPEHIHIVKQGETLSKIASKYNIPVVELKKLNKLNSDTIFTDQRIRLPKKK

SEQ ID NO: 851 - protein, 214 aa, Chlamydia trachomatis
ENCYRIWRETFPMLGSISFTTYKENLMRKTIFKAFNLLFSLLFLSSCSYPCRDWECHGCDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGIAADRLFTISYGKEHPVHPGHNELAWQQNRRTEFKIHAR

SEQ ID NO: 852 - protein, 145 aa, Chlamydia trachomatis
PDGTRLVFVSNKDGTPRIYQMQISPEQHSPRLLTKKYRNSSCPTWSPDGKKIAFCSVIKGVRQICVYDLASGRDEQLTTSTEHKESPSWAADSNHLVYSAGSSNTSELFLLSLITKKSRKIVIGSGEKRFPCWGAFPSQHIKKTS

SEQ ID NO: 853 - protein, 267 aa, Chlamydia trachomatis
TAGKFCLMKGSVVFLRSLLCLLCLLPSTLHCEDLEIHVRSESSLLPIAVSLLSSPKDSRQASYLASLRDLFARDLALGDLLAPTKELAPQTIFIEASYPELIFSLKKEGKGSQKIFSLELSGDPSKDHQAIHEAADRIHFLLTRVPGISSGKIIFSLCATNSSTELKQGELWSVDYDGQHLYPLTNEHSLSVTPTWMHISHIPAYMYVSYKLGVPKIFLNTLNQPAGKKSLLCKGISLCRLSLLKLNSSPLFLIETAILIFLYNHSH

SEQ ID NO: 854 - protein, 264 aa, Chlamydia trachomatis
YSFQTVSRDQIDYRRSRISGTSYCFEELTMPKFQYAPFLCASIIIHIALGGMLFFSAPQKKKPRLSPFKERIVALPPEPKITTTLQTPSPQPIRKPVKNAPAPEKKAAKPPAISNPQKSPQKPNKASPTPRNETLEKKQATLKKLAQLANQLAEEAETQESHIAQFSWPAQAQVLTENTSYQQDAFCALFQQYVSLPFPGEVRLKLEFSREGALLHCSILSTISHADKQHILNQIQKIPFQSFFSAYKTSKNIVFHIRLQGNSA

SEQ ID NO: 855 - protein, 138 aa, Chlamydia trachomatis
LMKRFVYEDLEEDPSVASNLTPLIDIVFVILMAFMIAMPLIKIDRISLATGSSSHQAFKKQESQQAEIKVFRNHTITLNDLPVSLQELRSQLTVIHAQHPNIVPLLLQDGDTAFKLYQEIKSTIEEAGFQELHIALKN

SEQ ID NO: 856 - protein, 236 aa, Chlamydia trachomatis
VYVLMFQLVNNPIIQSFQEADLFGKVIFFSLFALSICTWTVLHQKLSIQKKFLKSGKSLKEFLIKNRHSPLSLDIHPESTPFTDLYFTIKRGTLELLDKNRQLAPERTPLLSVEDIQSLETLFNAVMPKYRALLNKNNFIPATTISLAPFLGLLGTVWGILLAFAHISTGQANGTIMMEGLATALGTTIVGLFVAIPSLVGFNYLRAHAFQVSLEIEQTAFLLLNSIEVKYRQTSL

SEQ ID NO: 857 - protein, 221 aa, Chlamydia trachomatis
TGESVVFMIRQWYGFFLCLLFSYTSCFGVEENSGRATPTVELVSESEQAVEGEVLRIGVLIAIPEGEHIYWKNPGKLGMPLRISWDLPSGCRLLEEHWPTPEIFEEDGVVYFGYKHSTMVVADIRVSKEIETRPLEIKAQVEWLSCGASCLPGSSSRVLVIPIDQGPLIPNSKETFTFSRALAAQPRPLDAAIKISYQPDGLDVLVPAGESGSGNPGMVHC

SEQ ID NO: 858 - protein, 499 aa, Chlamydia trachomatis
  VARIANT (1)...(499): Xaa = Any Amino Acid
MFLCQQGKADRATQAWFIAENTRDFAYAQEVPLEQATTYIWKLKHPEGNMPKGVGLSRILIFKDDAGKVVASYQVEXNQVEQLSALSWGFLSILLMAFIGGILLNIMPCVLPLITLKVFSLIKSAADHHSSSVIGGIWFTLGAIVSFWGLAFCAFLLKVLGQNIGWGFQLQEPMFVALAVLIIVFFLFALSSLGVFEMGMICLSLGEKLQEEGGASVRKNQIWGAFFNGMLTTLVTTPCTGPFLGSVFGLVMAVSFVKQLAIFTAIGLGMASPYLLFASFPKMLAILPKPGPWMSTFKQLTGFMLLATATWLIWIFGVETSATAVTILLVGLWLAAVGAWILGRWGTLVSPRNQRLLASVVFIFCILSSLVITSIGVRYFDENVPPAHSFDWQSFSPEKLADLREKGIPVFVNFTAKWCLTCQLNKPLLHANMQAFAAKGVVTLEADWTKKDPKITEELARLGRASVPSYVYYPAGNKAPLILPERLSQSALEEMVFSQ

SEQ ID NO: 859 - protein, 274 aa, Chlamydia trachomatis
LRKIDYEGSMEIVDAHVHLSSEEFIEDFGDVVLRGKTAGVTRVVNVTTTKAELLRSFAYAEAYPDWMFYHVAGTPPQDAQDDIEEDFQEFCRAAEDGKLAAIGEVGLDYLFAVQASEQERQKEVLCRYLQLALQHELPLVVHCRGAFEDFFHILDHVYRVASPQRAKPGMLHCFTGTYEEATELLARDWYISISGIVTFKNAKSLQDLVEKIPLERLLVETDAPYLAPTPLRGKRNEPANIVHTLARIAEIKGISVYELQDAVSTNVQRWLRGS

SEQ ID NO: 860 - protein, 214 aa, Chlamydia trachomatis
LFRLVFIPSSDLAIFFEGERIFSLQMEEHLRYGRNLAYTLQRMTAWILLAGLAFHVIQFRFVLYPIQVTIQGKTFYAVSFDAARYPSVVQGTTGFFIMNVPFAEGGPQITEQFLQEKDRALFASHKSYIFTPEARKAFLYAVRNALGSLWMAIFYTLFVIAAVFHGFNGVWTFVSRWGIIISSRYLRLCQILCYVGMCVVMAMGISVIWNMYLL

SEQ ID NO: 861 - protein, 423 aa, Chlamydia trachomatis
WSMDVCLAMGNHYLFPLSPIMSDLMLRRDVCCDGYGYQRNLEYVFVMMNQRCRVIIIGGGLAGLSAAMQLADRGILVELFSLTKVKRSHSVCAQGGINAALNLKGENDSPYIHAYDTIKGGDFLADQPPVLEMCLTASRIIHMLDRFGCPFNRDADGNLDVRRFGGTLYHRTVFCGASTGQQLMYTMDEQVRRREWQGKIIKRENHEFVRLITNTEGRACGVVVMNLFNHRLEVIQGDAVIIATGGLGVIFQMSTNSTICTGAANGRLFMQGMHYANPEFIQIHPTAIPGLDKLRLISESVRGEGGRVWVPRCSSKTIIFPDGSRRPCGETGKPWYFLEEMYPAYGNLVSRDVGARAILQVCEAGLGIDGRHEVFLDVTHLPVETLNKLEAVLDIYHKFTGEDPKKVPMRIFLRCTILWEAPG

SEQ ID NO: 862 - protein, 269 aa, Chlamydia trachomatis
KSPYAHFSAVHYSMGGAWVDWPASDDRDRDSRYRHMTNIPGCFNCGESDFQYHGANRLGANSLLACLYAGLVAGDEAARFVESFGSCIYSQQDLNQALQQEQEISREILSRQGGENAFALHEEIARVMVSNVTVKRENKALEETLHKLKEFRERIKKVSVHDSSRFANKTFHFVRQMEPMLELALAITTGALLRNEFRGSHYKPEFSKRDDVNWLKTTIATYSVASPEPEISYKKVDTRHVNPELRDYTRQGAKDVVLENIPANIHFPI

SEQ ID NO: 863 - protein, 182 aa, Chlamydia trachomatis
YWESFELELHPGENVISALMEIEKNPVNIHGERVDPVVWEQACLEEVCGSCAVLVNGIPRQACTALIHEHMDAKREIKLAPLSKFPLVRDLIVDRSVMFKNLEEIQGWISAEKCGEGAGPKISQEEQTLMYSLSMCMTCGCCTEACPQVNEKSDFMGPAAIGKRVILTLILERNVERVGYEH

SEQ ID NO: 864 - protein, 155 aa, Chlamydia trachomatis
LANFLAIARFFFAKATLLYVVKSCRFSPHKTSSSKEAFSLLAKESNTETSKRDMTKKGVFSLPLPWNKIAMQSSKLKSPHLQKTLCYSSVFFLNNEENNARKEKRETSHPIAEMLSVKGNFLGHTRTQLWACPDPSIPRVPINARNRLSRRFSPG

SEQ ID NO: 865 - protein, 986 aa, Chlamydia trachomatis
  VARIANT (1)...(986): Xaa = Any Amino Acid
QRVFWRWGLLSFEDCIAILFHGKGREKTPFFVMSRLDVSVFDSLANKEKASLLEEVLCGENLQDFTTYSKVALAKKNLAIARKLASYILNEEGDLELSRVVESIQLLTKCLYPLGPYRQGEGPIREHVLKMLEFLRDDQEIKNRFRRFFVPSYARVQDLIRNTLALPASETVTVRHVREAALVALFTYLRQDVGSCFATALAILIHREYPLLFIRDLEDLLSSGKISRIVGDREISVPINLLPCVGDLFKPICVMDLYPNPVATLAASSDLQAAFVASGIFPTTGDIAGEVQTLLANEFIYQKVQDIHGKITAHDVIQDSLLHHYQLSLSTVQASVLQEGFRKERGDGTVLLSTNSQRVLSYLESYEQAKLGFIRDTQNVLLKSWEYTLATLADASQTTTTKHLQIALGWTSDDEDGLREIIRRFLAEEVATTQAFAGQCEETYQEAKAQLEYVESRMRNPINKQDSQILAMDHVRFRQELNQALQDWNAAQEKLKKMIMLPDFLLSFYSREIPNYFRSVYDAFIREFSGNYQDVPAGFRILFTYGRSHPNTWEPIYSIEEFIHALTEFFTSIEGDLLAKHNVSGLEKETSILLHRIVSALHEPRFQEAAMERILKAYNCPIPQGIFQHLDQVTHTPWVYVSGGTVTTLVGDYFENSKPLVKLEKLPADPHELAAFFADALKDLPEAVKDYVENGDHSLLAAAPSHVFSVTAGAPLFRDAWTNDWYSYTWLRDVWLSKHQDFLKRTLFDKSAIYAFITRFCTRYYLQELTQDLLYFCDDLSLSIPEFYEKSSRFFQSTVHDEKVVATLQKYLASQFVHEAPYVSEQQLPQIISDLSSYLGISSRISYDQLATLLEENVGKHSLLSSSDLRHLYKGLLMAGYQRVYHEEDLSMRLIAAMRHYGLAYPAPLLFGDTNWAYRYFGFIXHPGTQEMDLWEFNYLGLVGRPSENKERWFAVRDPWALYPESHRLRNGPSTRLSKWIAERFF

SEQ ID NO: 866 - protein, 112 aa, Chlamydia trachomatis
INSLASSVCTSPAISPVVGNMPEATNAACKSDEAARVATGLGYKSITQIGLNKSPTHGRRLIGTEISRSPTIRDIFPEDNKSSKSRINNNGYSRWIRIANAVAKQDPTSCRK

SEQ ID NO: 867 - protein, 609 aa, Chlamydia trachomatis
NICFRCGMRQTFTKRILLFLFLVIPAPLLLNLVVLSFFSFAAVKTTIIQDLHTRTMNFNLELEKKIAIQNIFLKRLAETLALKTLTTSHDFFTEAYSEMIALGDTDLSLCLLSSANDSIRTKNPRDPFVRYIKAHPEIRDKLIQNPGNASLISISERPDTEDHYLVFAEPLPIYEDPSLAGWVIAFYSMQKLRNYLFHNKQSYQDLLCYLNHKGELLFSDSSPFQNGAFSLSMEGYPALSSEKASYPLEPSPELFKAKELLKVSNTRENFLSLFISLAAYTTYPFSCADPSIHLHYTSLRLPINVILFYILAFSLMGWVLSCTSKRLNRPLQELSVSMESAWKGNHNVRYEPQPYGYEINELGNIFNCTLLLLLNVKEKAEIEYISGNLLQKELALLSSLKDTLLCQRSNSLPGGTFSLHYLQGEQQTGYFYGWVATPEKDRLFGVIGIAGDIGLPSYLYALSARSLFLTYASLGYSLPSICHKTMRSFDETTVGNEASVSIACLEYDLSSKSLSVLTEGANPPTLFIKRQEHLLTMSEQQRIETGDILVCLTGGPHIIQYLKTLPIEALLKDPLAPLNSKNFAEMLTTMLRSKNQTQIDGAVGFLSFI

SEQ ID NO: 868 - protein, 658 aa, Chlamydia trachomatis
APLGKKREMTIPIHENKYSMISFTRTIGFRLWLICVAAIMFPLGINILQLNLQQYKKTLSSITSDLRENALFKAHTLQQTIPLNIDILALFSEIFDLDRGVPAEPDLALSKEMEKIFHSTYKEISLVKKEADGNFRVVASSRIEQLGKNYNQEIFLSDSQPFLATLRHSGSDSQVLAVLQTNIFDISSQEVLGVLYTLSDTNYLLNGLLAAKDPLSVKTAILSKNGIILQATDSSLDLVSIHKTVSKEQFCDVFLRDDICPPHLLLRPPLNLDPLPYGENFVSFCIGNTEMWGYIHSLPEMDFRILTYEEKSIIFASLWRRTLLYFAYFCCVLLGSITAFLVAKRLSKPIRKLATAMMETRRNQHHPYEPDSLGFEINHLGEIFNSMVQSLSQQQSLAEKNFEIKQHAQNALRLGEEAQQRLLPNQLPDSATTEIAKAYIPAVTVGGDFFDIFVIGEGPQAKLFLIVADASGKGVNACAYSLFLKNMLHTFLSELSSIQEAVQQTAALFYQQTAESGMFVTLCIYCYHYATRELEYYSCGHNPACLRAPNGDISFLSHPGMALGFLPEVPPHPAYTLVLEEESLLVLYTDGVTEASNKHGEMFGEERLKALVASLTKQSAEEAIQSIMFSIKSFVKDCPQHDDITLLVLKIPKEPSAY

SEQ ID NO: 869 - protein, 472 aa, Chlamydia trachomatis
IPRYDPFLLRESPSEPSLCIAVIHAHRRKLDKTSELLSLTVLDKDLVMFDVVISDIEAREILDSRGYPTLCVKVITNTGTFGEACVPSGASTGIKEALELRDKDPKRYQGKGVLQAISNVEKVLVPALQGFSVFDQITADAIMIDADGTPNKEKLGANAILGVSLAFSKSCLQILYRDLLYRYLGGSFSHVLPCPMMNLINGGMHATNGLQFQEFMIRPISAPSLKEAVRMGAEVFNALKKILQNRQLATGVGDEGGFAPNLASNAEALDLLLTAIETAGFTPREDISLALDCAASSFYNTQDKTYDGKSYADQVGILAELCEHYPIDSIEDGLAEEDFEGWKLLSETLGDRVQLVGDDLFVTNSALIAEGIAQGLANAVLIKPNQIGTLTETAEAIRLATIQGYATILSHRSGETEDTTIADLAVAFNTGQIKTGSLSRSERIAKYNRLMAIEEEMGPEALFQDSNPFSKA

SEQ ID NO: 870 - protein, 678 aa, Chlamydia trachomatis
KILTTIHCVGGGVLKQQFVLHAPFLPCGDQPEAIRRLSQGITDGVPAQVLLGTTGSGKTFTMANVIANVNVPTLVLAHNKTLAAQLYQEFKAFFPENAVEYFISYYDYYQPEAYIARSDTYIEKSLLINDEIDKLRLSATRSILERRDTLIVSSISCIYGIGSPDNYSSMALTLEVGKEYPRSQLSSQLVRMHYQASSTPQRSAFRERGSVIDIFLAYESDLAVARGLEFMNDTLISIEYVDPLTMIPSHTTSSITLYPGSHYVTPEAVREQAIRTIREELEQRMLFFEGRPVEQERLFQRTTHDIEMIKEIGFCKGIENYSRHFTGAAPGEPPTCLLDYFPDDFLLIIDESHQTLPQLRAMYRGDQSRKQSLVEYGFRLPSAFDNRPLTYEEARRYFHRVIYVSATPGDLEIQESRGHIIEQIIRPTGIPDLLPEIRPAKGQIDDLLEEIRQRLRKDQEKILVISVTKKLAEDIAAFLAELGIAAAYLHSGIETAERTQILTDLRLGNIDVLIGVNLLREGIDLPEVSLVAILDADKEGFLRSSASLIQFCGRAARNIHGKVICYADRITPSMDHMLKETERRRKIQLDYNQQHKITPQPIIKPFLANPITKEAGQEETRLKMQSSKELEASIKTYEEAMYQAAQEFQFDEAAKYRDLMNAAKKQLLFQKGEEENGD

SEQ ID NO: 871 - protein, 379 aa, Chlamydia trachomatis
GLIFRKNPEMSCIDKLRIKEKARSEVFSPRESTMKKKRVLTGDRPTGKLHLGHWIGSIMNRLQLQNDSRYDCFFIIADLHTLTTKTRKEEVLQIDNHIYDVLADWLSVGINPEKSAIYLQSAIPEIYELNLIFSMLTPLNHIMGIPSIKEMASNASLNEESLSHGLIGYPVLQSADILLAKAHLVPVGKDNEAHVELTRDIAKTFNRLYGEVFPEPDILQGELTALVGTNGQGKMSKSANNAIYLSDDAKTVQEKIRKLYTDPNRIHATTPGRVEGNPLFIYHDLFNPHKEEVEEFKTRYRQGCIKDVEVKARLAEEINLFLNPFREKRSELVAQPKFLEEALQQGTEKMRTVARETMEEVHDHLGLSRKWRTILASSK

SEQ ID NO: 872 - protein, 202 aa, Chlamydia trachomatis
LKSYKKLQLTFFLTLRYPVMTTKPKTLEIDNNTFLLLEGNLKRIFATPIGYTTFREFQNVVFNCAQGQQELANFLFEMLINGKLLQELPAGQKQSAQSLIVQFMMPIRVAKDIHERGEFINFITSDMLAQQERCVFLNRLSRVDGQEFLLMTDVQNTCHLIRHLLSRLLEAQKNPIGEKNLQEIQEDLDSLRAHFEELTKSV

SEQ ID NO: 873 - protein, 268 aa, Chlamydia trachomatis
  VARIANT (1)...(268): Xaa = Any Amino Acid
VTCNVMGNIKTLLEIRFKKPTPXKMESLXKKRLEGELSPXXNGFTTPKLCSQEEARFRQLLEEYSFSKEISHNDLQQLCHLSAQVKQIHHQAVLLHGERIKKVRELLKTYREGAFSAWLLLTYGNRQTPYNFLVYYELFSALPDTLKLELERLPRQAVYTLASREGSQEKKEEIIRNYQGETRGELLEIIRREFPLLPTDRRQSSLAQQAFSFFAKGTKLLQRCTDISQEELLSLEKLIKKLQKVTTNLLSNTKVSRNDDETQNSRNR

SEQ ID NO: 874 - protein, 317 aa, Chlamydia trachomatis
TFLPEDTVPNNIEKRYLESFLTLFISFNLIRPCLWTNQYKGIKATKKERGFLPLQGLHLVINMKTIAVNSFKGGTAKTSTTLHLGAALAQYHKARVLLIDFDAQANLTAGLGLDPDCYDSLAVVLQGEKNIEEVIRPIDSSGLDLIPADTWLERVEVSGSLAADRYSHERLKIILSKIEHRYDYVIIDTPPSLCWLTESALIAAQHALICATPEFYSVKGLERLATFIQGISSRHPLNILGVTLSFWNYRGKNNAAFTELIQKTFPGKLLNTRIRRDITISEAAIHGKPVFSTAPSARASEDYLKLTEELLFLLSDM

SEQ ID NO: 875 - protein, 663 aa, Chlamydia trachomatis
NATMANTPRKKRRFFAAVCSKFFIYGEGMIHVTCNQEAFELPEGASAMDLANKMKQSHCFVGALINDQEKDLSTTLQDGDTVLFLTWDDPKGREIFLHTSAHILAQAVLRLWPSAQPTIGPVIDQGFYYDFANLSISEEDFPAIEAMAKTIAEEKFPISRQVFPDKEAALAYFSQNPFKAELIAELPEEVEISAYTQGEFLDLCRGPHLPSTAPVKAFKLLRTSSAYWKGDPSRESLIRIYGVSFPTTKELKEHLHQLEEAKKRDHRVLGTKLDLFSQQTCSAGMPFFHPRGMVVWNALVDYWKRLHQRAGYQQIQTPQLMNRELWEISGHWENYKENMYTLTVDEEDYAIKPMNCPGCMLYYKTQLHSYREFPLRIAEIGHVHRHELSGALSGLMRVRTFHQDDAHVFLTPEQVEEETLNILNLVSELYGTFGLEYHLELSTRPEQGTIGSDDLWELATEALKRALVKSQKPFIISPGEGAFYGPKIDIHVKDAINRTWQCGTIQLDMFLPERFDLKYTNAQGEKSTPIMLHRALFGSIERFLGILIEHFKGRFPLWLSPEHVRIITVADRHEARAQELAKHFSQMGIIVSVDSSNESVSKKIRNAQNMQVNYMITIGDKELETHLLAVRTRDNRVLNDIAVEQFSHVILEELRSLSLTPSL

SEQ ID NO: 876 - protein, 120 aa, Chlamydia trachomatis
KPITESNTIGMIAGRGRRRDSRLHNSSPKRTTPANTIRLPVTNKGAAASIADLLKANEEDQMKAFRKIKKIAMSQQGLNTQVRRVQANNNALTATMNRVARIYDPFYRTTKLVASCALKK

SEQ ID NO: 877 - protein, 333 aa, Chlamydia trachomatis
IRATRFMVAVKALLFACTLRTCVFKPCCDMAIFLIFLNAFIWSSSFALSKSAMEAAAPLFVTGSRMVLAGVVLFGLLLCKRESLRLPRPAIMPIVLLSVIGFYLTNVLEFIGLQRLSSSTACFIYGFSPFTAAFCSYVQLREVVTWKKLGGLSLGLVSYLVYLLFGGSEDVAEWGWQLGLPELLLIAATCLSSYGWTLLRKLGRRCESLSMTAINAYAMVIAGVLSLIHSAVTEVWNPVPVENPLLFLQAIGALVIFSNLICYNLFAKLLRSFSSTFLSFCNLVMPLFASFFGWLLLGESFPPGLLFAVGFMVLGCRLIYHEEFRQGYVLTSE

SEQ ID NO: 878 - protein, 292 aa, Chlamydia trachomatis
PTRAASAKSWSSSFQQQNQAIQNQVAMAPEIGNAIRTQAGHQAKATELQAQQSLISGITNIVGFAVSVGGGILSASKSLGGLKSAAFTNETASAATSATSSLAKTATSALDDVAGTATAVGAKATSGAASAASSAATKLTQNMAESASKTLSQTASKSAGGLFGQALNTPSWSEKVSRGMNVVKTQGTRATKFAGRALSSAMNISQMVHGLTAGIDGIVGGVIGAQVAQEQRMAGMAEARAEELKSLNSVQAQYASQAQQLQEQSQQSFNSALQTLQSISDSALQTTASMFN

SEQ ID NO: 879 - protein, 160 aa, Chlamydia trachomatis
WRSCVMTTGVRGDNAPDPSLLAQLTQNANSASAASTGKNGQVAGAKQENVDASFEDLLQDAQGTGGSKKATANQTSKSRKSEKAQASSGTSTTTSVALAQASQTATAQAVHGARDSGFNSDGSATLPSPTGTEVNGVVLRKGMGTLALMGLIMTYSRSKC

SEQ ID NO: 880 - protein, 483 aa, Chlamydia trachomatis
  VARIANT (1)...(483): Xaa = Any Amino Acid
RGYMSLSSSSSSDSSNLKNVLSQVIASTPQGVPNADKLTDNQVKQVQQTRQNRDDLSMESDVAVALAGTAGKDRAASASQIEGQELIEQQGLAAGKETASADATSLTQSASKGASSQQCIEDTSKSLELSSLSSLSSVDATHLQEIQSIVSSAMGATNELSLTNLETPGLPKPSTTPRQEVMEISLALAKAITALGESTQAALENFQSTQSQSANMNKMSLESQGLKIDKEREEFKKMQEIQQKSGTNSTMDTVNKVMIGVTVAITVISVVSALFTCGLGLIGTAAAGATAATAGATAAATTATSVTTTVATQVTMQAVVQVVKQAIIQAVKRAIVQAIKQGIKQGIKQAIKQAVKASVKTLAKNVGKIFSAGKNAVSKSFPKLSKVINTLGSKWVTLGVGALTAVPQLVSGITSLQLSDMQKELAQIQKEVGALTAQSEMMKAFTLFWQQASKIAAKQTESPSETQQQAAKTGAQIAKXCPQ

SEQ ID NO: 881 - protein, 122 aa, Chlamydia trachomatis
  VARIANT (1)...(122): Xaa = Any Amino Acid
TMSKKHKHKQAHTSSKPKVXPAYVSKKESPALQELQNAMISFSQDLPLAQMFSEIQDEKQLAKMMAALSGMLDSLPVETLTKGVFDNPKEEAQLSQEISSIFLGLKHLTETVASNKHIADEK

SEQ ID NO: 882 - protein, 234 aa, Chlamydia trachomatis
NLILLVVICYFIFLGIIAMSTPSSNNSKKPSASFNKKSRSRLAEIAAQKKAKAEDLEQKYPVPTEEETKQVLMDILQGLSNGLTLQQILGLSDVLLEEIYTVAYTFYSQGKYREAIGLFQILTASKPQCYKYILGLSSCYHQLKMYDEAAFGFFLAFDAQPENPIPPYYIADSLMKLNQPEESQDFLDITIDMCKNKPEYKVLKDRCSIMKQSLDAVLKKEKSAKGSETQASVS

SEQ ID NO: 883 - protein, 444 aa, Chlamydia trachomatis
VSLSPSRIRLLDSVTVASNQISAGEVIENAASVVKELIENSLDAGADEIHIETLGGGRGQIVVRDNGVGMDPEEVPVALQRHATSKIAHFADIFSLASYGFRGEALPSIASISKMEIHTARAGGLGSKTLIEKGEPVCCEPAPRQQGTTIAVHSLFYNVPMRQSFQKSPQMDRLAIRRLLENSVLSSEGIGWTWISERRQELHVAKKQGFIERVALVLGESFVQEAFFIDKQQGDLRVLGFLGSPNQHRSTRQGQRLFINNRAVESSFISKKVAEAYAWMIPAQRYPIFVLKLFLPPMWCDFNVHPQKTEVRLLQEGQISNLLVEAISEALLRRSSSLEEIVLKVPTEKIPIENEGISVPSIRPAIVSAPLSCPTFSQQPYLKTEMATIVSRDSASSSLSVVEKVRFLTSLGKVLLVEDSEGVHVVFVQLRVNICFMFLYYPSV

SEQ ID NO: 884 - protein, 101 aa, Chlamydia trachomatis
LSWKQTFYRCGLEALTALGIELSRISPDSFAIESAPPFIQEEELKEWIVALAQEGALHVGESFEQLVENTVQKLVFSRNARAFDYAWLDILWKLGKPEKSV

SEQ ID NO: 885 - protein, 356 aa, Chlamydia trachomatis
MNQNPIKRLQDSLVERALDAFLIEKDEDISYFLQDQARSGVLLITRDEAVLFVSPLDKDLYARIQDVVLVSYSKSVDQELGSYIENTGLKTIGFDSEYTPYGIAQKRMNSGYAFSPQSLVAEKLRCVKSTEEIQKMTRAAEIGSAGYDFVLAALRPGITEKELVRMLHVFWANLGIEKVSFPPIIAFGENAAFPHAIPTNRSLKKGDVVLIDIGVCYEGYCSDMTRTVAFGAAPEQQLLDGYVAVAEAQRAAIEFCRAGVPCRDVHKEAVRILRAHGMEKAFIHGLGHGVGREVHEYPRLSPFSDATLQLNMAVTVEPGVYFPGVGGIRIEDTIVIGVNENLNLTNRKVSSEIIII

SEQ ID NO: 886 - protein, 427 aa, Chlamydia trachomatis
FFFSNQLLYTILFCFSVVMRQLHFFFYQWIRGAALIGAIAGVCSPLTAEEKQPACSGAWALQDFSIEEELPDLRNQFVFLGCNKRPDARSGKFFLELATTNAIQEVSLGEKVFLRQGPDEETLVFSAEPTPLWLECRPSSDGRSLDVVVRMKGALGGAVSSPKERAHFSLSMAPRCSQTWEIGGMRVEPSIAVKQRIRCVGGDKFLLMHGGADYVIQAAKERVDFESLSGEAYSQYLAVGDVLLWDQDRWVPYKTFQGDGTRVPLLEVKRLDDRMMVIELWSIDGLMSQQITLVKQVSSPIEIAELVKEFSFVGMRTWSRPIITAGKDRLVLSADDWVIHTGERWERVTSKRQLEDYLSGKLRSPLLVFERIDKEDGEFVFKGHVFNTQRTVVETISLPLKQVLETVAQSHLGQESGTKNSRIGGGS

SEQ ID NO: 887 - protein, 88 aa, Chlamydia trachomatis
VKNILGYGFLGTFCLGSLTVPSFSITITEKLASLEGKTESLAPFSHISSFNAELKEANDVLKSLYEEALSLRSRGETSQAVWDELRTD

SEQ ID NO: 888 - protein, 703 aa, Chlamydia trachomatis
  VARIANT (1)...(703): Xaa = Any Amino Acid
CSQIFIRRSFVSPFSRRDFAGGMGRVANRLIGAKQRIRSLEDLWSVEVALAERGGDPEDYALWNHPETTIYNLVSDYGDEQSIYVIPQNVGAMRITAMSKLVVPKEGFEECLSLLLMRLGIGIRQVSPWIKELYLTNREESGVLGIFGSRQELDSLPMTAHIAFVLSSKNLDARADVQALRKFANSDTMLIDFIGGKVWLFGAVSEITELLKIYEFLQSHNIREEHXIVSLSKIEPSEMLXILKAAFREDLAKEGEDSSGVGLKVVPLQNHGRSLFLSGALPIVQKAIDLIRELEEGIESPTDKTVFWYHVKHSDPQELAALLSQVHDIFSNGASGASSSCDTGVVSSKAGSSSNGLGVHIDTSLRSSVKEGSAKYGSFIADSKTGTLIMVIEKEALPKIKMLLKKLDVPKKMVRIEVLLFERKLSNQRKSGLNLLRLGEEVCKQGTQAVSWASGGILEFLFKGGAKGIVPSYDFAYQFLMAQEDVRINASPSVVTMNQTPARIAIVEEMSIVVSSDKDKAQYNRAQYGIMIKILPVINIGEEDGKSFITLETDITFDSTGRNHADRPDVTRRNITNKVRIQDGETVIIGGLRCNQTMDSRDGIPFLGELPGIGKLFGMDSASDSQTEMFMFITPKILDNPSETEEKLECAFLAARPGENDDFLRALVAGQQAAKQAIERKESTVWGEESSGSRGRVEYDGRE

SEQ ID NO: 889 - protein, 428 aa, Chlamydia trachomatis
KEKSLPYGEKNPPALEEGWSMMDGNKGTMQDLLDRLPYSFLKKNYLLPVEDLGDKIVFARHLKKTPLEALDEVRLITQKPLSLVSKEEAEIIHGLQKLYSDKDGKASEMLQSMQEAVVPESESDTTELLENQENSAPVVRLLNLILKEAIEERASDIHFDPVEDLLRIRYRIDGVLHDRHAPPNHLRAALITRIKVLTKLDIAEHRLPQDGRIKLQLGGQEIDMRVSTVPVIHGERVVLRILDKRNVILDIRGLCMPPKMETSFRKAIGVPEGILLVTGPTGSGKTTTLYSVIQHLSGPFTNIMTIEDPPEYKLPGVAQIAVKPKIGLTFSKGLRHLLRQDPDVLMVGEIRDQETAEIAIQAALTGHLVVSTLHTNDAVSAIPRLLDMGVEPYLLSATMIGLSLNDSSVEFVRIAKNSVWPMCKNRLY

SEQ ID NO: 890 - protein, 144 aa, Chlamydia trachomatis
CCFCNPASFRHGSRALFIIRNNDRAVAQRLVRRICTHCKEFCVADVQEQALLRALGKDPFAPLCKGRGCSQCFRSGYKGRQGIYEFVDVTTTLRSEIALGRPYHILRGVAEREGYCPLLEHGVELALAGETTLSEVLRVAKRSE

SEQ ID NO: 891 - protein, 383 aa, Chlamydia trachomatis
LPSARAWSRTGSCWGDNPFRSFACGKTVRIAGGDMARFLCTYLDQSEKKRRSFVEAFHQREARELLAAQGARILDIRKVRERNYRVTTTELVIFTKQLALLLRSGISLYDALTSLRDQYQGHALAGVLTSLMEALRSGGVFSEALARLPHIFDSFYQNSVARGSGESIGNLEGALMNIIKVLEEKEKLSKSLAAALSYPAILLVFSCAVVVFFLIGVIPTLKETFEDMEMTRLTKAVFSCSTWFCRYKFLVLLGGIGGAISLRIVWKKRIGKRTLEAIIKKIPILRSLVIKIGFCRFCSVTSAVLQGGGNLIEALTLGCEAVSQDFLREELQEVIQAVVRGGSLSRELSHRTWTPKLVIGMVALGEESGDLAVVFAHVAQIYR

SEQ ID NO: 892 - protein, 151 aa, Chlamydia trachomatis
DSSRLKDPPRTTAWITSCSSSRKKSCDTASHPNVRASIKFPPPCKTADVTEQNRQNPILITRLRKIGIFLIIASRVLFPIRFFQTMRRDIAPPIPPSKTRNLYLQNHVLHEKTAFVSLVISISSKVSFNVGMTPIRKNTTTAQENTNKIAG

SEQ ID NO: 893 - protein, 137 aa, Chlamydia trachomatis
QAVFKRFNYRRETVKKTKKRKQSITLVEMMVVITLIGIIGGALAFNMRGSLQKGKIFQTEQNCARVYDVLMMEYASGNLSLKEVIANKEAILEDSAWCKEIKKLLKDAWGEDLLVKMNDKGDDIVVFSKKVRNEQRG

SEQ ID NO: 894 - protein, 203 aa, Chlamydia trachomatis
RRRQAFMFGRRYGGLIPWPEKGSRCTEVFMFRKIKKKRAFLLSELLIACVLISLLLGSLGYWTRRIWISHKEKEHVYRIFLNESKTYRFLRGTFLSTIAMEAQEELVFSFDRGVYVDPHLAGVVQGTLHYDPITQEISLIVASEREEARQEKISLWTHVLSMEWKVLRYQGLGEGPDRVYLTLVRKVGALPPRTLSYIFAVGR

SEQ ID NO: 895 - protein, 203 aa, Chlamydia trachomatis
VATRTVCAVRAHSSRCGVPGKKALPAQKEENNSPTPKPGSEWPENGSPPEKETRWVEKKPKSNKTTRSLLHFLNYEEKNTNQGRLNLLFTDPVILQAFINNSKAYSELERVRQEVWESARQQELAIKAYGQAAALEIFKTRTDFRTELQDKTQVILHRYDLLSLLNKKVFDYTLGTAGDYIFVVDPENEGVNRSRCVSRRKTN

SEQ ID NO: 896 - protein, 291 aa, Chlamydia trachomatis
IAMATLPEVLSGLGSSYIDYIFQKPADYVWTVFLLLAARILSMLSIIPFLGAKLFPSPIKIGIALSWMGLLLPQVIQDSTIVHYQDLDIFYILLIKEILIGVLIGFLFSFPFYAAQSAGSFITNQQGIQGLEGATSLVSIEQTSPHGIFYHYFVTIVFWLAGGHRIILSVLLQSLEIIPLHAVFPESMMSLRAPMWIAILKMCQLCLIMTIQLSAPAAVAMLMSDLFLGIINRMAPQVQVIYLLSALKAFMGLLFLTLAWWFIVKQIDYFTLAWFKEIPTMLFGAHPPKVL

SEQ ID NO: 897 - protein, 99 aa, Chlamydia trachomatis
IRDFPMLMLATSFKSILFEYSYEALLLILIISAPPIILASVVGIMVAIFQAATQIQEQTFAFAIKLVVIFGTLMITGGWLCSMILRFAAQIFQNFYKWK

SEQ ID NO: 898 - protein, 309 aa, Chlamydia trachomatis
LDFMRLIVRIFFFLCILSAPYSFASTCSAAQGASSCLPCATAPQQELPASPEKTEKPFRCPSYRPTVEAQHLLPPQEDLSSGAFSETYPDLTTQAVILLFLALSPFLVMLLTSYLKIIITLVLLRNALGVQQTPPSQVLNGIALILSIYVMFPTGVAMYHDAKKGIESSAVPRDLFSAEGAETVFVALNKSKEPLRSFLIKNTPKPQIQSFYKISQKTFPPELRQQLTPSDFMIIIPAFIMGQIKNAFEIGVLIYLPFFVIDLVTANVLVAMQMMMLSPLSISLPLKLLLVVMVDGWTLLLEGLMISFK

SEQ ID NO: 899 - protein, 93 aa, Chlamydia trachomatis
QVLSFYRWSIRWTTKRLFSFFWRCWKFLLRSGRARKARRGALCCGTSTGEAIGSAKNAEKEENSNNQSHKIQYLVFLALRLICCRSVRRFFMF

SEQ ID NO: 900 - protein, 248 aa, Chlamydia trachomatis
SNEQRSEVPCLLALPKDPYLVRRMKFFSLIYKDQEVVPNKKVLSPDAYTAVLTAQELLEKTQEDCEAYTQNTHEECAKLREEAKNQGFQEGSKAWSKQLAFLITETQAMREQIKASLVPLAIASVKKIIGKELETKPETVVSIISESLKDLTQNKRIVIHINPQDLAIVEQHRPELKKLVEYADVLLLSPKASVSPGGCIIETETGIVASNAQLDVQLAALEQAFSAILKHKKPADASTTDQPQSKKD

SEQ ID NO: 901 - protein, 278 aa, Chlamydia trachomatis
VTANTFGILNILMKQAKADDLAQFLPEHLLLDSPHHQDIPLQSLSFNMRWLATIHPSWISVAMKEFPPVVQSQLLAWLPLPLTQELLPLLDSGVTPATKRCLDFGAFYLLDLLSKKVRPPGITEEIFLPASPFNAMLYYVGPTKMALINCLGLYTLAQEMRNVVDRVVIDRVQRVLSETERMFLNYCKTHPMKHLEPTAFLASWEEDQALRHFIHVQGLRFLARALAKEDSSFLWYFIRRLDVGRGYIFEKALQSSIDSPHNEYFRERLEHCISILVQ

SEQ ID NO: 902 - protein, 325 aa, Chlamydia trachomatis
MFRYTLSRSLFFILALFFCSACDSRSMITHGLSGRDANEIVVLLVSKGVAAQKVPQAASSTGGSGEQLWDISVPAAQITEALAILNQAGLPRMKGTSLLDLFSKQGLVPSEMQEKIRYQEGLSEQMATTIRKMDGIVDASVQISFSPEEDQRPLTASVYIKHRGVLDNPNSIMVSKIKRLVASAVPGLYPENVSVVSDRASYSDITINGPWGLSDEMDYVSVWGIILAKHSLTKFRLVFYFLILLLFILSCGLLWVIWKTHTLISALGGTKGFFDPAPYSQLSFTQNKPAPKETPGAAEGAEAQTASEQPPKENAEKQEENNEDA

SEQ ID NO: 903 - protein, 319 aa, Chlamydia trachomatis
KMTDSESPTPKKSIPARFPKWLRQKLPLGRVFAQTDNTIKNKGLPTVCEEASCPNRTHCWSRHTATYLALGDACTRRCGFCDIDFTRNPLPPDPEEGAKIAESAKALGLKHIVITMVSRDDLEDGGASALVHIIETLHTELPTATIEVLASDFEGNIAALHHLLDTHIAIYNHNVETVERLTPFVRHKATYRRSLMMLENAAKYLPNLMTKSGIMVGLGEQESEVKQTLKDLADHGVKIVTIGQYLRPSRRHIPVKSYVSPETFDYYRSVGESLGLFIYAGPFVRSSFNADSVFEAMRQGKPQPLRYFRTKISHITCSF

SEQ ID NO: 904 - protein, 302 aa, Chlamydia trachomatis
TSKKSLKKWPLLAEGVIGCEFASLFHTLGSEVSVIEASSQILALNNPDISKTMFDKFTRQGLRFVLEASVSNIEDIGDRVARGLTINGNVEEYDYVLVSIGRRLNTENIGLDKAGVICDERGVIPTDATMRTNVPNIYAIGDITGKWQLAHVASHQGIIAARNIGGHKEEIDYSAVPSVIFTFPEVASVGLSPTAAQQQKIPVKVTKFPFRAIGKAVAMGEADGFAAIISHETTQQILGAYVIGPHASSLISEITLAVARGNELTLPCIYETIHAHPTLAEVWAESALLAVDTPLHMPPAKK

SEQ ID NO: 905 - protein, 212 aa, Chlamydia trachomatis
  VARIANT (1)...(212): Xaa = Any Amino Acid
MNEAFDCVVIGAGPGGYVAAITAAQAGLKTALIEKREAGGTCLNRGCIPSKALLAGAEVVTQIRHADQFGIHVEGFSINYPAMVQRKDSVVRSIRDGLNGLIRSNKITVFSGXGSLISSTEVKILGENPSVIKAHSIILATGSEPRAFPGIPFSAESPRILCSTGVLNLKEIPQKMAIIGGRCDRLRIRFLIPYVRLRSFCDRSKLSNPCFE

SEQ ID NO: 906 - protein, 163 aa, Chlamydia trachomatis
  VARIANT (1)...(163): Xaa = Any Amino Acid
RXDLMPFAKEADLQRTCWKCEGSVSACMPQCPYCSAFLQDPPVTSKGFSSCHITFPSEASKKNGDSDLFAVSSEDWEAVLNSQNTFEEPVQEPAPSQWDWLQYWPTAALFLGCGFLTFSLMILLFSTDSGLVLSWPKNRSYIYALVGILLAYRGYRSLPEHSK

SEQ ID NO: 907 - protein, 1204 aa, Chlamydia trachomatis
QRLILMILNSLSMFRHQATRFLQDNRDSIAVSFSKNTYKITIPDEDSPDGEWISTLSFNDEERLSFAACSCPDGDCCEHLLTATLAAYDPTEGALLHVKFESSFWWGLFYQLFLSKAPLHAPGDKVYTIQSQQLSVSLQCLSAEALTYWLPIVHTSPEPQTISKETFSQSALYRIARELFMFSQKGASLVIQENPQGFPSLFSLQWEGIALSIEVLDVDTLKALFPLLEFSQTSLYSGEPYLLHNVHVVPEQARIYFTKEYPPLPKSIKEYQETVLGPIKYFAEAKKCTSIPKTLSLPIHIIPALDRSFREHLLSQLCYETEERPIHYAIHFLRDASLSFSAYLETPGDLSEGHIIYPEFCYIPNKGLLAVSGLLSPESSFTIRSDHIENFLDEYGPFIKEPGFETFSNQSPVGSLSYNVTEQGVLLFHYDTGNAADIELRFGKWTYYSRQGFFLNSRLDLALQDGLTIEAPQVADFILTHEVALKSIPNFFAAQPPLKSIRFEVHKEKKGSGIYLQPIFEGLEHESCRLFGQFLYRENVGFSLLPAALQMLCQIPTEIPADQVAEFLLQFSKDDRMVFPDPQLALPERVELNILAIHRPHPSSPLHLKIEIKTNIGSIPLGTVLQALKGKKDFLFSKAGFLNLDNCLFVFLKQFLSSQRYDIQENTLITMVTDIFKLDALAPMITDPNIQASEEDLAYFSQLKSACLPPIPVNLFSTDHKLRPYQNSGLLWLWFLYNHRLSGLLCDEMGLGKTHQATALLDIVAQTAKNPKFLVVCPTSVLPHWEHVLASHLPQASLFSFHGPHKPKTLPDCDILITSYGTLRQNYALFYKVSFTVAVFDEIHTAKNKSSQIHKILCRLDAQMKLGLTGTPVENNLIEFKGLLDIILPNYLPSDALFKRLFTHKNASETDEDIISSKDLLLKLTRPFILRRTKKLVLPELPEKVESLIPCRLSPEQSQLYSSTLEKEKCQIQQLEKEEDPASVNYLHVFALLNQLKQICDHPAVYFKDPESYKNHSSGKWAAFVKLLNDSLASGYKVVVFSQYIQMIRIIALYLEEHAIEYALVQGKSQNRKEEIDRFSNDPNCRVFIGSLLAAGTGINLTAGNVVIMYDRWWNPAKENQALDRVHRIGQKNTVFIYKLVTEDTLEEHIHYLIEKKMRLLNQVTTTQDSNILHVLNREDLITILSYKDEHMLSEEVQEDSGDS

SEQ ID NO: 908 - protein, 410 aa, Chlamydia trachomatis
MHKKTQSHSHKGLSIWSIGGSIFAMFFGAGNVVFPLALGHHFYYHISYACLGMILTAVLTPLLGLFAMMLYSGNYRSFFAIGRMPGMVLMVAILCIIGPFGGIPRTIAVSYDTLASLGDKHPTLLPSLPWFSVFFCVLVYLFVCKLSKLIQWLGSVFFPVMLGTLAWLIIKGLLLPAHALPSESVTFSKQQAFVTGLSEGFNTMDLLGAFFFCSIVLVSIQQLMVQQKHESSEEKPLEFHHIGKTEKYKLAMSFLLAAALLSLVYLGFAFCAARHAGALIDVQRGQILGRISALVVGPNSFLTGLSVFLACLTTAIAVTGIFADFIARVVSSQKMSYSNALIVTLVPTYLVSILSFENISKILIPILEMSYPALIALTCGVIAKKLWDFRHVKTLFYLVFALTILYKLSV

SEQ ID NO: 909 - protein, 280 aa, Chlamydia trachomatis
AISTPALACSLLHIDDLAECLTTDYGEEEAIRLAKIFLEEAPCSIRVNTRRISVDKLQKVLPFPCQRGAAPSSLRFEKRYPLQHTRAFRRGLFEIQDESSQIITNAILIKDSDTVLDFCAGAGGKSLIFAQRARHVTLHDSRPQALEEARHRSPRSGIKNFTIPSQPLKKHSFSLVVVDAPCTGSGVFRRHPEKKLLFSKQLLHNNSIAQEKILKEALAYVAPRGRLVYITCSLMKEENEKHTSWMASQGWKCVKEVKIPLVSRQGDAFFSSHFIRSRSL

SEQ ID NO: 910 - protein, 116 aa, Chlamydia trachomatis
TYRYTRSQTRRPMIPFRFHHLYILLDSLFSSPIGESNRVAAYFKEHPSLGSKDRQWINTRIFTILRHRRLLEALVLAEGKEISAQTLVEKVEEGVTENIEQFQHLPWPVRYSISTI

SEQ ID NO: 911 - protein, 437 aa, Chlamydia trachomatis
MRTFFLLCRFFICLAPFFLSFPLYADPHTVLTKGIAAAVVHADSGAILKEKNLDHKIFPASMTKIATALLILRQYPDVLTRFITTRREPLTSITPQAKQQSGYRSPPHWLETDGMTIQLKVKEEVSGWDLFHALLISSANDAANVLADACCQSVSAFMRQLNEFLRELGCQNTHFNSPHGLHHPDHYTTARDLSLIMKEALKEPLFRQVIHTASYTMEATNLSPERVLSSTNKLLSSSSTYFYPPCLGGKTGTTKSAGKNIIFAAEKNNRSIIVVAAGYFGPAAQLYQDAIALCEDLFNEQLLRCFLIPPASHYPVPTRFGTVTAPVAQGIYYDFYPSEGDPLLTLSLEPNKISFPIRKGDLLGHWILSTPTGENQHSIPFLAESDILPTLKQRILLMSLRILTTYRTYVLILLFVWIYRRKKQPRATKTFSNPFFS

SEQ ID NO: 912 - protein, 151 aa, Chlamydia trachomatis
QITLEKGETAVSLDFLEDFFRRSITNHNTAFPEGFLDISDVLARSALDFKAEELADSAVNDFIVSESSDKLTLFNTNFAVWLVPTLVDGEAITRGYIALNQGEEFSPELTFEASGKYNNSSLILEALRRYLCDIQDTEKELRALRPPSIDG

SEQ ID NO: 913 - protein, 89 aa, Chlamydia trachomatis
QNTRWMFLIMRELTTQMLSLSLYTQNLTTHSLIYPSIEGGRKARNSFSVSWISHKYLRNASKIKLELLYFPDASKVNSGENSSPWFKAM

SEQ ID NO: 914 - protein, 152 aa, Chlamydia trachomatis
LYNRYTMTFSEGEQVFPATLQDLYPMLDFVKRAGVHCNCTQKKLSKLELACEELLLNIITHAYKGLPSTGWIRILCTETPDALLVRITDHGPAFNPITASPDIMRLDLPIEQRRIGGLGIFLAKYSVDVFDYERVNDTNVVTLTLYTKPHNS

SEQ ID NO: 915 - protein, 177 aa, Chlamydia trachomatis
SACGYTVLSPHYVEKKFSLSEGIYVCPIEGDSLGDLVSSLSYELEKRGLHTRSQGTSSGYVLKVSLFNETYENIGFAYTPQKPDEKPVKHFIVSNEGRLALSAKVQLIKNRTQEILVEKCLRKSVTFDFQPDLGTANAHQLALGQFEMHNEAIKSASRILYSQLAETIVQQVYYDLF

SEQ ID NO: 916 - protein, 281 aa, Chlamydia trachomatis
TKAIRDLTNSLFLFYDDALLLLSLRLAMKVILRALCLFLVLPCGCYARVPSFEPFRGAIAPNRYIPKHSPELYFEMGDKYFQAKKFKQALLCFGMITHHFPEHALHPKAQFLVGLCYLEMGHPDLADKALTQYQELADTEYSEQLFAIKYSIAQSFANGKRKNIVPLEGFPKLLKADTDALRIFEEIVTASSDADLKASALYAKGALLFDRKEYSEAIKTLKKVSLQFPSHSLSPESFTLIAKIHCLQALQEPYNEQYLQDARMKQQLYVNNTLIILAIQK

SEQ ID NO: 917 - protein, 295 aa, Chlamydia trachomatis
KGWVMKKVVFIAAIFSSIVFWDKIPYSHRIKQFAMDYGIELVEKSSQLVRKISGNERLCVFERRVSEEQVLAMFAKDKASAELLFVPHVLMRVRFSGEEDKRAGSHEGAMLWSLSNGEMVLNTGSWTYSKGFRECLMLKAGKQDVQLMQVLAGMGGSASREVLSQALSMRNVRADRVIRACQKKKLIFTHDNLIYSHFQQPQPIKGCMTVFNSSPVWLAKPKGSTVCSVVYPEDRIQNLVEMIFGDNFFILSSEQIHVPVYKVSIAASDSSVARGVEYINAITGKPFDFAPTYCK

SEQ ID NO: 918 - protein, 1246 aa, Chlamydia trachomatis
  VARIANT (1)...(1246): Xaa = Any Amino Acid
RAVLTWIPLHCHSQYSILDATCSIKKFVAKAVEYQIPALALTDHGNLFGAVEFYKTCKQNAIKPIIGCELYVAPSSRFDKKKERKSRVANHLILLCKDEEGYRNLCLLSSLAYTEGFYYVPRIDRDLLSQHSKGLICLSACLSGSVAQAALESEEDLEKDLLWYQDLFQEDFFSEVQLHKSSEEKVALFEEAWLKQNYYQFIEKQLKVASNEAVLATSKRLGIPSVALATNDIHYLNPDDWLAHEVLLNVQSREPIRTAKQNTYIPNPKRKTYPSREFYFKSPQEMAELFAAHPETITNTCIVAERCHLELDFETKHYPIYVPEALQKKGSYTEEERYKASSAFLEELCEQGLTSKYTPELLGHIAKKFPGEDPLTLVKERLKLESSIIISKGMCDYLLIVWDIINWAKDHGIPVGPGRGSGAGSVMLFLLGITEIEPIRFDLFFERFINPERISYPDIDIDICMIGRERVINYAIERHGKDNVALAQIITFGTMKAKMXIKDVGRTLDTPLAKVNFIAKHIPDLNATITSALEADPELKQLYVDDAEAAEVIDMAKKLEGSIRNTGVHAAGVIICGDPLTNHIPICVPKDSSMISTQYSMKPVESVGMLKVDFLGLKTLTGIHIATQAIYKKTGILLRAATIPLDDQNTFSLLHQGKTMGIFQMESRGMQDLAKNLRPDAFEEIIAIGALYRPGPMDMIPSFINRKHGKENIEXDHPLMEPILKETFGIMVYQEQVMQIAGSLAKYSLGEGDVLRRAMGKKDHEQMVKEREKFCSRAAANGIDPSIATTIFDKMEKFASYGFNKSHAAAYGLITYTTAYLKANYPKEWLAALLTCDYDDIEKVGKLIQEAHSMNILVLPPDINESGQDFEATQEGIRFSLGAVKGVGMSIVDSIVEEREKNGPYKSLQDFVQRADFKKVTKKQLENLVDAGTFDCFEPNKDLALAILNDLYDTFFREKKEAATGVLTFFSLDSMXRDPVKITVXPENVIQRSPKELLKREKELLGVYLTAHPMDAVEHMLPFLSVVPARDFEGLPHGTIIRTVFLIDKVTTKISSAEQKKFALLQVSDEVDSYELPIWADMYAEYHDLLEEDRLIYAILAIDRRSDSLRLSCRWMRDLSTVNDSVIAECDEVYDRLKSQKVYSSTKKSTGAQSSAMIKKVETREISPVTISLDLNKLRHSHLFILKGLIRKYSGSQALSLVFTKDNQRFASISPDADFFVTDDISSLLQEIEATNIPARVLATTV

SEQ ID NO: 919 - protein, 414 aa, Chlamydia trachomatis
  VARIANT (1)...(414): Xaa = Any Amino Acid
LFFYFTRKSXXFAMPTLIADLGFDKAQLGIIGSTLYITYGISKFVSGVMSDQSNPRYFMAIGLIITGISNIFFGLSSTIPLFVLFWGINGWFQGWGWPPCARLLTHWYSKSERGTWWSVWSTSHNIGGALIPVLTGVAIDYTGWRGVMFIPGIICIIMGFILIDRLRDTPQSLGLPAIEKFRKEEDAHPHEETTADILEEEAERELSTKEILFTYVLSNKWLWFLSFASFFIYVVRMAVNDWSALYLIETKDYSTVKANLCVSLFEIGGLFGMLLAGWLSDTISKGKRGPMNVVFSLGLLVSILGLWGTRDYFVWWIDGTFLFIIGFFLFGPQMMIGLAAAELSHKKAAGTASGFTGWFAYFGAAFAGYPLGKVAQDWGWHGFFVALLACALIALILFLPTWNASEQSLRKHSH

SEQ ID NO: 920 - protein, 406 aa, Chlamydia trachomatis
  VARIANT (1)...(406): Xaa = Any Amino Acid
LEKFSLWKRVEHAAHRICNLYGFDEIRTPVFEKTETFLRVGEHSDIVKKEVYTXLDKKGRSLTLRPEGTAAVVRALLDHSADMRKDNKFYYILPMFRYERXQSGRYRQHHQFGLEAIGVRHPLRDAEVLSLLWDFYAAVGLQHMQIHVNFLGGQKTRARYDEALREFFRKDLDRLSPLSQERYHANLLRILDSKEPEDQEFIEKAPSILDYIDDRDLSYFDAVLAQLKALGIPFAINPRLVRGLDYYTDLVFEAVTVVGERSYALGGGGRYDELVAQSGGPSMPAFGFGVGLERVIQTLLEQGNSLSTSTRRLRLIPMDEQADAFCFSWANRLRNLGIATEVDWSHKKPKLSLKDAADQQVSFVCLLGEQELATKQFIVKDMSLHQSFSGAQQDVEQRLVYEVQNA

SEQ ID NO: 921 - protein, 87 aa, Chlamydia trachomatis
SAASLRDNLGFLWLQSTSVAMPRLRKRFAHEKQNASACSSIGINRNRRVEVDKEFPCSNSVWITLSNPTPKPKAGIEGPPDCATNSS

SEQ ID NO: 922 - protein, 584 aa, Chlamydia trachomatis
MKYRTHKCNELSLDHVGEHVRLSGWVHRYRNHGGVVFIDLRDRFGITQIVCRQEENPELHQLMDQVRSEWVLCVEGLVCARLEGMENPNLVTGSIEVEVSSLEVLSRAQNLPFSISDEHINVNEELRLTYRYLDMRRGDILDRLMCRHKVMLACRQYLDEQGFTEVVTPILGKSTPEGARDYLVPSRIYPGNFYALPQSPQLFKQILMVGGLDRYFQIATCFRDEDLRADRQPEFTQIDMEMSFGGPEDLFPVVEELVTRLFAVKGIELKAPFLRMTYQEAKDSYGTDKPDLRFALRLKNCCEYARKFTFSIFLDQLAHGGTVKGFCVPGGADMSRKQLDIYTDFVKRYGSMGLVWIKKQDGGVSSNVALAKFASEDVFQEMFEAFEAKDQDILLLIAAPEAVANQALDHLRRLIAKERQLYDSTQYNFVWITDFPLFAKEEGELCPEHHPFTAPLDEDISLLDSDPFAVRSSSYDLVLNGYEIASGSQRIHNPDLQNKIFALLKLSQESVKEKFGFFIDALSFGTPPHLGIALGLDRIMMVLTGAETIREVIAFPKTQKAGDLMMSAPSEILPIQLKELGLKL

SEQ ID NO: 923 - protein, 250 aa, Chlamydia trachomatis
  VARIANT (1)...(250): Xaa = Any Amino Acid
VQLRKKRMKNILSWMLMFAVALPIVGCDNGGGSQTSATEKSMVEDSALTDNQKLSRTFGHLLARQLSRTEDFSLDLVEVIKGMQSEIDGQSAPLTDTEYEKQMAEVQKASFEAKCSENLASAEEFLKENKEKAGVIELEPNKLQYRVVKEGTGRALSGKPTALLHYTGSFIDGKDFDSSEKNKAAILLPLTKVIPGFSQGMQGMKEGEVRVLYIHPDLAYGTAGQLPPNSLLIFEVXLIEANDDNVSVTE

SEQ ID NO: 924 - protein, 151 aa, Chlamydia trachomatis
MRIVLHNPDIPQNTGNIGRTCVALGAELILVRPLGFSLADKFVKRAGMDYWERLSLSVVDSLEEALLGVPKERIFCLTTKGSSYYGERELPLDGTYIFGAESKGLSQTVLDAYSSQCLYIPMIEGTRSLNLATSVGIVMYEVARQNYKTLF

SEQ ID NO: 925 - protein, 102 aa, Chlamydia trachomatis
  VARIANT (1)...(102): Xaa = Any Amino Acid
MVQVVSQENFADSIASGLVLIDFFAEWXGPCKMLTPVLEALAAELPHVTILKVDIDSSPRPAEQYSVSSIPTLILFKDGKEVERSVGLKDKDSLIKLISKHQ

SEQ ID NO: 926 - protein, 214 aa, Chlamydia trachomatis
  VARIANT (1)...(214): Xaa = Any Amino Acid
QRTCFXXEQSLRLSPVVFVRDKIIFKSTEDAIQLLEADKKIWRETEIQISSGKPEVNEQTKRIYICPFTGKVFADNVYANPQDAIYDWLSSCPQNRERQSGVAVKRFLVSDDPEVIRAYIVPPKEPIIKTVYASAVTGKLFHSLPTLLEDFKTSYLRPMTLEEVQNQNKFQLESSFLTLLQNALEEEKIAEFVESLADDTAFHKYISQWVDTEE

SEQ ID NO: 927 - protein, 158 aa, Chlamydia trachomatis
PMGRYRRVTHSCEETIDLATRVGRDLTPGMVVLLSGDYGSGKTEFVRGIVQGFLGEAAVDQVASPSFALLHVYEAGGRRVCHYDLYRLETMDIRNGADLFQDAEEEDLICVEWPEAVNLLPQFRKSVCVQMRSLTDAQREVSIGVTDGCDLSFFMEND

SEQ ID NO: 928 - protein, 129 aa, Chlamydia trachomatis
RVVLLKDVEFVCLDCETTGLDVKKDRVIEFAAIRFTFDEIIDSVEFLIHPERAVSAESQKIHKISDAMLRDKPKFGEVFSRIKGFFKERDHIVGHHVGFDLQVLSQESERLGETLLPKHHYVIDTLRLA

SEQ ID NO: 929 - protein, 123 aa, Chlamydia trachomatis
LKEYGDSPNNSLEALARHFNVPHQGNHRAMKDVEMNVKVFKHLTKRFRTLSQVTHILSKPIKMKYMPLGKYKGWLFTDIPLEYLLWASKMDFDQDLLFSIRSEIKSRKKGTGFAQANNPFLGL

SEQ ID NO: 930 - protein, 163 aa, Chlamydia trachomatis
  VARIANT (1)...(163): Xaa = Any Amino Acid
KGDVRKDNKEDKRKKVSASCITDHIYKIFPNDLNTNNTXFGGLLMSLLDRLALVVAERHCESICVTAFVDAMRFYAPAYMGENLICCASVNRSWRTSLEVGVKVWAENIYKQEHRHITSAYFTFVAVDKNNSPVEVPELIPESQEEIRRFREADQRRALRLKL

SEQ ID NO: 931 - protein, 112 aa, Chlamydia trachomatis
ASKGVPLVFKPVSYIILSWVLVCLAQPDVSVVALASVVSCICGYSLLWAGLFALVEQLSWKKVWCIAFIWTWTVEGAHFSWMLEDLYVGTSIYFVWGILLSYLATLFASFSC

SEQ ID NO: 932 - protein, 438 aa, Chlamydia trachomatis
VVWCCRKQYRGALVWLPGVWVAIEAIRYYGLLSGVSFDFIGWPLTATAYGRQFGSFFGWAGQSFLVIAANICCFAACLLKHSFSKGLWLTLCAFPYLLGGAHYEYLKKHFSDSEVLRVAIVQPGYSPHMHAGRMASAIWRGLVSLCQTIQTPVDVIVFPEVSVPFGLHRQAYTLHENQPVLESLLPNKSWGEFFTNLDWIQAIAERYQCTVIMGMERWENKGGILHLYNAAECVSREGEITSYDKRILVPGGEYIPGGKIGFSLCQTFFPEFALPFQRLPGEFSGVVNITERIKAGISICYEETFGYAIRPYKRQQADILVNLTNDGWYPRSRLPLVHFYHGMLRNQELGIPCIRACHTGVSAAVDSLGRIVGILPWESRTCPVSTGVLQVSVPLYSYHTVYARLGDAPLLLIAVCSVIGAIAYFYRKKKETPPQTFF

SEQ ID NO: 933 - protein, 77 aa, Chlamydia trachomatis
  VARIANT (1)...(77): Xaa = Any Amino Acid
GMLFRGGSAFWKSCDAYXRARRGKYRRIFSRHAASEQYIPARLANVCGTGRSTTLSLDGSVISTVEHLLASLLLRSG

SEQ ID NO: 934 - protein, 208 aa, Chlamydia trachomatis
  VARIANT (1)...(208): Xaa = Any Amino Acid
NTCWHRSYFGVDNVRIYCSEDEIPIGDGSAQVFMDLIDQAGIQEQEQTVQIARLAHPVYYQYQDTILAAFPSDEFKISYTLHYSHNSTIGTQYRSLVISEESFRKEIAPCRTFALYSELCFLMEKGLIGGGCVGNAVLSKXDGVISLGKLRFPDEPVRHKILDLIGDLSLVGTPFLAHVIAVGSGHSSNIALGNRILEALQHEQELVK

SEQ ID NO: 935 - protein, 158 aa, Chlamydia trachomatis
TGVSQMNEKPVLGIQDIQNLLPHRYPFLLVDKILSYDLNTRSVVAQKNVTINEPFFAGHFPGAPIMPGVLILEALAQAAGVLLGIILENDRDKKIALFLGIQKAKFRQPVKPGDVLTLKAEFSLISAKGGKAFAQAFVGSQVVAEGELSFVLVKKESI

SEQ ID NO: 936 - protein, 265 aa, Chlamydia trachomatis
  VARIANT (1)...(265): Xaa = Any Amino Acid
MTNIHPTAIVEDGARIGNNVTIEPYAIVKKSVTLWNDVVVKSYAYIDGFTTIGRXTTVWPSAMIGNKPQDLKFKGEKTFVEIGEHCEIREFAMITSSTFEGTTVSIGNNCLIMPWAHIAHNCSVGNNVVFSTHVQLAGHVQVGDCVTIGSMVGVHQFVRIGSYSMVGAMSGIRRDIPPFTIGTGNPYALGGINKVGLQRRQVSFETRLALIKTFKRVFRSDESFQASLESVLEDFGEVPEVRHFVEFCRQPSKRGIERGVDCEDL

SEQ ID NO: 937 - protein, 209 aa, Chlamydia trachomatis
LSLSLRVVYLGTPQFAATVLKTLLDAHTHIVGVVTRADKPQKRSSKLISSPVKQLALSKNIPLLQPIKTTDPAFLAQLREWQADVFIVVAYGVILKQELLDIPTYGCYNLHAGLLPAYRGAAPIQRCIMDGGVLSGNTVIRMDAGMDTGDIANVNYVAIGEDMTAGGLAEALAASGGELLLKTLQEIEAGTVARGHVPQNEAMLRWLLN

SEQ ID NO: 938 - protein, 108 aa, Chlamydia trachomatis
  VARIANT (1)...(108): Xaa = Any Amino Acid
GRGRDSLGCSSFSSIRAYPGSLACSGRLDSLSIPRERGXRLGVLSARMESFSGNYGDPGEVLGVSGEDLLIACRQGALRLRMVQPEGKASMKAKDFFNGQSRLVSKLF

SEQ ID NO: 939 - protein, 335 aa, Chlamydia trachomatis
  VARIANT (1)...(335): Xaa = Any Amino Acid
VNMAAICGRLGSGTGNALKAFFTQPSNKMARVVNKTKGMDKTVKVAKSAAELTANILEQAGGAGSSAHITASQVSKGLGDARTVLALGNAFNGALPGTVQSAQSFFSYMKAASQKPQEGDEGLVADLCVSHKRRAAAAVCSFIGGITYLATFGAIRPILFVNKIWRNRFFLPKLKQIWDLLLAILWRLTMQRLWWVLDSLSVRKEQIAKPPALVLREKSRHSNCRERKMLARGESLERKPRRSRASSMHSSLCTRSFWNALPTFSNWCRCLLQWVFVQLWLRDVRSLPQLLDCGLSATEYXGFFKFLKKKAVSKKKQPFLSTKCLAFLIVKIVFL

SEQ ID NO: 940 - protein, 163 aa, Chlamydia trachomatis
  VARIANT (1)...(163): Xaa = Any Amino Acid
LHRRNYLPRDIRSYPSDSVCQQNLAQPFLSSQTKANMGSSVSYIMAANHAAFVVGSGLAISAERADCEAPCARIAREESSLELSGEENACERRVAGEKAKTFTRIKYALLTMHEKFLECVADVFKLVPLPITMGIRAIVAAGCTFTTAVIGLWTFCNRVXGIF

SEQ ID NO: 941 - protein, 223 aa, Chlamydia trachomatis
MRSQLSLIGKKEGMMHVFDKNGNLVACSVISVASPANVVAQLKTASSDGYNAVQIGADVVQAPEKTIEKRFSKALLGHFKKSGGRACRVLKEVVVSEEAVQSVSLGDEFGLEIFDGVSNVDICGISKGKGFQGVMKKFGFRGGPKSHGSGFHRHAGSIGMRSTPGRCFPGSKRPSHMGCDRVTVKNLEVVKVDLDRKVMLVKGAIPGFKGSVVVVKRSCGVEG

SEQ ID NO: 942 - protein, 231 aa, Chlamydia trachomatis
LRSRGVEVLMVLLSKFDFSGKELGKFELPDAFFTEGREQSVKDYLVAIQANKRQWSACTRGRSEVSHSTKKPFRQKGTGNARQGCLAAPQFRGGGIVFGPKPKFDQHIRINKKERRAAIRLLLAQKIQTGKLIVAENSVFVSSLDAPKTKEALRFLKECNVECRGVLFVDSLAHVGSNENLRLSVRNLSAVRGFTYGENISGYDIAAARNIVVSEKALELLVESLVSTTKD

SEQ ID NO: 943 - protein, 111 aa, Chlamydia trachomatis
MKDPYDVVKRHYVTEKAKMLEGLSLGDGEGKKKGSFCKDPKYTFIVAGDATKPMIAEAIEAIYSAKGVKVKKVNTMCVKPQPTRIFRGRRKGRTAGFKKAIVTFVDGHSIG

SEQ ID NO: 944 - protein, 284 aa, Chlamydia trachomatis
MFKKFKPVTPGTRQLILPSFDELTTQGELKGSSSRRSVRPNKKLSFFKKSSGGRDNLGHISCRHRGGGVRRHYRVIDFKRNKDGIEAKVASVEYDPNRSAYIALLNYVDGEKRYILAPKGIKRGDRVISGEGSPFKTGCCMTLKSIPLGLSVHNVEMRPGSGGKLVRSAGLSAQIIAKTAGYVTLKMPSGEFRMLNEMCRATVGEVSNADHNLCVDGKAGRRRWKGIRPTVRGTAMNPVDHPHGGGEGRHNGYISQTPWGKVTKGLKTRDKRKSNKWIVKDRRK

SEQ ID NO: 945 - protein, 96 aa, Chlamydia trachomatis
MSRSLRKGPFVDHHLLKKVRDMNALEKKTPIKTWSRRSMITPEMIGHTFEVHNGRKFLTVFVSETMVGHKLGEFSPTRMFKSHPVKKGYHKETGYV

SEQ ID NO: 946 - protein, 145 aa, Chlamydia trachomatis
LCQKLWLDTSWESSLQQECLRAIPLKKGIIRRQVMFKATARYIRVQPRKARLAAGLMRNRSVVEAQQQLSFSQMKAGRCLKKVLDSAIANAESNENIKRENLCVLEVRVDAGPMFKRMKSKSRGGRAPILKRTSHLTVIVGERGQ

SEQ ID NO: 947 - protein, 219 aa, Chlamydia trachomatis
  VARIANT (1)...(219): Xaa = Any Amino Acid
MSSRVXTAVTKKWRSLWYGNNQEFAKFLIEDVKIREFLKKKPSCQGAAGFVVKRMSGKIEVTIHTARPGLVIGKKGAEVDSLKAELKKLTGKDVWVEIAEVKRPELNAQLVADGIAKQIERRVSFRRAMKKALQSVMDAGALGVKVQVSGRLAGAEIARSEWYKNGRVPLHTLRADIDYATASAETTYGIIGIKVWINLGEKKAVPAANHAGAASTAAA

SEQ ID NO: 948 - protein, 145 aa, Chlamydia trachomatis
MNQYAKAAGKRTKFRKQQKGQFAGLSKGATFVASPFGEFGMQTLERGWITSRQIEACRVAINRYLKRKGKVWIRVFPDKSVTKKPAETRMGKGKGAPDHWVAVVRPGRILFEVANVSKEDAQDALRRAAAKLGIRTRFVKRVERV

SEQ ID NO: 949 - protein, 81 aa, Chlamydia trachomatis
LLSVWKGYSMGAKKNLLAELREKSSEELDEFIRDNKKALFALRAEAALQNKVVKTHQFSLYKKSIARALIIKQEKKDRVHG

SEQ ID NO: 950 - protein, 83 aa, Chlamydia trachomatis
MASDVRGRRKTKIGVVVSSKMEKTVVVRVERVYSHPQYAKVVRDSSKYYAHNELDVKEGDTVRIQETRPLSKTKRWRVVGRVN

SEQ ID NO: 951 - protein, 122 aa, Chlamydia trachomatis
MIQQESQLKVADNTGAKKVKCFKVLGGSRRRYATVGDVIVCSVRDIEPDSSVKKGDVVKAVIVRTRNDIHRKDGSTLRFDTNSCVIIDDKGNPKGTRIFGPVAREIRDRGFVKISSLAPEVI

SEQ ID NO: 952 - protein, 111 aa, Chlamydia trachomatis
MKRRSVCVGDTVYVLAGNDKGKQGKVLRCLKDKVVVEGINVRVKNIKRSQENPKGKRINIEAPLHISNVRLSIDNQPARLFVKVTEKGRELWNKHSDGSSSLYRLVRERKG

SEQ ID NO: 953 - protein, 180 aa, Chlamydia trachomatis
MSRLKKLYTEEIRKTLQDKFQYENVMQIPVLKKIVISMGLAEAAKDKNLFQAHLEELAVISGQKPLVTRAKNSIAGFKLREGQGIGAKVTLRGIRMYDFMDRFCNIVSPRIRDFRGFSCKGDGRGCYSLGLDDQQIFPEVDLDRVKRSQGMNITWVTTAQTDAECLTLLECMGLRFKKAQ

SEQ ID NO: 954 - protein, 98 aa, Chlamydia trachomatis
SNIRILKQHGFVAHFLVKEENRKRLMRVFLRYGEDRRPVIHALKRVSKPSRRVYVSAAKIPYVFGNMGIAVLSTPQGVLEGSVARAKNVGGELLCLVW

SEQ ID NO: 955 - protein, 183 aa, Chlamydia trachomatis
MSRKARDPIVLPQGVEVSIQNDEISVKGPKGSLTQVLAKEVEIAVKGNEVFVAPAAHVVDRPGRMQGLYWALIANMVKGVHTGFEKRLEMIGVGFRAAVQGSLLDLSIGVSHPTKMPIPTGLEVSVEKNTLISIKGINKQLVGEFAACVRAKRPPEPYKGKGIRYENEYVRRKAGKAAKTGKK

SEQ ID NO: 956 - protein, 130 aa, Chlamydia trachomatis
SRTMESSLYKKTSGKARRALRVRKALKGCSLKPRLSVVKTNKHVYVQLIDDVEGKTLAFISTLAKVAKTSGLTRKNQDNAKALGIKIAELGKGLQVASPRVVFDRGAHKYHGVVALAMVPDGAREGGLQF

SEQ ID NO: 957 - protein, 165 aa, Chlamydia trachomatis
  VARIANT (1)...(165): Xaa = Any Amino Acid
XTLSRNSHKEDQLEEKVLVVNRCCKVVKGGRKFSFSALILVGDRKGRLGFGFAKANELTDAIRKGGDAARKNLVSINSLEGGSIPHEVLVNHDGAELLLKPAKPGTGIVAGSRIRLILEMAGVKDIVAKSLGSNNPMNQVKAAFXALLTLSCKDDIMKRRAVIND

SEQ ID NO: 958 - protein, 144 aa, Chlamydia trachomatis
MIKLECLQDPSPRKRRTKLLGRGPSTGHGKTSGRGHKGDGSRSGYKRRFGYEGGGVPLYRRVPTRGFSHKRFDKCVEEITTQRLNEIFDNGAEVSLEALKERKVIHRETSRVKVILKGALDKKLVWKDAAIVLSEGVKSLIEAV

SEQ ID NO: 959 - protein, 457 aa, Chlamydia trachomatis
MATLRQVFSISELRQKIFFTFSLLALCKIGVFIPVPGINGDRAVAYFNQLLGSSQNLFQLADIFSGGAFAQMTVIALGVVPYISASIIVQLLVVFMPTLQREMRESPDQGKRKLGRMTRLFTLVLACVQSLLFAKFALRMNLVVPGIVLPAMLSLKLFGVPWVFYLTTVVVMTTGTLLLMWVGEQISDKGIGNGISLIITLGILASFPSVLGSIFNKLNLGSQDPSEFGIVSLLILCAVFVFVLIATVLIIEGVRKIPVQHARRIIGRREVVGGGSYLPLKVNYAGVIPVIFASSLLMFPATIGQFLSSESSWLKRIATMLSPGSVAYSIFYVLLIIFFTYFWTATQFRPEQIASEMKKNGAFIPGIRQGKPTQTYLEYTMNRVTLLGAVFLAVVAILPSVLGRILRVDANVSYFLGGTAMLIVVGVILDTMKQIDAFLLVRRYDGVLKKDRPKGRP

SEQ ID NO: 960 - protein, 122 aa, Chlamydia trachomatis
MPRIIGIDIPAKKKLKISLTYIYGIGPALSKEIIARLQLNPEARAAELTEEEVGRLNALLQSDYVVEGDLRRRVQSDIKRLITIHAYRGQRHRLSLPVRGQRTKTNSRTRKGKRKTIAGKKK

SEQ ID NO: 961 - protein, 132 aa, Chlamydia trachomatis
LVKNQAQKRGVKRKQVKNIPSGVVHVKATFNNTIVTITDPAGNVISWASAGKVGYSGSRKSSAFAATVAAQDAAKAAMSSGLKEVEVGLKGTGAGRESAVRALISSGLIVSVIRDETPVPHNGCRPRKRRRV

SEQ ID NO: 962 - protein, 193 aa, Chlamydia trachomatis
VSTKKTTKSVVIAKEFGMSDSSHNLLYNKFELPESVKMSPVEGAVGGIDKVARFVADPLEKGMGHTLGSALRRALLIGLEAPAIVSFSMTGVLHEYMAVEGIIEDVTNIVLNLKGSLLKKYPLQDCEGGRCSQKLRATISVDASDLAAAGGQKEVTLGDLLQEGTFEAVNPEHVIFTVTRPMQLEVMLPSCFW

SEQ ID NO: 963 - protein, 222 aa, Chlamydia trachomatis
FLRSRVQCNLRLCCRVALAFGRGYSPSERIVLEERGMNEIVLDAAFSPVVLVNYFVEDTRVGQDTDFDRLVLQVETDGRVAPKEAVAFATQILSKHFSVFEKMDEKRIVFEEAISVEKENKDDILHKLVLGINEIELSVRSTNCLSNANIETIGELVIMPEPRLLQFRNFGKKSLCEIKNKLKEMKLELGMDLSQFGVGLDNVKEKMKWYAEKIRSSKNTKG

SEQ ID NO: 964 - protein, 343 aa, Chlamydia trachomatis
  VARIANT (1)...(343): Xaa = Any Amino Acid
LTTWDLAMRIVINGFGRIGRLVLRQILKRNSPIEVVAINDLVAGDLLTYLFKYDSTHGSFAPQATFSDGCLVMGERKIRFLAEKXVQKLPWKDLDVASPVVIESTGLFVNRDDAAKHLDSGAKRVLITAPAKGDVPTFVMGVNHQQFDPADVIISNASCTTNCLAPLAKVLLDNFGIEEGLMTTVHAATATQSVVDGPSRKDWRGGRGAFQNIIPASTGAAKAVGLCLPELKGKLTGMAFRVPVADVSVVDLTVKLSSATTYEAICEAVKHAANTSMKNIMYYTEEAVVSSDFIGCEYSSIFDAQAGVALNDRFFKLVAWYDNEIGYATRIVDLLEYVQENSK

SEQ ID NO: 965 - protein, 145 aa, Chlamydia trachomatis
STYKKTLNKGSFVYFTRDPVIETVITSREGYKLSIRNSKHLSQDPFVVEAIEVVRLGGTSFFRNCDHSKPFLLPASDYEVMEIRDAKINLKAVGLDRGVKIVGSREALLKMPKVAPIVSVSEDNTIVSEEEVVADSTVALPLLHL

SEQ ID NO: 966 - protein, 157 aa, Chlamydia trachomatis
RRGSCRLYCCTPASTPVAPMSKKERRKEFKNEKWKDKKKQGRRRNSKEIADAVGSSQEMIDTVAEECLQESSSEEGDFSERRFSLIPPPTRLISDGPEEPEEESQPVTSVDLNESLNALVSESCNVIESILADEDTVVFTKEKDQTAEESQEQPSFH

SEQ ID NO: 967 - protein, 100 aa, Chlamydia trachomatis
FIDEESYLTWGISLMWLWSLVKLRLLSLLRFRKVRAFTSPDQYEEYSRSMLQLFCLWKDSDIVEWENTCQMLFGVCSKMSEVCLETRSRCKSNLRVKNNH

SEQ ID NO: 968 - protein, 137 aa, Chlamydia trachomatis
YCGMGEYLSDVVWCLFKNERSLLRNKKQMQIQSASKEQSLAEWEQQVCELKSQLASQENANQQEISKLQAENHWLQNRLAEKLQQARHQNDVIDELKRDLVESVQQMEVSEGRRLCYEHKIRVLEEQIDRFLAKEEV

SEQ ID NO: 969 - protein, 170 aa, Chlamydia trachomatis
MADLIMGIDPGTLVCGYALIKVENRYHIHPHSFGKVKLSQKLALAHRYKQLFTEISTILQQESPKAVVLETQYVHKNPQSTIKLGMARGVLLLAASLQDVPVFEYAPNTAKKAAVGKGNASKKQVQLMVSKLLRVPDLLAEDNEDIADAFALAMCHAHLAPYQDLKKTLV

SEQ ID NO: 970 - protein, 200 aa, Chlamydia trachomatis
MYEYIKGTLTHIDGSYVVIESFGIGYAIMLSERFLVDLRAFMHQEVLIYVHSVIRETEHVLYGFSSRAERECFRLLISFSGIGPKTGLSILNMFPLQELCSIARLENVKAIASVPGIGKKTAEKLMVDLKQKLPTLMPLYLEEPVVPSSTANSSFKEGIGALMNLGFSRLAADRMMTEAVKELSEEASVAELLPIALRKS

SEQ ID NO: 971 - protein, 101 aa, Chlamydia trachomatis
VRAMAQEKERQQGEYMEQTLSIIKPDSVGKAHIGEIIAIFEKSGLRIAAMKMVHLSVKEAEGFYVVHKERPFFQELVDFMISGPVVVMVLQGENLSPVTES

SEQ ID NO: 972 - protein, 88 aa, Chlamydia trachomatis
RETFFPRTGRLYDLWSCCSNGTARGKPVARNRELMGATNPKEAAEGSIRALFGESIGVNAVHGSDSLENAAIEVSYFFAKTEVVNSVA

SEQ ID NO: 973 - protein, 233 aa, Chlamydia trachomatis
MLINCVFVHCEGLPIFKQLQLEEALLRTSSQNFCLVNTHLPEAVVLGISRKPERDLHVEHLKEDGIPIIRRYSGGGTVFLDADSLMVSWIINSPTPSPSSKDLLQWTQDIYAPIFPTGFKITENDYTFLDKKIGGNAQYIQKYRWVHHTTFFWNMNPKKLARYLPTPEIQPSYRQNRSHDEFLTTIYELFDSREDFLSQLKQSAASKMVWEQGSIQTLTPMLSLPHRKATQIL

SEQ ID NO: 974 - protein, 617 aa, Chlamydia trachomatis
LGSMWTFPVDYDVIVIGAGHAGCEAAYCAAKMGASVLLLTSNLDTIAKLSCNPAVGGIGKGHIVARGEIDALGGIMAEITDLSGIQFRILNQTKGPAVARGAPRAQVDKQLYHIHMKRLLEQVPGLHIMQGTAEALLDNGEKVLGVSTKEGWAYLGKTVVLSSGTFMRGLIHIGTQNFSGGRLGDAASLGLSEDLKRLGFPLGRLKTGTPARLLASSIDFSVMEEQPGDHNVCFVHRNEMFVPTLPQVSCHITHTTDQTKDLITKNLHRSALYGGRIEGVGPRYCPSIEDKIVKFADKDRHHIFIEPEGLNTQEVYVNGLSTSMPFDVQYDIIRSVSGLENAIITRPAYAIEYDYVHGNVIFPSLESKLIEGLFLCGQINGTTGYEEAAAQGLIAGVNAVNKVLRRPPFVPSRQESYIGVMLDDLTTQVLDEPYRMFTSRAEHRLLLRQDNAGMRLSHYGHSLGLLSSERYAMFQEQKACIEQEKERLSKTFRKYGDTVVPLTRVLCRPEVSYQQLLTEFPADVRDLGPIVGASLEMEIKYSGYISRQQTLIRSMERSENISIPEDIDYHSISALSLEAREKLSKFTPRTIGSAARISGISVADIQVLMVSLKKDAH

SEQ ID NO: 975 - protein, 472 aa, Chlamydia trachomatis
  VARIANT (1)...(472): Xaa = Any Amino Acid
MATQTKKPQPTQLLSLPNSKESEMIVLGCMLTSVNHLNLAANLLQEDDFYFLEHRIIFRVLQDAFKSDRPMDPHLTGEELKRRDQLNIIGGPSYLITLSEFAGTSAYIEEYAEIIRSKSILRKMIQAAKDIEKKAAEEPRDVTTALDDAQNLLFRISQTTNLAPYVLVADKLKGVASSKDKSFLLALQERQEAFQASAHDSSSPMLSGFPTHFLDLDRMISGFSPSNLIILAARPAMGKTALALNIVENFCFDSRLPVGIFSLEMTVDQLIHRIICSRSEVEAKKISVGDISGRDFQRVVSVVREMEEHTLLIDDYPGLKITDLRARARRMKESYDIQFLVIDYLQLISSSGNLRNSDSRNQEISXISRMLXNLARELNIPILCXSQLSREVEDRANHRPLMSDLRESGSIEQDADQIMFLLRREYYDPNDKPGTAELIVAKNRHGSIGSIQLVFEKDFARFRNYAGCEFPG

SEQ ID NO: 976 - protein, 187 aa, Chlamydia trachomatis
YVSLRWRLRIFKTSFRINVMRQFCNLLSLSRVWLALLFCQERIITRLLVIFAAMVSDVLDGYLARRYNATSRLGSILDPATDKIFFLICVGVLFWENSLGLTHLALIFSRDIFLVFFGFYLSWVRGWKGYDYRALSFGKFFTVVQFFILFGVTIGMEIPVLWLAPLVILGALYFLERVLDYRRHCLE

SEQ ID NO: 977 - protein, 535 aa, Chlamydia trachomatis
  VARIANT (1)...(535): Xaa = Any Amino Acid
NPFRSSGDXFFPIYRSEFSKFIPLFFLAFFVGVNYALLKTTKDSLVLVGSRAGAEVIPFLKVWGIVPGAVIVTMIYGWMSRRYSRGTVFISLVGGFLGFFALFATVIYPIGDALHLNKLAAKLQSILPPGGRGFVVMVQYWSYSLYYVMSELWSSVVLSTLFWGVANHITSVREAGRFYALINTGLNLSSVFAGEVSLWLGRSPVIAFPMAVDPWHEMLLNITLLIVLAGGVILYLYQKLDRLMDETSMLEEGLAAEMSVAQLKKEKKRSKAKAKSLFALLLRSRYLLGIAVVVLSYNLVIHLFEVVWKDQVCRIYASRVEFNSYMSRITTLTGIVSALAGIFAAGQTIRRWGWTVGALVPPLTILITGALFFGAIYAVKGDAMIFGGILGISPLVLTAWLGGVQNVFSRAIKFTYFDQTKEMAFIPLEDDEKNYGKAAIDGVISRVGKSGGSLVYQGLLIIFSSVAASLNAITIVLLLALGSWIFVIAWLGREYTAKTETLVRVNASEEDVLQEEREASSLVDAESREEPATTL

SEQ ID NO: 978 - protein, 346 aa, Chlamydia trachomatis
LFLMLKAINRFIRVCMKNFFRFLLKGFLSACGLFLGVIGAAGFIFVLSASVLGAGDGVLFVNFPNAQGVVQELGKTAPIIAVIDINDAIIASSGAAKRLQSALQPLNEAPYKGRVKGILVKIDCPGGEVFEIDRMCATLSFWKKQWGIPVHVFVSGLCASGGYYVACIADKIGTTSSSLIGSIGVRSGPYFNVKEGLQRHGVETAILTAGDDKAPLNPFSSWTEEEYAERQGIVDAFYEQFVDHVVKYRSKLSKEKLTKVLGARVFIAKQALEEGLVDAINQTQEQALEELAEACGIKDNYRVIGLGSGHFLKRFSSYLSNSPLVTGKLQVTALPDQQQKSLWYMG

SEQ ID NO: 979 - protein, 870 aa, Chlamydia trachomatis
VHMKKLFVLDVSGFVFRAYFALPEMRGPNGESTQAVFGFIRSLDKLIKDLSPEYVVAVFDGPNNKQSRQELYADYKSNRDRQLEDLPEQIRLVKQYCELLGISCLEEKGVEADDVIASITKKAVADGFEVCICTADKDLLQLVSSRVSVFNPWKEQEIQYNEVLLQFGVPPEQIADYLALVGDSSDNIPGVSGCGPKKAQALLKEFQSVEELVANTERLSGKTKQMIEDQKETLLLSKRLATLHMDLAFPLTTEEFAFSPQAIDSAQLNTFYLQHGFKALVKHSETATSSIAVQTVTDPVTLKTVLEQLKGGEVGYCAAYTGEHLPSLQLHGVALAGANQVFYIEVSGVQEIALLKDFFADKATQFFGYRSKRDNHALRNSGIDVHVTADLVLAEHLVSGGAKISFQTLLMESGHIQEAVFFSKEWGAGSLPVQSLPRDPAQYFGMFASKLLAIKNYLFVKLEEKGLKDIFETVEQPLEAVLFAMECVGMPLDSQGLAVLDRDLTKELEECSQEIYDLTGCEFNIKSPKQLSDILYQRLGIEPVASPKAKSTKAEVLEALEDRHEIIPKILMFRATEKMLSTYVRALPKQINAGTQRIHPTFNQVGTVTGRLSCQDPNLQNIPVRSERGRSLREAFRVKKDNDYFLAADYSQIELRFLAHLSQDETLKRAFNSGEDIHAFTASQVFNVPLEQVTKQERYQAKAVNFGLVYGQQAYGLSKILKISVSEAQGLMDAYFARYPLAAEFITQTIEQASKNQKVTTMLGRERILSDWESSPGARAASGRLAVNTRIQGSAAELIKLAMLNISDEMRSRGLKSRLLLQIHDELLFEVPAEELEEMRSLVQEKMESAMELSVPLVVNVLIGKNWAEC

SEQ ID NO: 980 - protein, 218 aa, Chlamydia trachomatis
VCSFSCECLNWKKLGGMLDLLKISVTGDPSSGKTEACQVFEDLGAYVISADKVSHSFLVPYTSVGQRIIDLLGPEIIIENTLSRKAIAEKVFGNRDLLLSLEEILHPEVCRFVEEKYAHVVQEQKYPLFIVEFPLLYEIQYADWFDQVILISADTGIRKERFLKKTGGSDTSFDLRCARFSSLEEKILRADVVIENNGTKEEFRRKVKQCFKALKGTI

SEQ ID NO: 981 - protein, 336 aa, Chlamydia trachomatis
MKEESPAEVLQKVKEHKRREGPLSLEKEVSEDSAVATEEKETSQPVAVTKIAKLQRMGINELNVLARQYGVKNVGSLTKSQVVFEIVKAKSERPDEFLIGEGVLEVLPDGFGFLRSPTYNYLPSAEDIYVSPAQIRRFDLKKGDTIVGTIRSPKEKEKYFALLKVDKINGSTPDKAKERVLFENLTPLHPNERLIMEIGKENLAERVLDLTAPIGKGQRGLIVAPPRSGKTVILQSIAHAIAVNNPDAELIVLLIDERPEEVTDMIRQVRGEVVASTFDEQPDRHIQVTEMVIEKARRLVEHGKDVVILLDSITRLARAYNTVQPHSGKILTGGVD

SEQ ID NO: 982 - protein, 128 aa, Chlamydia trachomatis
TSALHKPKRFFGAARNIEGGGSLTILATALIDTGSRMDEVIFEEFKGTGNMELVLDRHLSDRRIYPAIDLIKSGTRKEELLYHPGELEKVRLFRQAIAGLTAIDAMHLLLGRLKKTNSNTEFLLSLKD

SEQ ID NO: 983 - protein, 450 aa, Chlamydia trachomatis
NYFLWWRGQMAGRRTKEEQINRKRSHFYRDNVGVIVLCGGEGKRLSPLTCWRCKPTVSFGGRYKLIDVPISHAFASEFSKIFVIGQYLTYTLQQHLFKTYFYHGVMQDQIHLLVPERRDGSQVWYQGTADAIRQNLLYLQDSRVEYFLILSGDQLYNMDFRSIVDYAIDAQADMVIASQPVSDKDVSRFGVLKVDDESKLIDFYEKPQSEEILKHFRLSNTAMKKFGLDPQHGNFLGSMGIYLFRKDCLFQLLLEETGDDFGKELIHRQMHRGKTVAYLYDGYWTDIGTIESYYEANMALTQRPSHNIRGFNCYDDGGIIYSKNNHLPGAIISDSRISSSLLCEGAMIESGQVSNSVVGVRGVIGQGSVFDRSIMMGSDSYGSESFPLGIGKNCEIHKTIIDENCCIGNGVRLQNLQGHKDYDSPDGKLVVRDGIIIVPRGTQIPDNYVF

SEQ ID NO: 984 - protein, 252 aa, Chlamydia trachomatis
FFYQARGFMRIFALADLHLSLGVPEKTMEVFGEPWVGYHQKIEKHWRDIVSSDDIVCLPGDISWAMRLEEAQVDFRFLGALPGIKYMIRGNHDYWSSASSAKLANVLPETLHYLSKGYVLLNAHQAIVGVRLWDSSDICLHWETQHDGPQRVLTEQDDKIFLREYGRLERALKELPASVEDVLVMTHYPPVSNDGTPGRVSNLLEMDGRVSRCLFGHLHKVPRPFPGFGNIRGIEYTLVAADYVDFIPQVVS

SEQ ID NO: 985 - protein, 106 aa, Chlamydia trachomatis
LKILSGKFKGKSLKTFSNPSVRPTCGVVKEAVFNICANHIVGARFLDLFAGSGSMGFEAISRGAESATFVDSSVEAVRLIRANLALLDSNLPVHILKQDVRSAFYA

SEQ ID NO: 986 - protein, 278 aa, Chlamydia trachomatis
AKRNHSGWIKIFLLNMIRGSSLISEVRVKFKYLRPLSFLVLVIVAFCYGCSREKQEVLVGRDATWFPQQFGIYTSGINAFVNDLVSEINYKEGLNISIVNQDWVHLFENLDDKKTSGAFTSASPSIEMLARYQFSDPVLLTGPVLVVLENSPYHSLQDLEGKLIGVYKFDSSVLIAQNVPNAVIDSYQHIPVALALEALSTQRYDALLVPVIEATALVETAYKGRLRIASEPLNEEGLRLVVLRGGGSDSLLEGFNAGLAKIRRSGRYKAIKMQSRLP

SEQ ID NO: 987 - protein, 217 aa, Chlamydia trachomatis
  VARIANT (1)...(217): Xaa = Any Amino Acid
NKEFKETVVTYLLANFGGPRTSQEIVSFLQALLTDRDVTGGMIPSVLHRPLFSYIAKRRAPHVARQYAYLGGGSPIFQDTERLAQNLSQELQASVIPFHTYLPETHRETLQALQESQGSIVGIPLFPHYTFAVTGSIIRFFLQHLPEKPISWITQFGVHPQFVSCMQQHIRDCLAAQXIAVEDCYFLFSVHGLPQRHIRLGDPYAQQCQASFEALRR

SEQ ID NO: 988 - protein, 121 aa, Chlamydia trachomatis
EILMLSNVRLLSKHYGGELEGEIAFQSKFGIGKWLDPSTQEVCQSLRTKKRYIVIVPFGFVSDHIETLYEIDHLYVPILLQKEYRVVRIPAINASSRWVSSLAAIVRSSPQETSLEPLLMP

SEQ ID NO: 989 - protein, 339 aa, Chlamydia trachomatis
ECGISMKSRNAQSILESLCKKTHRLLLRYLLKQTLLVALGMTLMVAELGIFLYFFLFSGKTLLPAFCLACFVLTIFICLVIRLYILSKKTEFFDKLLADFVHQAQVIFKKKNMMEEHPEIAAAVTQLSLVMQNQEYFVFCNLLKIVPPYDSIKKFSCFCFWKDYFSFREMLLQKAIDLYLLVVQAIPTDLGAHVSLADAYVSLSGLYADPRKYTEFDTKYWVPPGRYGEDIQEKFFATAHRATEEFKILNEYAPGNVWVHTQLAYSYHDLQMPKKEIREYEIVLKLKPHDANTIMKLGILYFQQGMNAKGLQVYEQLRKVASPLKKSKKLIKFYGVVAK

SEQ ID NO: 990 - protein, 228 aa, Chlamydia trachomatis
RTVCFYRVRKTMFEILRKKISSYSVVLFCLVVLSIFLSGKIVVNVKTYRVERQNSLVLLSRSVEAAYSRGIFPPETAMPMLEQAYRRGGKEAVSYAGFLASCFHIHNDPLRGAYYSGLAYQHGTHLQLPSPQHILLKEIADAHATKQYQEVLDKSRELLSSISSSKDFPMLRFLTLLRMIEVKESLNQDFSLELTELKALPGFEDYEQLYKDGVWTISKRYSSLRALY

SEQ ID NO: 991 - protein, 246 aa, Chlamydia trachomatis
SMLRVLAYRQVSFSKFPHLFKSFVSLLSSLKQHYSFMLPGDPLPKKKALMLTFDHASVDFYTHVFPLLQNLQIPAVIGVAWRYVADLEGEDLPIDVARGIAPSDFLAFQDEIFSYHQPFCSVRELCHMAASPLVRFASSGFAIRNLKYAPPYLDTEILLSKILLENAIQSPVESFFFPLGKSDVVSQHFVQETYRYSFVLGNTASFSYPTQSLHGIPRIDMPLDSQRVPSLYQLSYRHLKQFLVLR

SEQ ID NO: 992 - protein, 731 aa, Chlamydia trachomatis
RRQRMIDKIIRTVLVLSLFLLYWSSDLLEKDVKSIKRELKALHEDVLELVRISHQQKNWVQSIDFSVSPEISVLKDCGDPAFPNLLCEDPYVEKVVPSLLKEGFVPKGILRTAQVGRPDNLSPFNGFVASNIVRFYELCVPNLAVEHVGKYEEFAPSLALKIEEHYVEDGSGDKEFHIYLRPNMFWEPIDPTLFPKNITLADTFLRPHPVTAHDVKFYYDVVMNPYVAEMRAVAMRSYFEDMVSVRVENDLKLIVRWRAHTVRNEQGEEEKKVLYSAFANTLALQPLPCFVYQYFANGEKIVPEDSDPDTYRKDSVWAQNFSSHWAYNYIVSCGAFRFAGMDDEKITLVRNPNYHNPFAALVEKRYIYMKDSTDSLFQDFKAGKVDIAYFPPNHVDNLASFMQTSAYKEQAARGEAILEKNSSDRSYSYIGWNCLSLFFNNRSVRQAMNMLIDRDRIIEQCLDGRGVSVSGPFSLCSPSYNRDVEGWQYSPEEAARKLEEEGWIDADGDGIREKVIDGVVVPFRFRLCYYVKSVTARTIAEYVATVCKEVGIECCLLGLDMADYSQALEEKNFDAILSGWCLGTPPEDPRALWHSEGALEKGSANAVGFCNEEADRIIEQLSYEYDSNKRQALYHRFHEVIHEESPYAFLYSRQYSLVYKEFVKNIFVPTEHQDLIPGAQDETVNLSMLWVDKEEGRSPLYLKTSAFDSLNALCYHLCEFCDSQCCSRRPA

SEQ ID NO: 993 - protein, 494 aa, Chlamydia trachomatis
DLRYILKRLLLIPLTLFAIISVNFVILNAAPGDLLEEHSVDAQGEAGRSDKIRTYKGPDRYLQFREHYGLTLPIFFNTRPQISRSELRAGIQEIIDGTIHKKSKTGSITNIKVYWGDCAKFIMPALLAEAEDSSKEDIYRHVAADLFIRGGIRQGIVEPRLLEEQREYNQKVSKSNAELVRLLNEDNIEVKVALAALQEWVEQEGGRGQLMRRDLWRIFFLETRFAKYLSRIVRLDFGTLRNDCHKTVVSEVIKRLGSSLILSLLPMIVVFILCQVFGMIMAVNKNHWIDHLLNFLFLILFSIPVFVAVPWIIDNFVLNKTVPFTSISMPYSGLCSSPEIFKEMTSFEKLTDIVLHSFLPFCAVSYGAFAAQSRLSRAVFLEVLGEDHISALRARGISQYDILVRHVGKNSAATLITSLASSLSALLGGALVVETLFDIDGFGKFFYQAILNRDHNVVMFSVIMGSVISLIGYLIGDICYVLLDPRVQLEERKV

SEQ ID NO: 994 - protein, 584 aa, Chlamydia trachomatis
KKGRCEMKEPQTSYQRFFRAYNRRALPSIALKFFIGLMLIGIYAPLFASSKPILVRWHGEWYSPLFRYLLFPGFYTKSIDLFFNVLMLTLPFFILGFRYLSGVWKKLFLGVVTGIHIAVFSFALSGRVQDPCRDELLKQKRAKHLQQELKTTPKTEFLPTIAKRTRTWESERAYMSKYEQLGMLVKAKYRKMQHDHLEKQREAYELCKQSPMPTLRFLEMKNETASLRFFKNKINKLKASYPEGFEGWGTLLEDYRPYLMARARSEHALNMAIYEQHPQEELRAAFEALEEKEAPFREQLAFVRSLLEEREALNNSITFIMDKRNWIETESEQVQMVLNPLLSSFHWEDDAGGSREMNKYVHWWQLTRINRKDLLASLIFGIRIAIVVGGLGVSIALFIGIIVGLLSGYFGGKVDMLLSRVTEIWETMPMLFILMLVVAITQKKSLILDSVLLGCFGWVSISRYVRIETLKQRNLGYVLAATNLCYSHYHIMVHQILPNVIVPVISLLPFSMMAMISCEAGLTFLGLGEESSASWGNLLREGVTAFPSESAILWPPAIMLTLLLMAIAVIGDGIRDALDPKMQD

SEQ ID NO: 995 - protein, 170 aa, Chlamydia trachomatis
MAEKFFVVSPTSKNCLAQACSQGLPINRTPPIQIIVHFRGDSIFHSRLSPAPVFTCLFLGPGAHKAMEGLVRWCEAYANKMPPKLSFLDLSSFKEKRLAILQEIRQIPFGTRHTCEEIAERTKTHTEEVLIACQENPLPLLIPCHRVLSIHDYPGGEKLYKALTEFEELS

SEQ ID NO: 996 - protein, 363 aa, Chlamydia trachomatis
EISQHRTRQLMKRLFFICALALSPLAYGAVQKDPMLMKETFRNNYGIIVFKQEWNKRGCDGSITRVFKDGTTTLEVYAQGALHGEVTRTFPHSTTLAVIETYDQGRLLSKKTFFPNALPAKEAVYHEDGSFSLTRWPDNNNSDTITDPCFVEKTYGGRVLEGHYTSFNGKYSSKILNGEGVRSTFSSDSILLTEESFNDGVMVKKTTFYSTREPETVTHYVNGYLTEFGLPIFLVGFQIRLKNGDMDIKTALQSYLKMVVRLLKSHLYAEQKMESNSDTMNKRISLKRFLGSTTSCMESAKSMRRGYANPNGITKANLSRKSSLNDSVPPDNSTLGASWLKSSLLSLQRPRTVWPRLALKGFL

SEQ ID NO: 997 - protein, 132 aa, Chlamydia trachomatis
WRNGQKNDILLDSRTRNRHSLCQWVPHGVRFTYLPGGIPNTIEEWRYGHQDGLTILFKNGCKIAEVPFVRGAKNGIELRYNEQENIAEEISWQHNILHGVRKIHAAGVCKSEWYYKGKPVSQIKFERLSAAR

SEQ ID NO: 998 - protein, 794 aa, Chlamydia trachomatis
MLVPLSLLQKFFSSPLSIEEILQACDRIGIEAECSNVFPDSLNTVVTGKILSASPHPDAERLTVALAIVFDGKGKRQIICGAPNCRAGIIVPIALPGAKLRNASGEITTIKKAKIRGLESQGMCCGADELGFPHLQKAQRGIFEFPADTPLGESACMLLAGASLECSLTPNLGHCASLLGLAREISFLSPVSLNIPEEFSFASLPQETSICDMHDAGACPVFYSVKISGLSCRRSPEYLQAALTALGQKPLNAIVDITNYVMLSLGQPLHAYDSQAVEQKSLHAATLQSAQPLTLLNQETYTLPAGSLVVADQHNILGLAGVMGSAASSCSENTTEIILEAAYFQPQAVRKYQRTIQLHTEAAYRFTRGVASPPQGVLPALHAAIHMIQSLFPDAQISPIQKIGDDSFFPLSLSVRPKTIKRLLDIELSTAEIVAKLFSLGFQTAVEEQAVRVEVPSYRHDIQEETDLVEEICRTTPFVQKTQKILPTYTPIYSLKRELTAFLANGGLQQFFTCSLLDTEVSSLSLQESSLIPVQNSSWKLRDSLLPGMLKSAATNLHRQAPYVYAFEIGNVYSKEQNRYQEEERVAILLSRQVMDDSWQGKTPLSFYTIKGWVEKLLCQSGASIEDFSLQPSQHPNFHPYQQAALYQKKHLLGIFGTLHPQLCRKAQIKHDVVFAELSLNVLLSLKKKSGPHYVPYPIYPASSRDITITIDRDLPADLVRRELLSFESKWLESVHIVSVYQGRDSASQSKNVSLRMVFRDHERTLSGQEIEEEYERLTALLDKKLANIGQGNS

SEQ ID NO: 999 - protein, 256 aa, Chlamydia trachomatis
  VARIANT (1)...(256): Xaa = Any Amino Acid
ILRSGVYSSKYFEGEGCRSFMGIEGRGSGAMQSKKTIKWLKQALVLSSIVNILLLLLIYSTVFRKDIYKLRVFPGNLIAKSSRIGKIPEDILERLENASFADLLALLXEERMVFGHPLKSWAQGVSIQKYFVDIAPMLTHXLTFIKLKSPERTWLLPDINDQEFTRICQYLLTXRFPFSSRGFFRIMVRDCEAGVVDEDVLYRFCHLPEFLYVRSLLFGAEIEAASVASLARMIIQGGEDLFFSLCCLENRQTADF

SEQ ID NO: 1000 - protein, 279 aa, Chlamydia trachomatis
DTLPFNDIDVISTMRCSAYCTASSYHLHVLFHLLKVNYPSVLSREYVLISSEELDESDKAAVFFPFGVCVFWGWEETEELQVIRAITPSAVNPLPNPEIDSYDFHYGEKLQIRRDRLVLTNSNLNTKLAISFGLAQSIKLTVFEETIYKTVENSKSLPQELASKGKISLSRKTIAKKIGELFLDKASVNLHSDILDEPDFFWEHPETQPFYINVLTCLDVNARVASNVLNHRLAILGDVLEILNDQLNHQHSSALEWTVIWLIALEVLVTLLKDVFNII

SEQ ID NO: 1001 - protein, 206 aa, Chlamydia trachomatis
SFVSFVMEKRGVIVHILVCLLTIFGTLSLPAFGAHFLAEEEQFYMDRFVFSGQYPDMETMEIHAERKKRVQFDVTGSFPKLESVVYKGSFGLLRSKIKGECPELSSVNLSCTSCRMDLDFRGEWKKNASIYIRNEQEPITIMLPKDIGVVVYTQVDMNSKVVAEGSLIKRGRGFWKKTFRNSLVGESPVTLTFHVETRNGGVIFLR

SEQ ID NO: 1002 - protein, 280 aa, Chlamydia trachomatis
RKLSAHRFFIPKDKNIRFLPRDSFIFSTDELLYPYIFMQITLPGVVLTNSPAEKQHVIVKIFSPAGLLSAFAKNGASLSCDFRESLFPISFSLFTIQQSPPKMRKVIQGELQNPFTTIKSSYPLLQSAGKMIQAILKTQWHEKPSPHLFSLFFNFLQRIPETQYPNFFSSMFLLKLLQHEGSLDLSRSCTLCKTSLESSTIYRYEGALFCEKHAHEETISFSQEEDHILRVIVQAKKFQELVCLAEFPIDIDTKIDALFSSFLSETSEPSSLYYKGKTLL

SEQ ID NO: 1003 - protein, 386 aa, Chlamydia trachomatis
  VARIANT (1)...(386): Xaa = Any Amino Acid
MSIEHILIIDDDPHILALLSEILGARNFSVSSAPGVKQAIKQISNCPFDLIISDMNMPDGSGLDIIQYTKQHRPQTPILVITAFGTIQNAVEAMRFGAFNYLTKPFSPDALFTLIAKAEELQALQQDNLFLQSQGSSISHPLIAESPSMKQLLDKARRAANSSANIFVHGESGCGKENLSFFIHKHSPRSTKPYIKVNCAAIPDTLLESEFFGHEKGAFTGATTKKVGRFELAHQGTLLLDEITEIPIHLQAKLLRAIQEQEFXHIGGIKTLPVNIRFLATSNRDLEEAIETKVLRQDLYYRLSVISLHIPPLRDRKEDILPLAHYYLEKFCKMNNKPPKTLSLEAQRNLLDYSWPGNVRELSNVLERTVILENDPAITPSMLALL

SEQ ID NO: 1004 - protein, 261 aa, Chlamydia trachomatis
EKENWELMPKIDTCDSCVSNTELLAIRTRVTQSYNEAQTILSSIPDGIFLLSESGEILICNPQARAILGIPKDIQLVTRRFHDFFPDTFFGFSVQEALEKEVPPKTIRLTLSQELSQKEVEVFVRKNISHGFLFLLIRDRSDYRQLEQAIEKYRSISELGKIAATLAHEIRNPLTSISGFATLLKEELSSERHQRMLNVIIEGTRSLNSLVSSMLEYTKIQPLNLRSIDLQDFFSSLIPELSLTFLLVHLEEPSYLLYSAL

SEQ ID NO: 1005 - protein, 222 aa, Chlamydia trachomatis
AFFHSAGNFMNLILLLTLCLSSLLSGCSTDNRQTSYIEAARITTQSSGSLILYPVIEPRSAPTYHWPTPKSPVITNYSFHCHGTSGSLSTEETLVFDCNGIKHLAKPFSIHPLLVTIAQYIHHHFPITIEEGYCCPMHYKFLLTSDTSISEQHCKGLAAIVSTQQPVSPQMLAPILSKLYRGLPLPSKTFTLSHNTIQNEDFIITSTFKKGKPVLVIEVHHE

SEQ ID NO: 1006 - protein, 267 aa, Chlamydia trachomatis
MTKKIVLQIAYQGTSYSGWQYQPNALSIQEVLKTILKKIAGFRISVISSGRTDAGVHAQGQIAHFHCPDHPHFTDPRQIQKMLNALLPHDIVIRDAVMTDGDFHSRFSAIAKEYRYTLSLLPKPLPHHRLFCFSPRYKLNIARMQEAAQYLVGTHDFASFANLGREYSSTIRTLYTLDLSEQEHLVTVICRGNGFLYKMVRNIVGALLDIGKGKYPPEHLLDMLATKDRRKGPPSAPPYGLSLHHVCYPPPYQWFCKHEHNNSSEGK

SEQ ID NO: 1007 - protein, 222 aa, Chlamydia trachomatis
GASMNLSCSLVLLGGGKGERFNSLQPKQYTHLCGEPLILHALHAYQRLPFVQEVVVVCEEQYRELFLPYSVKFASPGTLRQDSVFSGLQQVFTPWVCIHDGVRPFVYADEVIEVCSAARKTGAAALASPATYTIKSCAPVRTLDRDALAVIHTPQCLDTEVLREGLLLARAMDFSLSDDTEAAELLGIEPTLVFSNRVQIKVTYPEDLLFAETLLSKSSTYK

SEQ ID NO: 1008 - protein, 329 aa, Chlamydia trachomatis
LFVFVGITVSLTTILAAPLLTWVWANHLEPNLLRVTRLNWNLPKKFAHLHGLRIVQISDLHLNHSTPDAFLKKVSRKISSLSPDILVFTGDFVCRAKVETPERLKHFLCSLHAPLGCFACLGNHDYATYVSRDIHGKINTISAMNSRPLKRAFTSVYQSLFASSRNEFADTLNPQIPNPHLVSILRNTPFQLLHNQSATLSDTINIVGLGDFFAKQFDPKKAFTNYNPTLPGIILSHNPDTIHHLQDYPGDVVFSGHSHGPQISLPWPKFANTITNKLSGLENPELARGLFSFPEESRLLYVNRGLGGWKRIRFCSPPEICLMRCLYEP

SEQ ID NO: 1009 - protein, 91 aa, Chlamydia trachomatis
ESSMSQNKNSAFMQPVASNVSADLAAIVGAGPMPRTEIIKKMWDYIKENSLQDPTNKRNINPDDKLAKVFGTEKPIDMFQMTKMVSQHIIK

SEQ ID NO: 1010 - protein, 104 aa, Chlamydia trachomatis
VYRQNKKHSQVFSKKRGKSELENDLFLGLLRKKLIPKRRSCYHERVLAVTATVIVEITGKENSSLKKKSLKLDILRKVSKIMHENFDKRLEVLLEGLALTRRSL

SEQ ID NO: 1011 - protein, 250 aa, Chlamydia trachomatis
  VARIANT (1)...(250): Xaa = Any Amino Acid
LGGLFDPEGKENELKELEQQAVQDGFWDDVARAGKISERIARLKQQLSEFNELKNKVSTIQFFLEDEESSKDLEMQKELEKEFVFCEKKITEWETLRLLSGELDRNSCFLSINAGAGGTESCDWVEMCCACICDGLVVISWRVEVIDRLDGEVAGIKHITLKLVGEYAYGYAKAESGVHRLVRISPFDSNAKRHTSFASVEVFPEIDDKIEVEIHPGDIRIDTYRSSGAGGQHVNVTDSAVRITQXLREL

SEQ ID NO: 1012 - protein, 91 aa, Chlamydia trachomatis
SNSKPRSLYEYLRARIYQKLLQERLEKQNIDRKNKKEISWGSQIRNYVFQPYTLVKDVRTGYEVGNIQAMMDGELLDAFIKAYLVDYGEIT

SEQ ID NO: 1013 - protein, 172 aa, Chlamydia trachomatis
LWRNYMTTMRDPLLEIRYTVPEDAHYMRLWLNDPKILRGFPLKTEAEIRDSVNFWVSFYRCRSSLTAVYNGEVAGVATLILNPYVKVAHHSLLSIIVGEKFRNKGVGTALLNNLLHLGKTQLKLELVYLEVYEGNPAIHLYERFGFVEVGRQKTFYKDELGYLAKITMERVL

SEQ ID NO: 1014 - protein, 122 aa, Chlamydia trachomatis
MAGHSKWANTKHRKERADHKKGKIFSRTIKELISAVKMGGPDPKSNARLRMIIQKAKDQNIPNENIERNLKKASSADQKNYEEVTYELYGFGGVGIIVEAMTDNKNRTASDMRVPLTNEVGL

SEQ ID NO: 1015 - protein, 133 aa, Chlamydia trachomatis
EPHSLGYARTVNKRGGALVEPGSVLYNFSRKGACYVPKHSIDEASLLTHVIDCGGEDLDSDDEEFFLVLCEPTDLASVKEALLAKGVTCSEERLIYVPLRLVDCDEETGKSNLALIEWLENIDDVDDVYHNMA

SEQ ID NO: 1016 - protein, 605 aa, Chlamydia trachomatis
  VARIANT (1)...(605): Xaa = Any Amino Acid
VTQKIRVVVQQQHSILYRGSSYTTGPRNEGVFGPGPEGLPDMSLPSYDPTNKTSLLTFLSNPHVKXKMLENSGHFVFIDTDRSSFILVPNGNWDQVCSIKVQNGKTKEDLDIKDLENMCAKFCTGFNKFSGDWDSRVEPMMSAKAGVASGGNLPNTVIINNKFKTCVAYGPWNSREASSGYTPSAWRRGHQVASNFGEIFEKANDFNKINWGTQAGPSSEDDGISFSNETPGAGPAAAPSPTPSSIPVINVNVNVGGTNVNIRDTNVNTTNTTPTTQSTDASTDTSDIDNINTNNQTDDINTTDKDSDGAGGVNGDISETESSSGDDSGSVSSSESDKNASVGNDGPAMKDILSAVRKHLDVVYPGDNGGSTEGPLQANQTLGDIVQDMETTGTSQETVVSPWKGSTSSTGSAGGSGSVQTLLPSPPPTPSTTTLRTGTGATTTSLMMGGPIKADIITTGGGGRIPGGGTLEKLLPRIRAHLDISFDGQGDLVSTEEPQLGSIVNKFRKETGSGGIVASVESAPGKPGSAQVLTGTGGDKGNLFQAAAAVTQALGNVAGKVNLAIQGQKLSSLVNDDGKGSVGRDLFQAATQTTQALSSLIDTVG

SEQ ID NO: 1017 - protein, 134 aa, Chlamydia trachomatis
GSSVLTRSPCPSKDMSKCARIRGSSFSNVPPPGIRPPPPVVIMSALIGPPIIKDVVVAPVPVLNVVVDGVGGGEGSSVCTLPLPPADPVEEVLPFHGDTTVSWDVPVVSISWTISPRVWLAWRGPSVEPPLSPG

SEQ ID NO: 1018 - protein, 323 aa, Chlamydia trachomatis
FVVMTNSISGDQPTVTTFTSSTTSASGASGSLGASSVSTTANATVTQTANATNSAATSSIQTTGETVVNYTNSASAPTVTVSTSSSSTQATATSNKTSQAVAGKITSPDTSESSETSSTSSSDHIPSDYEPISTTENIYENIYESIDDSSTSGPENTSGGAAALNSLRGSSYSNYDDAAADYEPISTTENIYESIDDSSTSDPENTSGGAAALNSLRGSSYSNYDDAAADYEPISTTENIYENIYESIDDSSTSGPENTSGGAAALNSLRGSSYSNYDDAAADYEPISTTESIYENIYESIDGSSISDPENTSGGAAAALNSL

SEQ ID NO: 1019 - protein, 428 aa, Chlamydia trachomatis
MPGIKVFGETVLRGSVARGVSGAKNATTKLLVASLLSDQRTILKNVPNIEDVRQTVDLCRVLGAIVEWDQQAQVIEIHTPRILLSKVPPQFSCVNRIPILLLGALLRRCPYGIFVPILGGDAIGPRTLHFHLEGLKKLGAEIVISDEGYWASAPNGLVGAHITLPYPSVGATENLILASVGAQGRTIIKNAALEVEIIDLIVFLQKAGVEITTDNDKTIEIFGCQDFYSVEHFIIPDKIEAASFGMAAVVSQGRIFVEQARHEHMIPFLKVLRSIGGGFSVHENGIEFFYDKPLKGGVLLETDVHPGFITDWQQPFAVLLSQSEGCSVIHETVHENRLGYLKGLVKMGAHCDLFHECLSAKSCRYSTGNHPHSAVIHGPTPLQATDLVIPDLRAGFAYVMAALIAEAEPHGLRIPRCWIEGTLIGEGN

SEQ ID NO: 1020 - protein, 209 aa, Chlamydia trachomatis
  VARIANT (1)...(209): Xaa = Any Amino Acid
WRIQLRNNRCRSYAYRIQQDQADRILIVTDSGQSLHFQLLEATCLAAGYLPSKGIFSHVGFGLVLDTQGRKFKTRSGENIKLRELLDTAVEKAKESLKAHRPDISEEELAYQGPILGINAIKYADLSSHRINDYVFSFEKMLRFEGNTAMSLLYAYVRIQGIKRRMGLESLPQEGPLAIHEPAEEALXLLFYVSLKFWTSPSENSVLXS

SEQ ID NO: 1021 - protein, 337 aa, Chlamydia trachomatis
MTTLLSFLTSLCSAAIHQAFPELEELTLDITPSTKEHFGHYQCNDAMKLARVLRKSPRAIAESIVAHIPPAPFSSIEIAGAGFINFTFSKEFLASQLQTFSKELANGFRAASPQKVIIDFSSPNIAKDMHVGHLRSTIIGDCLARCFSFVGHDVLRLNHIGDWGTAFGMLITYLQETSQEAIHQLEDLTALYKKAHARFAEDSEFKKRSQHNVVALQSGDAQALALWIQICSVSEKSFQTIYSILDVELHTRGESFYNPFLAEVVADLESKNLVTLSDGAKCVFHEAFSIPLMIQKSDGGYNYATTDVAAMPIASNKIRPIEFLSLQTQDNPYTSSF

SEQ ID NO: 1022 - protein, 235 aa, Chlamydia trachomatis
FDNKPNSGENPTFDTLPFNMIFTIAKSLVRLLFPLFYRRKILRSKASATVKGAAIIAANHVSFLDPIIIPLAFPGKLYQLAKSGLFSNSFTNRLFRELGCYPISRNAGNAAAFKAALNIFSHGGRLIIYPEGTRHADGEIHQGKVGVGMLAIKGNVPVIPVYVAGTFEAFGKNQKFPKLWRTLTTVIGSPISFQDLIDNPAIDKKEAYQLATDRIMTKITELRTWFQQGCIGEIP

SEQ ID NO: 1023 - protein, 216 aa, Chlamydia trachomatis
MIITIDGPSGTGKSTLAKALAQTLQFLYCNTGAMYRTLAYARLQPDWQEVPLEDFLASPPFSFSFSKDSPLQAFYGDRLLTSELSSQEVANFASLFSKEPLVRAYMQTLQKQYATVGNCVFEGRDMGSKVFPHAEVKIFLTAKPEIRAERRLKDLPQGSLPKEALMAELIARDQADQQRECDPLVIPQDAIVIDSSDLTISQILEKILPLIPSHLT

SEQ ID NO: 1024 - protein, 305 aa, Chlamydia trachomatis
MFDSDHNSIFQSDLCQRLVVHSILLTFLVILLCTSLYPSSAFIVGLLSSACAALGTYEMGAMVRIKFPFSFTRYSALGSAIFIALTCLTARCKMYFPEHIDLLPWFFLFFWTIRLVFKSRHYKLGPIGSTGLALFCMLYVSLPIRLFLHILYGFVHTDTPFVGIWWAIFLIATTKSSDIFGYFFGKAFGKKRIAPVISPNKTVVGFIAGCCGSILVSLLFYSHLPKAFADQIAVPRILVALGTVLGVSGFFGDIIESTFKRDAQIKNSSDLESIGGMLDVLDSLLLSTPIVYAILLITQNRTFLG

SEQ ID NO: 1025 - protein, 170 aa, Chlamydia trachomatis
  VARIANT (1)...(170): Xaa = Any Amino Acid
IEIGSRRIIFFIQLAVALAQXLSFLHDREIRLRCIGDLSKLPQELQNNIEQASSATAHYSRMELIFAINYGSKDELVRAFKELHQDLASKKISVNDISEELISSYLDTSGLPDPDLLIRTGGEMRVSNFLLWQIAYTELYVTDVLWPDFTANDLLEAIKTYQQRSRRGGK

SEQ ID NO: 1026 - protein, 106 aa, Chlamydia trachomatis
  VARIANT (1)...(106): Xaa = Any Amino Acid
TILSETCYIWPPSGADSIPQIVDTALHLGVEALTLFAFSTENFSRSKSEVAELFSLFNSQLRRXSLSYMIGRSDYGVLATYRNFLKNYKTTLSKPPPRQLITPAWS

SEQ ID NO: 1027 - protein, 113 aa, Chlamydia trachomatis
DMKLPEVSFSLPTAVWASSTKRLSQEKEFSSLDRVQSMNWVQRIVPSLIVLLGISVLGCSVLAFCTCLTVLPGLGLVILGSLLLYWAYHQIANMRVARGMALSFEASSEAPIQ

SEQ ID NO: 1028 - protein, 1254 aa, Chlamydia trachomatis
  VARIANT (1)...(1254): Xaa = Any Amino Acid
XXXWTRGSQDYRXFTRQVSDARNDLTLRVAKILSTLKLRGDIKXHPSIPGIVNVHFPLAEDAALFIDNVVHGEPSVPVKSARLYVVGSSEFTGETVVQISGSLVTSLTEEDLSFVSYEDKDVTVSQELENLATNLFIESERPCECGYYSLWDSMPIEKVIHVTRNICSGLRLLPTRKTQVFLSRCLGTERDFTAFLARLEKALQHEEVKEAREELKDASYLLHSRNLRWNSISPKVVGNVVDCSELSPCFSSMSLTADGKLLFHFDAEVAANRQQLVGNERLDLERLFAMEKQHIATRLNRSVEETEFGFAVRLRDEAASGKIVLQGHRVCQRIVEHLTALVLNRPLAETCDLSTENFPVYGREPLDSDALGCFIFSPERSCRHFSKGSVYIVFKGLRSIVAKYEHAGAEEAALLQHDLQNLYACFIHTDAVSWSLGEDRVLEIKEPLQRVIRIWGEEFVQSFGKASLEVRDVRDRLAVVASNRIEKTQHAELVRWDEQYRQAQCSMNPQVRLRAAIPHKNVFFENLKLNIRKYSRGEHVLRFGTDFVGGKQIRIAFRDHQGNLLTDKAGIDKVSDELYARLNKLGVSEVGMQREGDHIQVSVPGAAGISSADILGTSKMSFHVVNEQFSSRSPLRYEVQTFLDYLWFTARSLDECSPQAINRLAGALFHGDNGSAPANVRVAVEKLREAGLSFSKELEGGSASLDTQYSMIAIEKESREQVASNPLMIVFRNHALEGASLKNIRPEFAVGEGYVLNFGVKDKATFSDGRETPVQQFHAWTSKFCQEGVSGTKNGLFSGGRGWRMAVVLDGYVISDPVLNVPLKDHASVSGXFSYREVHRLATDLKSGAMSFIPEILSEEVVSPELGSSQRVQGILSVVLGLVVLIVLMSVYYRFGGVIASIAVLLNLLLIWASMQYLDAPLTLSGLAGIILAMGMAVDANVLVFERIREEYLLTRSLSESVEAGYKKAFSAIFDSNLTTILASALLLMLDTGPIKGFALTLIIGIFSSMFTALFMTKFFFVIWVQKTRETQLHMMNKFIGIKHNFLKECKRLWVVSGVVLVLGCVGLGFGAWDSVFGMDFKGGYALTLDSDVCEYNPEQMCSVLRKRFQQIGLSSRDYRVRRADSSGKVKIYLSQNALDRVEQIEGAGSEQKGSDYHLARVLQVLSDSGSSTTSMVFDASRGSWFKVSGQLSNKMRTQAVIALFGALGIILLYVSLRFEWRYAFSAICALMHDLLATCAVLVALHFFLQRITD

SEQ ID NO: 1029 - protein, 126 aa, Chlamydia trachomatis
LPYISFCRELQIDLQAIGALMTVLGYSLNNTLIIFDRIREDRREKLFTPMPILINDALQKTLGRTVMTTATTLSVLVILLFVGGGSIFNFAFIMTVGILLGTLSSLYIAPPLLLFMVRKEEQNSLR

SEQ ID NO: 1030 - protein, 142 aa, Chlamydia trachomatis
SSHNFRITYAQAYFIIYRREFCSSLRTMNKRSGGAMYNEDSVPNKIPTVIMNAKLKIEPPPTNNKMTSTDRVVAVVITVRPNVFCNASLIKIGIGVASNSFSRRSSRIRSKIINVLFKEYPSTVINAPIACKSICNSLQKEM

SEQ ID NO: 1031 - protein, 127 aa, Chlamydia trachomatis
QEFSSGRYMEKGSLSSLGQKWDYPKHNEVFLKKILKEFHLHPAIAQVLISRGFQSIQEIRDFLYPQLSSLHSTSLFLDMEKAVARLLQAKANNEHVMIYGDGDVDGITGVTLIVEFLQILGVKTSYC

SEQ ID NO: 1032 - protein, 477 aa, Chlamydia trachomatis
ISTNTWSENKLLLTGTLFKQHGETASLISQMLQDGISLLITVDCGITAGKEVQAINKQGIDVIVTDHHMPTGKLPHCIAMLNPKLDKNPYPNKELTGVGVAFKLVCATYEELIQQDASWKDKIDLLRFLDLVSLGTIADVGRLSGENRILVSYGIKEIAKGKRLGLKKLCSLSGVDKSEVSSTNLGIRITPKLNSLGRLADSSQGVKLLLSQDPKNIGTIVSELSAVNQERQRIEAEVLRDVERILAANPKLTAQSAIVLASPNWHSRVIPIISARLARTYNKPVAIIALQDGIGKGSLRTIGSFPLLGVLRKCESFFLSYGGHDFAAGLMIKEDQVEGFRKKFIHLVSSSLRKDDAMRTLSLDVGMDFSRINRDLIASMELLEPFGKGNVSPVFYTKAIQVRYPKLLAGNHVKLYLNSGERNLEGTAFGQGDKISLLKANWNIPLDIAYTLRIMRRSARGAIRLLIQDFRIQIPRL

SEQ ID NO: 1033 - protein, 192 aa, Chlamydia trachomatis
VDERGLNSRMECLQQDTGVEAEQVQVQQQEENAVPVTSQRVSITQAAKLHNVTRQAIYVAIKQKKLKASKTTRWEIDLQDLEDYRRNRYSRAKSTYQGELLFDNEKGFYSVGQVASMLDVPEQKIYYATRIGAMKGERRGSAWVIHVSEVDRYRNDYLKKEAERKGKSLAAMREGFEALGADLLADAENFIS

SEQ ID NO: 1034 - protein, 463 aa, Chlamydia trachomatis
MTVQNVRVRVAPSPTGDPHVGTAYMAQFNEVFARKYNGQMILRIEDTDQTRSRDDYEANIFLALKWCGIRWDEGPDVGGAYGPYRQSERTEIYKKYAEILLQTDCAYKCFATPQELQEMRAVASTLGYRGGYDRRYRYLSPEEVARGQREEQGQPYTIRLKVPLTGESVFEDQCKGRVVFPWADVDDQVLVKSDGFPTYHFANVVDDHLMGITHVLRGEEWLSSTPKHLLLYKAFGWEPPQFFHMPLLLNPDGSKLSKRKNPTSIFYYRDAGYKKEAFMNFLTLMGYSMEGDEEIYSMQRLIEAFDPKRIGRSGAVFDIRKLDWMNKHYLNHEGSPESLLQELKGWLWNDEFLLKILPLCQSRITTLADFVGLTSFFFTAIPQYSKEELLPSSLKQEQAAVMLYSLVKYLEKKDLWEKDFFYQGSKWLAEAFQVHHKKAVILCYMWLLLVQNRDFLFLIRWNY

SEQ ID NO: 1035 - protein, 88 aa, Chlamydia trachomatis
MKKTALLAALCSVVSLSSCCRIVDCCFEDPCAPIQCSPCESKKKDVDGGCNSCNGYVPACKPCGGDTHQDAEHGPQAREIPVDGKCRQ

SEQ ID NO: 1036 - protein, 557 aa, Chlamydia trachomatis
MRIGDPMNKLIRRAVTIFAVTSVASLFASGVLETSMAEFISTNVISLADTKAKDNTSHKSKKARKNHSKETPVNRKKVAPVHESKATGPKQDSCFGRMYTVKVNDDRNVEITQAVPKYATVGSPYPVEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINVVASNQGTATARNVVVENPVPDSYAHSSGQRVLTFTLGDMQPGEHRTITVEFCPLKRGRATNIAMVSYCGGHKNTASVTTVINEPCVQVSIAGADWSYVCKPVEYVISVSNPGDLVLRDVVVKDTLSPGVTVLEAAGAQISCNKVVWTVKELNPGESLQYKVLVARGAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 1037 - protein, 102 aa, Chlamydia trachomatis
NMSTVPVVQGAGSSNSAQDISTSSAPLTLKGRISNLLSSTAFKVGLVVIGLLLVMATIFLVSASFVCKSHLSSYSCYCGMREYLRRNFIHGRILFSGEMELM

SEQ ID NO: 1038 - protein, 91 aa, Chlamydia trachomatis
FRPASFVNPIYLAIPAIVGCVNICVGILSMEGYCSPERWSLCKKILKASEDIIDDGQINNSNKVFTDERLNAIDGVVVSLSRRNSLVDQTQ

SEQ ID NO: 1039 - protein, 632 aa, Chlamydia trachomatis
MMRFARFCLLVLTLFPQLAFSAEPLRRQDVRKTVDKLVEHHIDTQQISPYILSRSLEDYVRSFDHKAYLTQDEVFSHAFSEEATHPLFKQYQEDNFSSFKELDTCIQQSISRAREWRSSWLTDSIRVIQDAMSHTIEKKPSAWASSIEEVKQRQYDLLLSYASIYLEDAAKNRYQGKEHGLVKLCIRQIENHENPYIGINDHGYRMSPEEEANSFHVRIIKSIAHSLDAHTAYFSQEEALSMRAQLEKGMCGIGVVLKEDIDGVVVKEVLAGGPADKTGSLRVGDIIYRVNGKNIENTPFPGVLDSLRGSPGSSVTLDIHRQNNDHVIQLRREKILLDSRRVDVSYEPYGNGIIGKITLHSFYEGENQVSSEQDLRKAIRELQEKNLLGLVLDIRENTGGFLSQAIKVSGLFLTNGVVVVSRYADGSVKRYRTISPQKFYDGPLAVLVSKSSASAAEIVAQTLQDYGVALIVGDQQTYGKGTIQHQTITGSNSQEDFFKVTVGRYYSPSGKSTQLEGVKSDIVIPSRYAEDKLGERFLEYALPADQYDNVINDNLGDLDINIRPWFQKYYSPHLQKPELVWREMLPQLAHNSQERLEKNKNFEIFVQHLKKTNKQDRSFGSNDLQMEECEHR

SEQ ID NO: 1040 - protein, 129 aa, Chlamydia trachomatis
  VARIANT (1)...(129): Xaa = Any Amino Acid
LNREEYMPTINQLIRKKRQSGATRKKSPALQKSPQKRGVCLQVKTKTPKKPNSALRKVAWVRLSNGQEVIAYIGGEGHNLQEHSIVLVQGGRXKDLPGVRYHIVRGALXCAAVKNRKQSRSRYGAKRPK

SEQ ID NO: 1041 - protein, 131 aa, Chlamydia trachomatis
  VARIANT (1)...(131): Xaa = Any Amino Acid
LLHGKKSIARKIVYGALERFAKRLGLENPLEGFEEALENAKPILEVRSRRVGGATYQVPVEVAPDRRSCLAMQWIIKHARSKPGKCMEVGLANELIDCFNKQGATIKKREDTHRMAEANKAFAHYKWXXNV

SEQ ID NO: 1042 - protein, 704 aa, Chlamydia trachomatis
  VARIANT (1)...(704): Xaa = Any Amino Acid
VCERQKSSMSDQEFGLDAIRNIGIMAHIDAGKTTTTERILFYAGRTHKIGEVHEGGATMDWMEQEQERGITITSAATTVFWLGAKINIIDTPGHVDFTIEVERSLRVLDGAVALAVFDAVSGVEPQSETVWRQANKYGVPRIAFVNKMDRMGANYXGAVESMREKLGANAXPVHCPIGSESQFVGMVDLISQKALYFLEETLGAKWEERKIPEDLQEQCATLRMQLLEELATVDESNEAFMEKVLENPDSITEEEIHTVMRKGVIEGKINPVLCGSAFKNKGVQQLLDVIVKWLPSPLDRGNVRGINLKTGEEVSLKPSKDGPLAALAFKIMTDPYVGRITFIRIYSGTLKKGSAILNSTKDKKERISRLLEMHANERTDRDEFTVGDIGACVGLKFSVTGDTLCDENQEIVLERIEAPEPVIDMAIEPKSKGDREKLAQALSALSEEDPTFRVSTNEETGQTIISGMGELHLDILRDRMIREFRVEANVGKPQVSYKETITKTSNSETKYVKQSGGRGQYAHVCLEIEPNEPGKGNEVVSKIVGGVIPKEYIPAVIKGVEEGLNSGVLAGYGLVDVKVSIVFGSYHEVDSSEMAFKICGSMAVKEACRKALPVILEPIMKVTVITPEDHLGDVIGDLNRRRGKILGQESSRNMAQVSAEVPLSEMFGYMTSLRSLTSGRATSTMEPAFFAKVPQKIQEEIVKK

SEQ ID NO: 1043 - protein, 112 aa, Chlamydia trachomatis
LLRSKEYMKQQKQRIRIRLKGFDQGQLDQSTANIVETAKRTGARVVGPIPLPTKREVYTVLRSPHVDKKSREQFEIRTHKRLIDILDPTGKTIDALKMLSLPAGVDIKIKAA

SEQ ID NO: 1044 - protein, 301 aa, Chlamydia trachomatis
ILRSRLPNSFDLKMSLFSKFKAQWMFLHSRELCSSTSDIGNTCSDPVFQILCNPVRSEISYKVGDSLGVFPTNPSTLVDSVLDALQYGPRSPVVSRHADSVLPLHEFLTSYVASPLDKIPKSLRPFFPGDLDDTWSLAEAILVYQPRIPFEEFIRSAMPLLPRFYSIASSPTCSHGKLELLVRCVSFQGKTQLRYGLCSAFLCKDLQEGESFRGFIQPTRHFTLEQKNFGKPLIMIGAGTGIAPYKGFLQHRIYHQDVGSNILFFGERFEKSNFYYRAFSPGADRFRKTPVIHSLFQRFRV

SEQ ID NO: 1045 - protein, 102 aa, Chlamydia trachomatis
MTEIPSSFVLPDPEWIYRVGIGQDSHRFLPDEDPKPCILGGIIFENTPGFEANSDGDVVFHAICNAFSSVTHKGILGGLADELLKTKGITDSVVYLQELSPL

SEQ ID NO: 1046 - protein, 509 aa, Chlamydia trachomatis
  VARIANT (1)...(509): Xaa = Any Amino Acid
LQGLISGGGNMASLLDRYLRNISDKSQQNLASVAYLASLDHLLHAFPSIGQSIVQELKSQRSRLKMIASENFSSLSVQLAMGNLLTDKYCEGSPFKRFYSCCENVDAIEWECAETAKELFGAESAFVQPHSGADANLLAIMSIITQKIQSPAVQQLGYKTINDLPEQEYEALKAEMAQHKCLGPSLNSGGHLTHGTVRMNIMSKLMHCLPYEVNLDTELFDYDEIAKXAKEHKPTVLIAGYSSYSRRFNFATLKQIAEDCGAVLWVDMAHFAGLVAGGVFVGEENPMPYADIVTTTTHKTLRGPRGGLVLAKXEYANTLNKACLXMMGGPLPHVIAAKAIALKEAMTINFRKYAHKVVENAQTLAEVFQRNGLRLLTGGTDNHMLIIDLTSLGVPGRIAEDMLTSVGIAVNRNTIPSDASGQWKTSGIRLGTPALTTLGMGSAEMEEVALANIIVKVLRNITVRSNAESGSSKSEGELSEGIAQEARQRVADLLGRFPLYPEIDLETLV

SEQ ID NO: 1047 - protein, 152 aa, Chlamydia trachomatis
GVAKRLPGTAHKLNTDPVDAAKPVTTVVKGEEIILIWSQTAKLASTDPPGLLMTNTIGCPGLVSSKYQSFLMASAALFSVTGSEKKIRRESNNFLSMTSCNLCIISPSGIESPTKLAFPDRFQDKEGIFLINQPHVVSLPERSLLTALPHFY

SEQ ID NO: 1048 - protein, 198 aa, Chlamydia trachomatis
  VARIANT (1)...(198): Xaa = Any Amino Acid
GNASLVGDSMPEGEMMHKLQDVIDRKLLDSRRIFFSEPVTEKSAAEAIKKLWYLELTNPGQPIVFVINSPGGSVDASFAVWDQIKMISSPLTTVVTGLAASTGSVLSLCAVPGRRFATPHARIMITKPSIGGTITGQATDLDIHAREXLKTKARIIDVYVEATGQSPEVIEKAIDRDMWMSANEAMEFGLLDGISLLF

SEQ ID NO: 1049 - protein, 90 aa, Chlamydia trachomatis
SNGVWTVRWDFSSLLTTCRYLLYSGAGNSFILGESMPSLEDVLFLCQEEMVDGFLCVESSEIADAKLTVFNSDGSIASMCGNGLQSQWRT

SEQ ID NO: 1050 - protein, 212 aa, Chlamydia trachomatis
WIYRVYVREWVAVAMAHVAQCFGLEDVSIETERGVYQGKFFSMNRVLVASPMTLPDWKKAERKLTHVLPGMPEQVFFIDTGVPHVVVFVSDLSKVPVQEWGSFLRYHEDFAPEGVNVDFVQRKKDDLLLVYTYERGCERETLSCGTGMLASALVAADIFSLGQDFSIAVCSRSRNLIKIFSEKGKVFLEGPVSLLNRSENFGWLEPKSRRFG

SEQ ID NO: 1051 - protein, 200 aa, Chlamydia trachomatis
  VARIANT (1)...(200): Xaa = Any Amino Acid
HKRELLSNRASPILEPMTTYPVPQNPLLLRVLRLMDAFSKSDDERDFYLDRVXGFILYIDLDKDQEDLDKIYQELEENADRYCLIPKLTFYEIKKIMETFVNEKIYDIDTKEKFLEIVQSKNAREQFQEFLYDHETEQEKWQQFYVERSRIRIIEWLRNNQFQFVFEEDLDFSKHILEQLKVHLFDAKVSKELTQARHFF

SEQ ID NO: 1052 - protein, 171 aa, Chlamydia trachomatis
AHFRTTEGTSIRCQGIERVNTGASLLLNKSKVYYSNEALNPRPKRGRPPKQSAKVEAETTISNDIYTKVPSAARRFLFLPEITSPSSLTFSEKFDTEEEFLAHLRGGGRLEDQLNLAKFSERFDSLRELSAKLGYDSDGETGDFFNEEYDDEEEEIKPKKTTKRGRKKSRS

SEQ ID NO: 1053 - protein, 232 aa, Chlamydia trachomatis
NSLETIMTDFHDKPNIQIMFDSLAPTYDKINGILSLGLHIAWNNALVSLLGETNHLLDLCAGTGRVALSYVQNYPRASATLVDFSTKMLENVQKRHPSAPFSYITSDVTHLPLPDNTFRLASMAYGLRNLSYPLEALREVYRVLQPGGHLGILELTRPATYNPVYLLHKLYLNLVVPSVGRFYSGNSYAYSYLKESIRDLPRMPLSKQSFMQRIYALSGNANYFLAQQPFGF

SEQ ID NO: 1054 - protein, 288 aa, Chlamydia trachomatis
RDVPSHNTTWSYPMLSQFQDRLNIGCVRYVNALPFSSGLSQAPGVSLLMDTPTNLVPKLLSREIDYALTSVAATFSSSLHRVSSFGIAAYKKILSVASNLHATSQFFAKEAPHIAATKESLSSILLLRVLCENLWNIPFPSVTLLSSDSILTQAEHYDALLLIGDTALRHPIIPGFHTYDLAASWYDLTAKPFVFAGILSLSSTISFQLQQEFSSTLNYFQNHKEDITSKAAALLKLPESLMQEYYTLCRYELSEEDFAGLEQFRDYYDRLPRQAKYPNHVRFSCAYL

SEQ ID NO: 1055 - protein, 396 aa, Chlamydia trachomatis
  VARIANT (1)...(396): Xaa = Any Amino Acid
VAAATAVRKRSLVPVKSKTHKLITTMTTLPARILPKSAWLKTLFDDYLSGARLSEKQALQLLLVASPAEDQQALWSFADLIRANRVGDTVFYSSTLYLYPTNFCQFNCTFCSFYAKPGNPTGWFFTPDQLVQSIKENPSPITETHIVAGCYPSCNLAYYEELFSKIKQNFPDLHIKALSAIEYDYLSKLDNLPVKEVMQRLRIAGLDSIPGGGAEILVDEVRETLSRGRLSSQGFLEIHETAHSLGIPSNATMLCYHRETPADIMTHMSKLRALQDKTSGFKNFILLKFASENNALGKRLHKMTSRHSIPPATIIAVARLFLDNIPNIKALWNYLGLDVALHLLSCGXNDLSSTHQGEKVFRMASSQEPIRMDIEGMSHLIIQHGRIPCLVNSKTV

SEQ ID NO: 1056 - protein, 174 aa, Chlamydia trachomatis
  VARIANT (1)...(174): Xaa = Any Amino Acid
RETCVFGFVAGGLDDRNLYNHFFDSDQQQYSPGLTAVICNKYSRDSLLEALYQRQCYATTGQRIIVNFQITSAPMGSELSTAIKPGLVINRHISGYVAGTAKIASIEIIRNGDILHPFHPDGNNFEYEYDDLSPFAQVTLKDPQNGAPFAFYYLRVTQENGAMALSSPXWIDLN

SEQ ID NO: 1057 - protein, 334 aa, Chlamydia trachomatis
KRLPRILWLQKLCMLPEAISLLSNLLSLVMWKLGTLSLLFLAPLPTSLKRTLQVMVLNYLLNAVASNLSLFMLTHQGKDLLKDPDIFTMDIRGNVLKNIRIFAPSYVIKNKRFDITVRFEDEFGNLTNFSPEETHIELSYEHLRENLNWQLFIPETGFVILPNLYFNEPGIYRIQLRNQATKEVFTSAPIKCFAETSSHLLWGLLHGESDRVDSEGNIESCLRYFRDDCALNFFATSSFEIQDGLTPETIKTINQTVADFNEEDRFIALSGAQYLSEEPGEGIREVLLMKEPKSPGKHKECKLFPLSKLYKQSTSHELISIPQLHCFKEIWIQF

SEQ ID NO: 1058 - protein, 204 aa, Chlamydia trachomatis
RSSVKHAKAKFLQIKDFLVTRTYILVAMRRSVCYVTPSVARAGQISTWRFEYSSANFLPEGTLLKFDLGIDGRPIDWEIPSIDLSQPCNTIYLETPSEDIVAAKAVYAPGGYIPTFEFTLPCDVEAGDTFSIILGSSPNFPQEDSSGNGAQLFTQRRKPFSLYVDPSGKGSFERSRYLHNGYQRKCIKKYPDFCSFLCDQKQTL

SEQ ID NO: 1059 - protein, 125 aa, Chlamydia trachomatis
  VARIANT (1)...(125): Xaa = Any Amino Acid
RLSLMNTDLQKAFVSMEDIVEEIFGEIADEYDDQEDVHYKXIGNAWIVASPGRMNISDAEECFGLHIEHESSYDTLGGYVFHKLGAVPEKGMKIYYEDFAIDILSCSDRSVEKMKITPRRRKPLS

SEQ ID NO: 1060 - protein, 298 aa, Chlamydia trachomatis
  VARIANT (1)...(298): Xaa = Any Amino Acid
ASSLFVDSPNNFFYRSWLFSPLIMLYILLAIIVLFLFLGSATHRRASISAYGGEGLPPFSSCPKVLPLLCLIYGMLGAPVYQYIHNFFSLSPSIFWLIFLSLALVIYKFLPLCPGYSDDSFSYKVSSSTVKTLENCLAGFKTPSITAMQQTPPPEPPNELSTNISCLNHMIAREIMTPKADIFALQGDTPISQAFPLIIDEGYSRIPLFTKSIDDITGMVLVKDLSPVYYKDPHTSQPLSSIAYPPLYTPEIRRASLLLQEFXQKRCHLAIVVNEYGFTEGLCLYGRYRRRNLWRNCR

SEQ ID NO: 1061 - protein, 165 aa, Chlamydia trachomatis
VIFFLLILDRSSPQIFISNEQQDVSIDLQSAQRLVVLFLELQKVSTDQVYVYFLDDTALAQLHDEQFSDPSLTDTITLPIDKPGIASFPHVLGEAFVSPKAAMRFLEQYTEDQLYHEISRYVVHSLLHMLGYDDQTDEDKRIMQEQEDVSLSFLAEHQALLRPAV

SEQ ID NO: 1062 - protein, 105 aa, Chlamydia trachomatis
QQSLGLNQDPLNKVVMVPFPNREVLCIGLVAGEAPTTCSQDADDPMITVFIPTTPNPTSGFLTLFKKSDITFLDMKIEDAFKYVISCGVLNSDPCATSPFIHPQF

SEQ ID NO: 1063 - protein, 108 aa, Chlamydia trachomatis
LMEPYAVIQTGNKQYQVRKGDVIDVELLDGISEENKEVLFQDVLFTFDGEKASVGAPTVGNAVVKGELVSFVRGEKVVAYKYKKRKNYHKKIGHRQNYLRVKISDLVM

SEQ ID NO: 1064 - protein, 83 aa, Chlamydia trachomatis
MAHKKGQGASRNGRDSESKRLGLKVGAGQRVSTGSILVRQRGTKWHPAVNVGRGKDDTLFALADGIVVMKKTDRTYVSVIPQA

SEQ ID NO: 1065 - protein, 267 aa, Chlamydia trachomatis
LFKLCFCLRVKIGLFLFVPGRVMFVDQITLELRAGKGGNGVVAWRKEKYLPKGGPYGGNGGNGGSILIETVTNMYSFEEYRNLRFLKADDGQAGASNNRTGRNGKDLVLKVPEGTLLRDAATGELIHDFTKDGERIVVCQGGRGGKGNVFFKTSTNRAPTKATPGKPGEIRLVELELKLIADIGLVGFPNAGKSTLFNTLARTEVKVGAYPFTTLHPSLGLVHQEGMLYQKTWIMADIPGIIEGASQNRGLGLDFFGILNVRDYCYS

SEQ ID NO: 1066 - protein, 114 aa, Chlamydia trachomatis
RSVAKPGIGIGFLRHIERTRLLLFVIDISGIERHSPEQDLKILMGELLAYKEELKDKDMVIALNKIDQLLPDEREERVALLKQQFPDQEFILLSGLTGEGVDALYDLFKSKLSE

SEQ ID NO: 1067 - protein, 305 aa, Chlamydia trachomatis
NFRKILLQHFWEMPMISILCSLFPPLLFPSLLAAFGASIAAGIVGSYIVVKRIVSISGSIAHSILGGVGIALWLQYQFNLPISPLHGAIASAIFVAICIGNVHLKYHEREDSIISMIWSIGMAIGIICISKLPSFNSELSDFLFGNILWVTPQDLYFLGILDLFIVATVSICHTRFLALCFDEKYMALNHYSIKTWYLLLLILTAITTVVLMYVMGVILMLSMLVLPVSIACRFSYKMSHIIYIASILNIVCSFLGIMLAYLLDLPVGPVIAILMGGAYSLSLLLNRSYNASTPSPVSPESKINS

SEQ ID NO: 1068 - protein, 236 aa, Chlamydia trachomatis
MTKQMLLENVSFRYGKTGPLIVDHVSCEVYSGDFIGIIGPNGGGKTTLTQLMLRLLQPVCGSISTYSVQDHRPLSIGWVPQHFSYDAAFPITVKETVLSGRLATLPWYGRYTQEDHEAAEEALLTVDLIDYKDSCFSHLSGGQIQRVLLARALAARPEFLLLDEPTANIDPVNQQKILQILSALNKHCTILMITHDLHHTAGCFNRVFFMNKTLTTLADTTTISERFCCNTFGRCP

SEQ ID NO: 1069 - protein, 278 aa, Chlamydia trachomatis
DNMRLLFLLLFSLGITCSYGDEVSTRKQILVSIVPYKFLVEQIAGDTCQVFSIVMDNHDPHNYELSPKYIEKIRQVELWFRIGEGFEKTCERIISCKQVDLAANIDKITNGACCQRFLSFDTHTWLSPKNLKIQIQAITEALVETAPEHETLYRKNCSLLQSQLDLLDQKISSIVSSTSQRNVLVTHGAFAYFCRDYGFIQHTIERANHSELSPKDVVRVERTIRDHNLHSVILLKHAGKRSSAALVRKFNMTPILLDPYAEDVFNNLLAIATAFANL

SEQ ID NO: 1070 - protein, 892 aa, Chlamydia trachomatis
RDSRRTVTFSGNTVSSQSTTGQVAGGAIYSPTVTIATPVVFSKNSATNNANNATDTQRKDTFGGAIGATSAVSLSGGAHFLENVADLGSAIGLVPDTQNTETVKLESGSYYFEKNKALKRATIYAPVVSIKAYTATFNQNRSLEEGSAIYFTKEASIESLGSVLFTGNLVTPTLSTTTEGTPATTSGDVTKYGAAIFGQIASSNGSQTDNLPLKLIASGGNICFRNNEYRPTSSDTGTSTFCSIAGDVKLTMQAAKGKTISFFDAIRTSTKKTGTQATAYDTLDINKSEDSETVNSAFTGTILFSSELHENKSYIPQNVVLHSGSLVLKPNTELHVISFEQKEGSSLVMTPGSVLSNQTVADGALVINNMTIDLSSVEKNGIAEGNIFTPPELRIIDTTTSGSGGTPSTDSESNQNSDDTKEQNNNDASNQGESANGSSSPAVAAAHTSRTRNFAAAATATPTTTPTATTTTSNQVILGGEIKLIDPNGTFFQNPALRSDQQISLLVLPTDSSKMQAQKIVLTGDIAPQKGYTGTLTLDPDQLQNGTISALWKFDSYRQWAYVPRDNHFYANSILGSQMSMVTVKQGLLNDKMNLARFDEVSYNNLWISGLGTMLSQVGTPTSEEFTYYSRGASVALDAKPAHDVIVGAAFSKMIGKTKSLKRENNYTHKGSEYSYQASVYGGKPFHFVINKKTEKSLPLLLQGVISYGYIKHDTVTHYPTIRERNQGEWEDLGWLTALRVSSVLRTPAQGDTKRITVYGELEYSSIRQKQFTETEYDPRYFDNCTYRNLAIPMGLAFEGELSGNDILMYNRFSVAYMPSIYRNSPTCKYQVLSSGEGGEIICGVPTRNSARGEYSTQLYPGPLWTLYGSYTIEADAHTLAHMMNCGARMIF

SEQ ID NO: 1071 - protein, 915 aa, Chlamydia trachomatis
  VARIANT (1)...(915): Xaa = Any Amino Acid
IMKFLSATAVFAAVLSSVTEASSIQDQIKNTDCNVSKVGYSTSQAFTDMMLADNTEYRAADSVSFYDFSTSSGLPRKHLSSSSEASPTTEGVSSSSSGENTENSQDSAPSSGETDKKTEEELDNGGIIYAREKLTISESQDSLSNPSIELHDNSFFFGEGEVIFDHRVALKNGGAIYGEKEVVFENIKSLLVEVNISXEKGGSVYAKERVSLENVTEATFSSNGGEQGGGGIYSEQDMLISDCNNVHFQGNAAGATAVKQCLDEEMIVLLTECVDSLSEDTLDSTPETEQTKSNGNQDGSSETKDTQVSESPESTPSPDDVLGKGGGIYTEKSLTITGITGTIDFVSNIATDSGAGVFTKENLSCTNTNSLQFLKNSAGQHGGGAYVTQTMSVTNTTSESITTPPLVGEVIFSENTAKGHGGGICTNKLSLSNLKTVTLTKNSAKESGGAIFTDLASIPTTDTPESSTPSSSSPASTXEVVASAKINRFFASTAEPAAPSLTEAESDQTDQTETSDTNSDIDVSIENILNVAINQNTSAKKGGAIYGKKAKLSRINNLELSGNSSQDVGGGLCLTESVEFDAIGSLLSHYNSAAKEGGVIHSKTVTLSNLKSTFTFADNTVKAIVESTPEAPEEIPPVEGEESTATENPNSNTEGSSANTNLEGSQGDTADTGTGVVNNESQDTSDTGNAESGEQLQDSTQSNEENTLPNSSIDQSNENTDESSDSHTEEITDESVSSSSKSGSSTPQDGGAASSGAPSGDQSISANACLAKSYAASTDSSPVSNSSGSDVTASSDNPDSSSSGDSAGDSEGPTEPEAGSTTETPTLIGGGAIYGETVKIENFSGQGIFSGNKAIDNTTEGSSSKSNVLGGAVYAKTLFNLDSGTLDELSPSPGILSLLNLQQVRLLEELSTLLL

SEQ ID NO: 1072 - protein, 118 aa, Chlamydia trachomatis
  VARIANT (1)...(118): Xaa = Any Amino Acid
SDSASVREGAAGSAVEAKNRFILAEATTSXVLAGEEEEGVEDSGVSVVGIDARSVKIAPPDSFAEFLVRVTVFKLDKESLLVQIPPPCPLAVFSEKITSPTRGGVVILSLVVLVTDMV

SEQ ID NO: 1073 - protein, 1196 aa, Chlamydia trachomatis
LITHQKNMVVEPLLPKEISQTYTSDVETIPGITPVHGETVITGNKSTGGNGGGVCTKRLALSNLQSISISGNSAAENGGGAYTCPDSFPTADTAEQPAAASAATSTPESDPVALASTALSTPSSSTVSSLTLLAASSQASPATSNEKTQDPNADTDLLIDYVVDTTISKNTAKKGGGIYAKKAKMSRIDQLNISENSATEIGGGICCKKSLKLDALVSLSVTENLVGKEGGGLHAKTVNISNLKSGFSFSNNKANSSSTGVATTASAPAAAAASLQAAAAAAPSSPATPTYSGVVGGAIYGEQFTFSQCSGTCQFSGNQAIDNNPSQSSLNVQGGAIYAKTSLSIRSSDAGTSYIFSGNSVSTGKSQTTGQIAGGAIYSPTVTLNCPATFSNNTASMATPKTSSSSGNSIKDTIGGAIAGTAITLSGVSRFSGNTADLGAAIGTLANANTPRATSGSQNSITEKITLKNSSFIFERNQANKRGAIYSPSVSIKGNNITFNQNTSTHDGSAIYFTKDAKIESLGSVLFTGNKVTATQASSATSGQNTNTANYGAAIFGDPGTTQSPQTDAILTLLASSGNITFSNNSLQNNQGGTPASKFCSIAGYVKLSLQATKGKTISFFDCVHTSTKKTGSTQNVYETLDINKKENSKPYTGTIVFSSELHENKSYIPQNAILHNGTLVLKEKTELHVVSFEQKEGSKLIMEPGAVLSNQNIANGALAINGLTIDLSSMGTPQAGEIFSPPELRIVATTSSASGRSGVSRSIPTNPKGISAAAPSGSAATTPTMSENKVFLTGDLTLIDPNGNFYQNPMLGSDLDVPLIKLPTNTSDVQVYDLTLSGDLFPQKGYMGTWTLNSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTILYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTYRK

SEQ ID NO: 1074 - protein, 79 aa, Chlamydia trachomatis
DPLVALGVFALARVPIAAPKSAVFPENRETPDRVMAVPAMAPPMVSLIEFPEDEEVFGVAIEAVLLENVAGQFNVTVGE

SEQ ID NO: 1075 - protein, 113 aa, Chlamydia trachomatis
VGVAGDDGAAAAAACREAAAAAGAEAVVATPVASPEEFALLFEKEKPDFRLEIFTVLACKPPPSFPTRFSVTDKETRASSFKDFLQQIPPPISVAEFSEIFSWSMRDILAFLA

SEQ ID NO: 1076 - protein, 568 aa, Chlamydia trachomatis
  VARIANT (1)...(568): Xaa = Any Amino Acid
NGCQLLRCLLLFSPQFQGFASQNLXXLNFSRVGTSSSTTFTETVGEAGAEYIVSSNASFTKFTNIPTTNTTTPTNSNSSSSNRETASVSKDSDSTTTTPDPKGGGAFYNAHSGVLSFMTRSGTEGSLTLSEIKMTGEGGAIFSQGELLFTDLTGLTIQNNLSQLSGGAIFGGSTISLSGITKATFSSNSAEVPAPVKKPTKPEAQTAGETSGSSSSSGNDSASSSSSSKAEPAAANLQSHFICATATPAAQTDTETSTPSHKPGSGGAIYAKGDLTIADSQKVLFSINKATKDGGAIFAEKDVSFENITSLKVQTNGAEEKGGAIYAKGDLSIQSSKQSLFNSNYSKQGGGALYVEGNINFQDLEEIRIKYNKAGTFKTKKITLPSKAQASAGNADAWASSSPQSSSGATTVSDSGDSSSGSNSDTSKTVPVTAKGGGLYTDKNLSITNITGIIEIAINKATDVGGGAYVKGTLTCKNSHRLQFLKNSSDKQGGGIYGEDNITLSNLTGKTLFQENTAKKEGGGLFIKGTDKALTMTGLDSFCLINNTSEKHGGGAFVTQRNLSDLHL

SEQ ID NO: 1077 - protein, 133 aa, Chlamydia trachomatis
KRMGKSKDYLYPRTEVPFCSPLTTVAESLPILSSYGYGCVCVVNELFELLGIFTDGDLRRGLSEYGGDILAYPLQQIMTRNPKVISEDSDVLLSLEMMESGNPVTVLPVVDAQQQRFIVGLLHMHALARAGLL

SEQ ID NO: 1078 - protein, 124 aa, Chlamydia trachomatis
DFFPVVEEDSEGNCSSKKAFIDLGNKTFFLREASPAIRVTSLLGIDKKFASNATTASLALPFSGTSVTRTLNIPSSKHTTLFSRAFVVTLTSKTQKPSNKIFSFSLLRSFKRKRTVFTFPHTIN

SEQ ID NO: 1079 - protein, 111 aa, Chlamydia trachomatis
KILWFFMVSRVPGSSDPVDVNALSNLSPVQNQNSGVSVSAIYLPNETVSKSGKTLKYSTELIAGIVCIRGCISNCGYRPNDTSSWSSAIDCFSDCFFRNFCRWSYHVKKSY

SEQ ID NO: 1080 - protein, 76 aa, Chlamydia trachomatis
LQVLFVLGVALAIVAIALTILAPGVPQSIVLAIAFSGISVGGVTTLRSLINGIKTVVAPRMTFRQRAKSALSLVQD

SEQ ID NO: 1081 - protein, 109 aa, Chlamydia trachomatis
ARLPGEASKAIARIMPTARREHAKIMEILIQEAPDRWFGIFESEVVEGETGAYSKTEGFCTTGICFYYQTKKFVNSLGREGLEEVSSSKPLHFTKKAYLPRLIKVKGYR

SEQ ID NO: 1082 - protein, 96 aa, Chlamydia trachomatis
MTKDPEKKAVLYRYAEQLIEDTILFTDAENPLPSPSSSYLRYQVSPETRTQLMLAILETLVSSKTDEDIRVFLSLMKKTHYKNIPILSGLLMRIVE

SEQ ID NO: 1083 - protein, 85 aa, Chlamydia trachomatis
LTSSKWTIVSLTFTRPLLMSSCMIGPFKPAALIFSGINFVVSGSVMRHPRVSTRWSSWRDSIRKLPKSSTIPSRSIGCSITLIVS

SEQ ID NO: 1084 - protein, 131 aa, Chlamydia trachomatis
SAFETIQEAIMQLPSIIQSFFFPKAPPSPLKKPIYQQTERIINIAYLVLLSLSVVGIISGVFLSLSFPLLGAGICLISLAVGSCLLVLFPLLPDIEKIIALREPKVSITTSSPLPTLMRSFKSIGLGKAAH

SEQ ID NO: 1085 - protein, 125 aa, Chlamydia trachomatis
VNSTNNTDSQNLDPNASEVEKLLDESAEAEEKVDDHTPPSELFILPLNKRPFFPGMAAPLLIEAGPHYEVLTLLAKSSQKHIGLVLTKKEDANTLKVGFNQLHRVGVSARILRIMPIEGGRLKCY

SEQ ID NO: 1086 - protein, 105 aa, Chlamydia trachomatis
MIRMFKILPLDGLIYNLFYPTLVMPIFLMIPLSFLNPLLSHLSESYISWILDLPWLHAPNVLISLTSAPPTLEWITLVSIILVYIGALSSVGKAVNTAVDHSIIL

SEQ ID NO: 1087 - protein, 158 aa, Chlamydia trachomatis
WNSSGSACHRYCVDFCPYLCLSSSYRVYYWSFFRTSNKLVSCLWIPVQIRSGYIADQELFDKQEKRIRQAIMQCRLIRNQMVLQRRLDILQKRAHRPGQSQTITIRPLTNRISLPEEMEHEILGKKPQVVIAMLDNKIAQLNQSLVQLYDRPTRVIEQ

SEQ ID NO: 1088 - protein, 85 aa, Chlamydia trachomatis
VTRAVHVSVVTISCFVLNVGSVNCNTASFFFRSVVNRAIITKISQPISRQRTRNSSCQRSLTMVASNVANGPYVDMRLITLKSFF

SEQ ID NO: 1089 - protein, 112 aa, Chlamydia trachomatis
TLSETLTIPRSIRPVTVPRPEIENTSSMGIKKGLSISLSGVGILSSTACISSRTFSMYAASPSKAFRAEPLMIGHPLYPFSSRSSANSISTKSTNSASSSEIMSILLRKTTM

SEQ ID NO: 1090 - protein, 82 aa, Chlamydia trachomatis
  VARIANT (1)...(82): Xaa = Any Amino Acid
MGQDHRRKFLKKVSFAKKQAAFAGSFIEEIKKIEWVNKRDLKRYVKIVLMNIFGXGFSIYCVDLALRKSLSLLGEVTSFFFG

SEQ ID NO: 1091 - protein, 103 aa, Chlamydia trachomatis
  VARIANT (1)...(103): Xaa = Any Amino Acid
LCSSLTNYSTSTPMLRAVPSTILSADSKRTTSMSFIFCSAIAVICARVASNLPTLFLLGILDPDSKPKAFLINEETGDCFITKXKVLSEYTVITTGSKSPGRS

SEQ ID NO: 1092 - protein, 100 aa, Chlamydia trachomatis
LSNRASTASCNIRFSLRTMTSGVFSRKIAFKRLFRLITLRYRSFKSEVALAKRPPSKGTKGRKSGGTTGMFFNTIHSGRFEEDTKPSTIFRRLASFILAC

SEQ ID NO: 1093 - protein, 132 aa, Chlamydia trachomatis
VLNKKDVMEKKEQALCFSCPYCCDGNVAFSVIDLENCLVCDCCEASFMFDAEMCDAIRRFSALCLRIYEAKALLGEAAVSVSVQGQRIDVPFQLLFSRFPVFLNLNLAGKLVARGVRFIFDSLRGEVLYHRG

SEQ ID NO: 1094 - protein, 95 aa, Chlamydia trachomatis
DQRSLEATALLPNSLTSLITKSAGEQLLVSRFKTFNPSESFRTFSESLSLLFDKNSTAPISRHAEKNSDFLRPINRYLSTSTRMQTTPYAAEFFS

SEQ ID NO: 1095 - protein, 88 aa, Chlamydia trachomatis
LLSLPIVHGLLWLGIFGCKSKKKYSSMTVIVLCCFAFPEKKLVGGFSFLENILRTFSTGGQEIQQSFLGSPQRDFLTNSLDFCAYPTF

SEQ ID NO: 1096 - protein, 110 aa, Chlamydia trachomatis
IGHNISIICRSCSCEVILWLLMRLFGWSCGNSFCSFLISLRFLRLCFLGFLKSGSLSCSSIYRIFIAFYTCSQSFLRIIAQCRSNTSVSFKILTYRTSRTPRFTSSLFFC

SEQ ID NO: 1097 - protein, 146 aa, Chlamydia trachomatis
LGETSTVACLLGAGLLLLTGIASWRTMLSFGLSAFFFAWFFKIMSILTTGNAGAWAPAKFFIPAYRHLCIGGLAFGLVFMATDPVSSPAMKLAKWLYGAFIGFLTILIRLINPAYPEGVMLAILLGNVFAPLFDNIALKQYRQRRI

SEQ ID NO: 1098 - protein, 142 aa, Chlamydia trachomatis
LNIGEISAICSTCSALSPHLSLYLYELMPETLALYRCACLGNRSGEQSFSKAALRALILNQCSIDRIIFSSKDIERNIVESIARYLKVPCEKRSWYRKRKALDSAENICILSTYPFNRRVREEIFSQVPDNAIFMSLFPLAH

SEQ ID NO: 1099 - protein, 106 aa, Chlamydia trachomatis
  VARIANT (1)...(106): Xaa = Any Amino Acid
VESNFRMGRRRTRRAPHFWIFVPSSRALSEKLILFFEALVILDPLSVYDFQTLGGLYLQISENTKALYVLDQALRMQGDHLPSLLNKTKALFCLGRIEEASAIXPT

SEQ ID NO: 1100 - protein, 95 aa, Chlamydia trachomatis
MNRYRFSRLLVCLSLLCCALYRYIDKQNDLTKLRLEIPCLWAQLRQIEQENVALSFLLEKLESPEHLLQIAFLPEYQYLEYLSEEKISVLAYESP

SEQ ID NO: 1101 - protein, 110 aa, Chlamydia trachomatis
  VARIANT (1)...(110): Xaa = Any Amino Acid
VELLPHEKQVVEYEKTIAEFKEKNKENSLLSSSEIQKLDKRLDRLKEKIYSDLTPWERVQICRHPSRPRTVNYIEGMCEEFVELCGDRTFRDDPAVVGGSQRFXDSVSCL

SEQ ID NO: 1102 - protein, 91 aa, Chlamydia trachomatis
MLIPIAEEIFFRGILQTFFKNTFSRSKAVVTSSLIFAITHIEASLGSFIFVPTLFVFSLCAGFIYEKVRHIAAPVTLHILFNSCQLALLSL

SEQ ID NO: 1103 - protein, 154 aa, Chlamydia trachomatis
MVGLGLLLVFVGISIFLANGFFVWPKPEKHTHLPFSLVCLGAVLLLLPALLPTGDPLSSISKASFHGIFVFSAFLFLLLGLPAPITQSILYAGRTTSSTSWLLAIRAGARMWVITITATQILARLLQLVLPLILPKQLFQEQVITEEIREQPIN

SEQ ID NO: 1104 - protein, 98 aa, Chlamydia trachomatis
RVSFPCTWKITIPPLYIKKFNVESLSDVDASNIYSKTLHHFFLLAIQMIPTPRKTIGIDNHCPIVNMFSSPSHAPWCVLKNSAQKRITATPIKAPAAL

SEQ ID NO: 1105 - protein, 77 aa, Chlamydia trachomatis
YSLRSSEISSSRRPKMNICSFPICSAISILAPSIVPIVKAPFKANFIFPVPEASIPAVEICSDKSVAGMIASAKETL

SEQ ID NO: 1106 - protein, 157 aa, Chlamydia trachomatis
  VARIANT (1)...(157): Xaa = Any Amino Acid
NSKRTNETEGHSSIMLRNCPLFNINVFTRVIASAEYSRTLLLKKLSSPKQSRGLSRTLIVGSFAKILTHPSAITYRLKLGCPSEKISEPALKSMTSDLSAIESKTSMSKDANKXVFFRRKALSIRFKEVPPTKDLKLGTSYVFPGQYRGFLFLSKAL

SEQ ID NO: 1107 - protein, 103 aa, Chlamydia trachomatis
LSKNFLSPIEHMIRTTGIPVTLVRYGSLFSFFFNPNRPNNLADAQLSDIEAFQKFYQSAFSKGVYLSPSPFEASFLSAAHSMESLDYAQTALIESLEQVFSLV

SEQ ID NO: 1108 - protein, 105 aa, Chlamydia trachomatis
DPVKTPLLVFISLMRSLSLLLCVSLIYCATTAFCSSEVRRSTKGCSGAKAKKETPIKVSGLVVKTSIAPCSVAKLTEAPEDFPIQFFCNCLTLSGQSSSSSPSRS

SEQ ID NO: 1109 - protein, 96 aa, Chlamydia trachomatis
VLIKHILPYALFPVISYSAFLITTLMTGTFSIENLFCIPGLGKWFICSIKQRDYPITLGLSVFYGAFFMLTSLCCDLLQAWIDPQIRYSYGKERSK

SEQ ID NO: 1110 - protein, 112 aa, Chlamydia trachomatis
LDFKTFMATTVNPNYSLPFCEKMVSSATLAAHSFFNHLKLLIPLLVGYFCTIIRSSNLNRCDYDYTLYCSKLLSFSGSYFGYRRGGFMRSFKRPLFSVTQSKGSTLLHISCD

SEQ ID NO: 1111 - protein, 363 aa, Chlamydia trachomatis
MVSMSLNLPPAEVRLRPVTAKSFPNSSAWRATQKRITGCSLNASSYRPSSARVISFVVGVLVVLGWICCRIAYLANSRVLTFPKMFAIAILPFILFGGGLAILFRIAGKVDVLYGKKIQPFISRQWERVILCEKEGEFIRPIQEPDMYMDVSLLDRTGSGIAPVYTYPPMDARTVICVVTSILLPIFSIVRMLYNIFRFFIVPFYILFQMVRQNYQTDIPKEERFVCSDIVREMTRSLLQAVKAPFYGAACYLANLYGLLNPLSGRVVLASLERDWNNDVIRSRGVWGIFCEKNYMFEGGGTRSGLGQNAWYLLGCFQPAQLFLLKDGVIISGARPSIQSFPESKEYLASFLYGAVPGRLASF

SEQ ID NO: 1112 - protein, 100 aa, Chlamydia trachomatis
LNLQEGFAGMLYALPESQVLYLKATALQGHKALEFWIACDDVYFRGMLVSVNHTLYQVFMVYKGRSPEILDKEYSTFIQSFKVTKVRNSKKMDIRKRVSL

SEQ ID NO: 1113 - protein, 135 aa, Chlamydia trachomatis
VIKHLRSYCLYLAWLFSCIGTLMSVYYSYILNVEPCLLCYYQRICLFPLVVILGIAAYREDISIKIYTLPLALVGFGIAIYQVCLQEIPGMTLDICGKVSCSTKLFLLGFITMPMASAAAFCAIACLLVLATKSK

SEQ ID NO: 1114 - protein, 96 aa, Chlamydia trachomatis
TRTRWESSEICCNRGMASQIKVTSAQSGHISYQRNPKQFDQAILDMLRLFCLGYFPQLFEKQKNLLEDLIYNKLFVEKTVVMGEGACVVNLAIGGG

SEQ ID NO: 1115 - protein, 87 aa, Chlamydia trachomatis
VMTISSTTTPSKSSSCFQFRETNKEPVKTYRVTSIALVAIGLLLLMISSLLLLLRVPMTMPCLVISSSCMSCGVVLVGSKIEGICFG

SEQ ID NO: 1116 - protein, 104 aa, Chlamydia trachomatis
KMVKKKFCVIQKHLFPSYSPKLVDIVKRYKREAKILINKLAFGMLWRHRAKSQILTEGSVRLDLQGFTESKYNYQIQVGSHTIAAVLIDMEYFQDSIQIRTSLM

SEQ ID NO: 1117 - protein, 105 aa, Chlamydia trachomatis
RSLQSARLVWMRVRSETNFCFCARVSSAEVCTADAPHLGSRINACNFSTADCTPRKDCLGCKDIARLSSLRKVFPSLIALCTPSTNGVTPPAALPICKIVSIKSR

SEQ ID NO: 1118 - protein, 111 aa, Chlamydia trachomatis
LFRLSVFMRKNGDWLDNGAGGRVMLYVNTKNSAGKTMRRLLGIAVCLGSTWYTTVPMFWCAATYYATSSGFFQLIVGERNFRFLLSLGVWFGYLLFLNGALFYLHRLACFS

SEQ ID NO: 1119 - protein, 106 aa, Chlamydia trachomatis
  VARIANT (1)...(106): Xaa = Any Amino Acid
ESTDWRNSFVKPSVEAPAAGEAVIENLNFPSGVWRAVRACXFKQHCLYFFPDPQGQGSFLLGFFNINSFLSLLIRKINYKEPSLQPQFLQGTHRFLVARGARARGY

SEQ ID NO: 1120 - protein, 84 aa, Chlamydia trachomatis
GIWLAEKTFARTGLWIRSACSVALSQSIDTVIFSFLGLYGLVANLPDVMMFSLLSKGTALLLASPCVALAKVFYNRLNKEEAHF

SEQ ID NO: 1121 - protein, 132 aa, Chlamydia trachomatis
MNIFVLKQIVLFGFEVTAADVYVIGLFSCLNCAREFWGKESTKKVIFVSWCSTLSFLILTQLHLHLKPSPGDISQLHYEALFAPSLRIISASVITTMIVQFVDFKVFGWLKKHSRGRVFGFVPHAPLRFLKA

SEQ ID NO: 1122 - protein, 125 aa, Chlamydia trachomatis
MLRPPSFLKKLLSSVRNNFIIKSILKAPKVLYHNGASKEACVLSYYGLFSCVPILVFFLRLSQYLFISLDWKEWLLLHFPDYKAPILAIIEAAYSTTSNIGVVLVSSFFVFCWAGILMLQSLEVG

SEQ ID NO: 1123 - protein, 85 aa, Chlamydia trachomatis
MTTATTSQTALRSRKDVPLSDCWDTKSLYASREVWQDELKKVGAEGAPFWPHLSENNFDIKQPSSLRELLTTVFSIERTLDKLYV

SEQ ID NO: 1124 - protein, 162 aa, Chlamydia trachomatis
MISMIPRFSIACIPLAVWLFSGAKMLVKSLYLALHYQFSLVLSAELFAIAWILASIKHRFILRKSMLKQHELDAQLLIKEISPWTFIKRSFLSKRMFVIISMSVISSLLHRSTTIPLLSFLMCSSVSYALFKTSLAHWKSLKELKSKYSVYYYLITLQLPQP

SEQ ID NO: 1125 - protein, 75 aa, Chlamydia trachomatis
LGEHPPMHRKLMHQKTMAIDGELAWIGSANFTLASLEKSANLIIGLKSAEICHFIKTQTSGRCFINNQLIEYCFL

SEQ ID NO: 1126 - protein, 147 aa, Chlamydia trachomatis
LVSFLLFPRYFPEWRPVYFAPLIVTTFYSQPKERVLLWAMLSGLLCDMGSTCFMGIQAFLYVSTSLILYKTQRFFIKERWISFPLISALFSLTFYFLSYPVLAFFNRPLCLYNTALLADLQHVLMVDLPYGALLSLLAHKKSFTPQI

SEQ ID NO: 1127 - protein, 130 aa, Chlamydia trachomatis
LCSILSKLLRRMGRRNQNQRETSFRKILAVASSATPEILHLHDHAIATSGSQYQRWHVDNKTYTHILDPLTGTPLEDSSHPILAVSVINESCAFADAMATALTTFSSKQEALDWANKKHLCAYITDKNVS

SEQ ID NO: 1128 - protein, 92 aa, Chlamydia trachomatis
IPANTTGLISLKPSKGSLAGCLTVVTVSPIFTSFTFFRLAMKYPTCPARKDPSMRVASGKKAPIPKTSKEEPLVAMKVMRSPFLISPLITRT

SEQ ID NO: 1129 - protein, 151 aa, Chlamydia trachomatis
MQNILRTSSCRYMFLLGIRSVWNRVAVVNNFRGSSWKIVAIPSCILFTLIFHLPRWLIDFGVCTNLACSLSIIFWVFSLRSSASARIFPSLLLYLCLLRLGLNLASTRWILSSGWASPLIFALGNFFSLGSIPVGSYGMFTPVFSEFSRHN

SEQ ID NO: 1130 - protein, 165 aa, Chlamydia trachomatis
LALRGFPVSIIEQDYLRMKSERLKKLESELHDLTQWMQLGLVPKKEIERHQEEIRLLESKILEEKERLQLLKESGEIKEYVTPRRTPAKTIYPDGPSVSDVEFVESSDTEVDLDAGDTIEIDLGDEAREESGNELDYSSEDDEDPFSDRNRWRRGGIIDPDANEW

SEQ ID NO: 1131 - protein, 78 aa, Chlamydia trachomatis
MEELPPNERIKETLALRLRLCDPIPFGVFPQELVDEILMHPSIGSLFTKDDKAFSLNKKGRLFHDSIAEEIMASSFSF

SEQ ID NO: 1132 - protein, 174 aa, Chlamydia trachomatis
VVDAYRICILLVWLAGALLVPDDDVGFSSCESPPDPELPPELLLFGLTYFSFNTDPVACTGICSVQDCPEASENFLVIGSGVVGVVGVGDGVADRLYFLEKVFVIDAVVGPLVAGDDVASEVVFFGEDDGDLGVVSVFGGVTVSSREIGSVDVGVVLFGWFQVPCMEKVRIPVF

SEQ ID NO: 1133 - protein, 108 aa, Chlamydia trachomatis
YHATNASRGWRRNSTSSSRNPCIKVLLSYNKRKRVFFLLCLSPPPLLFISSVRFLLNLLVLVFMESLSVRSTIPLPLGAKKLSADRYRFSLFSSQAQQVTLVLLDPPF

SEQ ID NO: 1134 - protein, 114 aa, Chlamydia trachomatis
MASKKQTSWFRYMEECVIRSWWLILCLLGGGFVYDRAISQLCTQELRLQQRMFHLKSHLKEALEKQQELSTHLASWDDPKVIELALIHKLGLVPKGYEKICFQNSQKTKRNHRK

SEQ ID NO: 1135 - protein, 240 aa, Chlamydia trachomatis
  VARIANT (1)...(240): Xaa = Any Amino Acid
LVAEKITTKAFVIFSVLFSLIIGFIASCGFLFAGPPAFIASGLCFALLVSVVSFFGCQKLIPYGIQHLMSYVKSIPSLSSSLIDFLKTESKSISSLYPNPGLKECFKGASPKYKKFFFDHPEKLLSAAFTDWTPQIIPSDSGQPRTIILSHSSLPFSLTLSTLDFETLHTYXIKSNALTCRVGYAHQLPSGNPVMREXKKEFYNNIMIQEMKPSSFLFRKASSCNKKSSLKNSLVTMHRS

SEQ ID NO: 1136 - protein, 81 aa, Chlamydia trachomatis
  VARIANT (1)...(81): Xaa = Any Amino Acid
LLHKGDTCAHRXPTKRAAXSPPVPARNSIITLRSSSGSGGISRFSNCFDRRSTASSPTRTPSSSIATISGSFSVDXASLSS

SEQ ID NO: 1137 - protein, 138 aa, Chlamydia trachomatis
LAFFISYPSAEAHSPLQSSIQEKILTARPGDYAVLSRGSQKFFFLIRQSSSEATWVEVSEFASLTQQEKKLVEQSSWKNAFHQLQSSKKVYLLRISKNPLMIFVLKNAQWMPLSEKDPLPFFVKILRTPFISSPLSLN

SEQ ID NO: 1138 - protein, 171 aa, Chlamydia trachomatis
LERRMGFSRGIGYEKCQEKNKNFKKVLEGAFFLAFFIKMFGYGSPFCYVRFSHTKIVILGLSNGKKTLIPEYRQVLFVDSSTGYKFVCGSTYQTDKTEVFEGQEYPVCYVSISSSSHPFFTGSKKLVDAEGRVDKFLKRYSGIKQSAPKPETVVEDVLPKGKKKSPAKKKK

SEQ ID NO: 1139 - protein, 85 aa, Chlamydia trachomatis
MLRSLIAMHFSIKGTCSLWILQFLLIAILPYRNSLCLKRKKNFNHLKTNLTSHLLTEVLLQNLQRNLFPLLLISVLKFRKATCLS

SEQ ID NO: 1140 - protein, 94 aa, Chlamydia trachomatis
TGTACFKTLRSTSIMRLPSRSITARASKKFSLQSSCSPSRNPLGTPINLGTSNDKACENVPLKKSLVVESLGSRPAKASIARATSSTTVVNGPI

SEQ ID NO: 1141 - protein, 80 aa, Chlamydia trachomatis
MRPDHMNFCCLCAAILSSTAVLFGQDPLGETALLTKNPNHVVCTFFEDCTMESLFPALCAHASQDDPFVCTWKFLLLVRI

SEQ ID NO: 1142 - protein, 102 aa, Chlamydia trachomatis
ANSPMLSPTNSTSKTAPVPPRDSSKPVLISEEPRNQLLQKVARTALAVLLVVVTLGLILLFYSFSDLQSFPWCCQTHPSTKEQPTISIPVPLPSPPLAVPRP

SEQ ID NO: 1143 - protein, 172 aa, Chlamydia trachomatis
  VARIANT (1)...(172): Xaa = Any Amino Acid
MRHLAYLLDKIARSYPHMCPXPDNMEAYXEXXIPNKDIPLDTYQKIFKLSSEDLEQVYKEGYNAYLQGDYEESSTAFYWLIFFNPFVSKFWFSFRSSLHMRQKYQQALHAYGVAALLREKDPYPHYYAYICYTLLNNPEEAEKALDLAWQKVKTSSAYSSLKEEILAIKSYA

SEQ ID NO: 1144 - protein, 91 aa, Chlamydia trachomatis
GLLPTTCCFSNDIEKSFSTYFPNDRGDTSENTQGSCSNAKPFCNSSLFCKGVRDFLRFLHEVCSGRSAFKKILFTAVEHQFHDFRADTQNI

SEQ ID NO: 1145 - protein, 198 aa, Chlamydia trachomatis
MKKFISYLLIILPLIGLWEFCAQNYPSFGFICPPPSKVLTTGIHSFPVLFQHSCYTAQGILGGFFLALLLAILFSATMLLFPSTQGLLHPLCVLVQCLPMFTLAPLIVLWFGWGTRAVIIPTALSIFFPLALTIHQGIKNSPEELLEQFTLYQATTWQKLFKLRIPNGLPHIFSGLKIAMSAADLRPLLENGLQHNLV

SEQ ID NO: 1146 - protein, 140 aa, Chlamydia trachomatis
VTISGIPQLQRTERSLLSIYNHQPLYKRLMDWSFFLLSQSCILFLAADSTTNVEVLNTILGNLSKRSKALHLLRESLFALLGSFVLYPLLSGLLYSLQTPACAVLLSEGVGLCSQECGLFFGILKHPFGVKFLRYPSHLK

SEQ ID NO: 1147 - protein, 108 aa, Chlamydia trachomatis
LACSEIWAINYSASKDPIFAYLILLYAHLATIMYRSCDPVCPSLLTFSSAPQNYLGISSPLGTINIFFVVLKAGMVLANNSVLPALQVMFIPAGFMLLITLYAYRKLA

SEQ ID NO: 1148 - protein, 182 aa, Chlamydia trachomatis
SLTESLKKTTSHPSPRRGISPSGLNNLSHSRHNLNASALDCYMVPINEDYYQVLRLKLHSFFHKKKCVDLLNLHTKHFFISKKLSIAPGKQVRSFIKIMTHIYSGPSFHFGALRKEERLSLRITGRIALYSFLGVIMSVMASDKACAPVRASRPFPKQKLRGARFTGAIRSGNRSRRRGFSR

SEQ ID NO: 1149 - protein, 133 aa, Chlamydia trachomatis
LQQPPTLWSQTCRYSPMRMALDKKKRLTLFVEKRMFRSQKPKKNKCCLWLRGVLFGGFLATLLTSLFLPKSGMQIRKKLLRVKTSGTKKGRALLKNSKHHTREFAEQTKLLAKNISKEIQDFTQSIIDESRRD

SEQ ID NO: 1150 - protein, 145 aa, Chlamydia trachomatis
LRKDDNVKFYLHRLKFPGDREDIHASIPPQVFCDSEEEGMCSPVEIRGSLEMVSGEQWFLSLEISTILSLRCRICDAPVEWPVQGIVIQQLIHCSDERSGVFDCRDLIRDELLLEGDRFQECQEGGCPAREFIKNFLKKRRDVTL

SEQ ID NO: 1151 - protein, 90 aa, Chlamydia trachomatis
VLMHFSNCLYQAFEDQLLPEPLYQKFQICYQTYIEAASKKSPLRKRKLFVLNGLRSLLMTLRILLFSLPTTKKFARQLIFTNLASTFFLR

SEQ ID NO: 1152 - protein, 180 aa, Chlamydia trachomatis
MLLLEQNEDPHQYKDSVATSMLLSWIHNLYFSDLRTEQQLGYMVGSKYLEFAETPCGLFYIRSNNYSPEELVHRTQLFIQKIATDPESAGLSEEIFEQLRETYIQSILLPSSTPLAMAKKLFSIAFETKKQDFSRPDQKIAAARSMDYSYFKKYCEEFLSQKFGPEIQLLVYGANSSQEK

SEQ ID NO: 1153 - protein, 87 aa, Chlamydia trachomatis
MILPHYSSGLRIGSAILFFSAVIHTFLTPWLTRLYEESQHKKMIFPERWRQYLWLSELLRIVSRVELVFVLWAIPLFCLFLYTEAIA

SEQ ID NO: 1154 - protein, 75 aa, Chlamydia trachomatis
MELVVQSRETDKKSVIKKIRQQGGIPAVLYSGGKSLANIVVDARVFSKFLSTLESGAFSFYCVHAFLMKDEKSKL

SEQ ID NO: 1155 - protein, 96 aa, Chlamydia trachomatis
LFFQKRKRTHYFLMNSNIEYRQYRIDILSCFICLLMMVWTLVSIKLGDSLGGIIPGCLGYLLAKRKHRRPVRWFFLTFFFGIASGIFLVVLHPKQK

SEQ ID NO: 1156 - protein, 242 aa, Chlamydia trachomatis
MSLFTTCAPVDTPCIHLTVFQEIFNRYTEKPYPATSILVPLYFPEEPLTFSEDLSPSTAPILNPPGLEPQALPVETPKDPVTTSIPPPSHPKESKHSWACVPIYPGLSHEELLKENYPALKRYIQRPARASCGIFVHESQEHEILFFNRLAKILSQKIFPTRLVLFYQKTLSDFSHSPHPFCLAPLPTIRYKNSQVNYHDPVLHDKVTCIPIYSSSQYEKDSALKRDLWTLLTSLSASMQKS

SEQ ID NO: 1157 - protein, 90 aa, Chlamydia trachomatis
MDNGVLDIRSLSIKVFYAQLSCASGLFVQIVLVFCSRSKTFILSAAFLFAFILVIVKNVEKLLVALAILSDRFFVRKTRVIVLQNNMSRT

SEQ ID NO: 1158 - protein, 82 aa, Chlamydia trachomatis
MMKTKHEYSFGVIPIRFFGTPDRSTLKACFICHTDGKHWGFPKGHAEEKEGPQEAAERELVEETGLGIVNFFPKIFVENLFL

SEQ ID NO: 1159 - protein, 94 aa, Chlamydia trachomatis
TNCCICLFNSIMAASSSSRAFLSSSTIALYCKARSKSRPDPPNNFLSHSNLALSSLRRSILCSRTCRIFNTFSSGQASICSSSRARTLLCAALI

SEQ ID NO: 1160 - protein, 217 aa, Chlamydia trachomatis
  VARIANT (1)...(217): Xaa = Any Amino Acid
VPNRHVDMNSWWRSACYPRSTFYPLSDGDSTFHRRITKPDFRLCSTCWSCSQPILYLYALLVIANHDEISFGLLRYFLGGYRPSKTARLAMSIFQIHGIMLDSQLVKTSISTLTPTLLKKSVLSLLAILHITNQKPIPKYSKGSRGLFVLSRVNSIFTATTISPSLSLRQCPXSLHHSVQVGTYPXKEFRYLSTVIVTAAIHQGLGSMLRFTADISL

SEQ ID NO: 1161 - protein, 90 aa, Chlamydia trachomatis
EAFLQPSFERKLHLMLPPIFYAPIFYQLPKKPFFLTSQFIPSHTILNPFYKTKFSSLFFFFLLILPFLSSIFLSKFFFLALRTSLHLGLF

SEQ ID NO: 1162 - protein, 198 aa, Chlamydia trachomatis
VKGFSSKGGVRLYFYLQGLAFARTERITKKREGINEKGKEGPVDKSALYKKEKALKYYFFVERVFFAVLTFVLGAAFFVGLTFALVAQVLFVQAFLATVFVARTGFLAAALAFLAAALLFFIKPIFSALMDSLRYTFAVFSNLIDSVRTLCAAALFPFSALSKFCWILSNKSVIFFAVSFSAMKKYPLVVVLNYFFQF

SEQ ID NO: 1163 - protein, 82 aa, Chlamydia trachomatis
MTWLSGLYSIFVASAAFCSLDLILVAVILLSRKFLIKVHPCKLKINNDDSLTKTVDSGKTLLSSLLDFRNRYPFSLWRESCL

SEQ ID NO: 1164 - protein, 191 aa, Chlamydia trachomatis
VPNRHVDMNSWWRSACYPRSTFYPLSDGDSTFHRRITKPDFRLCSTCWSCSQPILYLYALLVIANHDEISFGLLRYFLGGYRPSKTARLAMSIFQIHGIMLDSQLVKTSISTLTPTLLKKSVLSLLAILHITNQKPIPKYSKGSRGLFVLSRVNSIFTATTISPSLSLRQCPGSLHHSCRSELTRQGISLP

SEQ ID NO: 1165 - protein, 103 aa, Chlamydia trachomatis
MMRMLEACKFNAISFSKALIFCTLTPVLGRTSKAARVGPEQMFPIAASIPKLANVCCKIAAFFFNSSKRDSGRRTFRLLKRWYCGKSGASPASTNGDGVGKGL

SEQ ID NO: 1166 - protein, 180 aa, Chlamydia trachomatis
  VARIANT (1)...(180): Xaa = Any Amino Acid
RNSGADMLFWGIFSLCLGGLFGGYCRLRYTAKALLLSWRQLLRLALKKREVLQEIAALQTFPLLRLEEEIAFLKQGSSYSLKEFLKASDADGVTFYEMERFFTLRLKQTLASLQXSLHQEAVQHLMEELLAYENAFSFEAFAFEKAAETYTTLHGHPVIRFSGKLFRFPQISFPPLDEAI

SEQ ID NO: 1167 - protein, 92 aa, Chlamydia trachomatis
VCGQKLQLLLVKSEWRYLRCTKIRLRNVEKPLSPFRKEGWLVGCLPREGACFVNFCPVHSYTIGCPVGNSKESTCSSDNFSRSIIKERKEFP

SEQ ID NO: 1168 - protein, 109 aa, Chlamydia trachomatis
MLLLCSMRKRRKKLIVLSVEVFLSIVIAQEYVIVLVKRWQKTFYNIMWGSLIERYVIFRRVFGIQMSKGIRGLFLFVRITLKNLQIFWLKSCIWTVISLKIRSMPKLLY

SEQ ID NO: 1169 - protein, 105 aa, Chlamydia trachomatis
LFNRSRTFFSCFLILRTVLYRLDNRFSGCMWIFLPRKSLVISWIGNGFLLLFYLLSYTEIDGIHSTTSITLFLFPEFRSFFFLFGYLLFKSLFFLCSSCLLSRAL

SEQ ID NO: 1170 - protein, 179 aa, Chlamydia trachomatis
LITVKTRRAKALYSELFATKQVKKLYVAICINAPSQELIHTRITRHPLKRKEMTVLSTHAEGGKEAITHCHVLATNGRLSVVALYPETGRTHQLRVHMKHLGTPILGDPVYGIPSINFRYGLDKQQLHAYSLVFAHPESAERVKLVTKLPDDMTSLIEKEFREGVSILDGSCDWFKITR

SEQ ID NO: 1171 - protein, 80 aa, Chlamydia trachomatis
MKRSYISCPFCSPIFAIRACRNWSKERTGPSKVIFDGDINSSFTWPETEVTPWFRTDRLAMNCVSITRDSPNTKIFLYFT

SEQ ID NO: 1172 - protein, 140 aa, Chlamydia trachomatis
LLSRRAGVPVIISLLFSELSPDQEVYRDAVAAAFQGVRSCHTCFSYSWGDFSRKACSYWIKKRLWSLSKLAFASALAIFIGGGVESLLLVHKAQQIFREIAPEKEITRVFRSAQQVVKEVCDSDHSWEYEYLLRYPRIKK

SEQ ID NO: 1173 - protein, 98 aa, Chlamydia trachomatis
MLSYLLRTAVNIYSFLILVYVLCSWLPECHNTQWYRIIRRWVSPYLRIFHKFVPRIGFIDISPMIALLCLGVLPFMILKIVRFIVLNIFQSPWLLQYL

SEQ ID NO: 1174 - protein, 107 aa, Chlamydia trachomatis
VKTASLVKIFARLISSDKTRISSCSLARLSEANLYSEFSLKSPKALASSISLAFSTISFPTRDCSLFFIRVKLSEVVQRIFSSSSRVPLLRAGCTTSAKLLKTPRSP

SEQ ID NO: 1175 - protein, 112 aa, Chlamydia trachomatis
VGGNESIAKYNNVFFVWQSYISLELFAYSKNPLSYYWSFPSHTACLQCIPKLYPYKSRILGLIIVFLNFGISTVLESTMMLATTETSFKIGLFPPSFILSILFFFLFYCLFT

SEQ ID NO: 1176 - protein, 103 aa, Chlamydia trachomatis
KVMSSLNLHTLGINCGQRVRRDKKAVRYLQLFQSLRRGDLFQEWQPNHKNIRFVVLLVNNAKRKFLLGENSNVDREGYLLRKREEQALFVINFRKYILFQLFL

SEQ ID NO: 1177 - protein, 84 aa, Chlamydia trachomatis
KLIFFLKSVTLYNSFLFLCCYAPTSFLFLSMDKRRRLDRRDRRGMLSSYSRGEAACVFRGLGATRLFYRGRTPGFTESVCVPWL

SEQ ID NO: 1178 - protein, 91 aa, Chlamydia trachomatis
  VARIANT (1)...(91): Xaa = Any Amino Acid
IEPMHFIFTLLCLTSLVTVVSLDAAGTRKRISYAKLQEKEEVAFSAQQSAISEVIXRDKTNDCLPRRKKQSLVRKIRSVIVSLFGRSAIDC

SEQ ID NO: 1179 - protein, 157 aa, Chlamydia trachomatis
LIKRKNQVWLMADEMQKESSSQEPSASKFGSLKQKVRDLHTNPKVGGMKRFLSRHACEAIGGALIVFGIIANCVSWVGGLFVASGIVLGFYPEILAVLQNLQSYYAKNGPIKNALVCGVALFWLIKAPSFVLSFIVLCIIVILLAQGQHKDTTSRHE

SEQ ID NO: 1180 - protein, 79 aa, Chlamydia trachomatis
LLIVGTALSLSIRNNTLTFLFFLSCYHFSSLRFYPPRCTIREMYLSEGPLFSFPRKAWKENPLPSDNHLIWIVAILNTH

SEQ ID NO: 1181 - protein, 131 aa, Chlamydia trachomatis
LFRLRKRTPMFIKSFVHLCLLFSLTPTGLFSAAPISAHPSVTKKLSLRQLFKRFLPETSHNKKERYYHFLKHVSHALKRPEIWNDLQNLLLILMQFEQFANQEVGSRRYEEILSQINRKKNSFPIIRATGF

SEQ ID NO: 1182 - protein, 118 aa, Chlamydia trachomatis
PGFHYIATLSIPSWMQHAQSRSLLPKQWNIKFPRSLLPITGICLARSNFIRPVNKTRLNLSSGVSYTSHPLLVSIKKKNEKAELPTISSFFVKMKKGIATFVCSPLLLTQKVFTMCLA

SEQ ID NO: 1183 - protein, 95 aa, Chlamydia trachomatis
SHLFKVLFLRKERDHYVTPKEFSGLLENLLLFSLLFLLFDTPYSPLIHPQYAASSPLLPLFTQQMYCLLKAIKLNERSVDDITTIVQYDARAGLA

SEQ ID NO: 1184 - protein, 88 aa, Chlamydia trachomatis
  VARIANT (1)...(88): Xaa = Any Amino Acid
YFXNIHTYPYFFQLLNGKLILLLITSLLLKGSLSAHIPVLYLLSLPCKSIFTKSKTGLTSPCSRGRGILNRLHAIMIFRXAQAHYVFQ

SEQ ID NO: 1185 - protein, 87 aa, Chlamydia trachomatis
  VARIANT (1)...(87): Xaa = Any Amino Acid
LLKKKKDNIRVSLSGFCMLGRAQRTLKRKVCYSGVGVHFGKAAMLTXEPAEENTGVFSLVMQLLNSIFPLDWRMFVERDVALAPHCL

SEQ ID NO: 1186 - protein, 97 aa, Chlamydia trachomatis
LCVKSFRLNKNMVAVFICKFHDFILNRGAISWPNSFDSPSIQSGTMQIFGYKIFCLISGMSNVTRNLWQCRNKHLVSMNETNVMITWLLFHYRKINR

SEQ ID NO: 1187 - protein, 90 aa, Chlamydia trachomatis
ELFSDSPMLFHIFVGIPIQEQILHLEPPLRIISFYGKRFLGIYSETKESFHSDEVAELLKTALLQLKRVAFRNIQTYQATPIIIPEILIG

SEQ ID NO: 1188 - protein, 137 aa, Chlamydia trachomatis
NISYFTPIYRGSFYFRMDFMSVVPQSPCSSPTNFYRRLSVSWRASLSPRARYEVGSLLAIVGLILTLIGAASIHAVLLQSVATPAILSLCSAFSIRPLATAIFSVIVGLALLIGGIFLLPVQQETPHSSLRYLATTP

SEQ ID NO: 1189 - protein, 109 aa, Chlamydia trachomatis
HHIKVMQTSRISSFFRGLVHLYRWAISPFLGAPCRFFPTCSEYALVALKKPPLRKSLFLIAKRLLKCGPWCIGGIDLVPRTSVEEYLSSPTPLAESPDDRTVPHTHETS

SEQ ID NO: 1190 - protein, 178 aa, Chlamydia trachomatis
MSTPPTDAHCLFDPIRCKPVPPFPEEHVRQALLSFLIQELSYPQQQIIVEKGIKSCIPASLPPLPKKMRGRADVLILSPSSYVSSEGASISFPHPQPLLLIECKAKTVTSLSFSQLISYNYFIGAPCLSLISANSQLTGFLSPKTKTFAFYQGIPSYSQLMNFYIHTFSCKSPFPELF

SEQ ID NO: 1191 - protein, 93 aa, Chlamydia trachomatis
  VARIANT (1)...(93): Xaa = Any Amino Acid
LRCVICNLVKNAVEASDEEIFLELHEKGFXVINTGTLPPNIQXKLFIPFFTTKPQGNGLGLAEAHKIMRLHGGDLVVSTQDNRTTFTILWTPA

SEQ ID NO: 1192 - protein, 81 aa, Chlamydia trachomatis
NVINAGDWTRTNTLLLRVDFESTASTIPPRRHNHLGLKTEEEIEFLPLTGNILKRTKYKGEKVFLLRKIRSAEVFTHDELQ

SEQ ID NO: 1193 - protein, 130 aa, Chlamydia trachomatis
  VARIANT (1)...(130): Xaa = Any Amino Acid
MRLDSYEVYFFDLDGLLIDTEPLFYQACLETWQKYKVSVELSFSQYYSLAMQGRERFQEALIQLFPETRAFXPSYFLDRDRCYHDLLSCEQIQLMPGVETFLSLLEGKCLGVVTNSSKESTLRIRKNIRF

SEQ ID NO: 1194 - protein, 82 aa, Chlamydia trachomatis
YKNRRDEKMKRFFLFIVATAALLTQGCSYEPPKREYILAQKCSPLFKHARTLDFSLAQAVFEMTFFTKAPPCVSSLEELSQN

SEQ ID NO: 1195 - protein, 133 aa, Chlamydia trachomatis
LLIKCFLRILLVQKLENKTCIMKVVVNPTQEYSQISTPVLPQNQRVTFFRNTAMLTCSLLFTLCSAVLFIIGLFPQTTIPFAGAFFVIGMFLAFSALCIFLMALIYNVKNWLSHRPIPLPLFSNINFLVTKEK

SEQ ID NO: 1196 - protein, 225 aa, Chlamydia trachomatis
MPLYLGLNPSSAKQYSAVFQPIIRIVPFSKHVPQIRHARKFLVSASHILLTSPSSTACFFSSIRKRIPLSLFRNKSFVTIGEASSSRVKAFLPKANIVQSAFPQAEAFLPILSTLPSSSSLLYPHSVLARPILRSLLQTLPFSSFSYPHYTVKPITLSVSTFLPHKTIILTSPSIVARGAYAQLFPCLPDKEHWCLGEISAAEFKQIFHTPPSKILFSTKEPTGC

SEQ ID NO: 1197 - protein, 103 aa, Chlamydia trachomatis
DYLVACCSCSRWCCRRCGCSCSGKVSCTRCVCSSYCRRRRSIRAFSLIRGVIIILLLGIITILVTFTICRWGSTASTCSSVYDSQFWRSKDISFSNTIFLYAG

SEQ ID NO: 1198 - DNA, 20 bp, Artificial Sequence
  Primer
cgtgggagttgttgtattgg

SEQ ID NO: 1199 - DNA, 20 bp, Artificial Sequence
  Primer
ccgcctttcttagcagtgtt

SEQ ID NO: 1200 - DNA, 20 bp, Artificial Sequence
  Primer
cttcccttcacggttgatag

SEQ ID NO: 1201 - DNA, 20 bp, Artificial Sequence
  Primer
cagaggtgtaagtctgagag

SEQ ID NO: 1202 - DNA, 20 bp, Artificial Sequence
  Primer
gctcctagtagaaacttggg

SEQ ID NO: 1203 - DNA, 20 bp, Artificial Sequence
  Primer
ccccactcgattggattcaa

SEQ ID NO: 1204 - DNA, 20 bp, Artificial Sequence
  Primer
ggcgccggtaccggacagat

SEQ ID NO: 1205 - DNA, 20 bp, Artificial Sequence
  Primer
gcatagacgattagagctcc

SEQ ID NO: 1206 - DNA, 20 bp, Artificial Sequence
  Primer
gttcttggttgcaagccatc

SEQ ID NO: 1207 - DNA, 20 bp, Artificial Sequence
  Primer
cccccgttcttaggaaatag

SEQ ID NO: 1208 - DNA, 20 bp, Artificial Sequence
  Primer
gaaaaacgcaggaagttgag

SEQ ID NO: 1209 - DNA, 20 bp, Artificial Sequence
  Primer
cgtaatacgtcttcttcggc

SEQ ID NO: 1210 - DNA, 20 bp, Artificial Sequence
  Primer
cgcggaaaataagaagaggg

SEQ ID NO: 1211 - DNA, 20 bp, Artificial Sequence
  Primer
ctcttcaggaaagctcttcc

SEQ ID NO: 1212 - DNA, 20 bp, Artificial Sequence
  Primer
gccgtaagaggcttcttcaa

SEQ ID NO: 1213 - DNA, 20 bp, Artificial Sequence
  Primer
cgcagatgaaattcgcacac

SEQ ID NO: 1214 - DNA, 20 bp, Artificial Sequence
  Primer
cgctcaagataccacggttt

SEQ ID NO: 1215 - DNA, 20 bp, Artificial Sequence
  Primer
atcccaacaacgttgccgat

SEQ ID NO: 1216 - DNA, 20 bp, Artificial Sequence
  Primer
gtctgtgggataggcactat

SEQ ID NO: 1217 - DNA, 20 bp, Artificial Sequence
  Primer
cctagagctccagcgaggat

SEQ ID NO: 1218 - DNA, 20 bp, Artificial Sequence
  Primer
ctatgggcgaggtcctgatg

SEQ ID NO: 1219 - DNA, 20 bp, Artificial Sequence
  Primer
ggcgaacctaatgtacgcaa

SEQ ID NO: 1220 - DNA, 20 bp, Artificial Sequence
  Primer
cacaacaactccatcagcac

SEQ ID NO: 1221 - DNA, 20 bp, Artificial Sequence
  Primer
gtagcttctccgtcgatggc

SEQ ID NO: 1222 - DNA, 20 bp, Artificial Sequence
  Primer
tgcggttttcttgcgtttgc

SEQ ID NO: 1223 - DNA, 20 bp, Artificial Sequence
  Primer
gccgataaggagatagctct

SEQ ID NO: 1224 - DNA, 20 bp, Artificial Sequence
  Primer
ggtgaagaggatatccttcc

SEQ ID NO: 1225 - DNA, 20 bp, Artificial Sequence
  Primer
ggaccgaaaaacccttgcgg

SEQ ID NO: 1226 - DNA, 20 bp, Artificial Sequence
  Primer
ccttcaggtgagtgtacaga

SEQ ID NO: 1227 - DNA, 20 bp, Artificial Sequence
  Primer
cagaaagattggcgaaggcg

SEQ ID NO: 1228 - DNA, 20 bp, Artificial Sequence
  Primer
gactggagctcttattggca

SEQ ID NO: 1229 - DNA, 20 bp, Artificial Sequence
  Primer
gagattatgctgcgcatggt

SEQ ID NO: 1230 - DNA, 20 bp, Artificial Sequence
  Primer
ggatggaatttacggtggag

SEQ ID NO: 1231 - DNA, 20 bp, Artificial Sequence
  Primer
tagttcgattagggtgcagg

SEQ ID NO: 1232 - DNA, 20 bp, Artificial Sequence
  Primer
aggtttccctagcagctctt

SEQ ID NO: 1233 - DNA, 20 bp, Artificial Sequence
  Primer
cctttgtcacctttacgtcg

SEQ ID NO: 1234 - DNA, 20 bp, Artificial Sequence
  Primer
gccagtctcctccaactcgg

SEQ ID NO: 1235 - DNA, 20 bp, Artificial Sequence
  Primer
gggttgtttctccaggagat

SEQ ID NO: 1236 - DNA, 20 bp, Artificial Sequence
  Primer
aagtctggggttagtagggc

SEQ ID NO: 1237 - DNA, 20 bp, Artificial Sequence
  Primer
gacgtacgcttgaggtagtt

SEQ ID NO: 1238 - DNA, 20 bp, Artificial Sequence
  Primer
cgtcgatagtgatgaatggc

SEQ ID NO: 1239 - DNA, 20 bp, Artificial Sequence
  Primer
catcggggaactcttctgta

SEQ ID NO: 1240 - DNA, 20 bp, Artificial Sequence
  Primer
gcggccgctgttggatcagg

SEQ ID NO: 1241 - DNA, 20 bp, Artificial Sequence
  Primer
gatctccatccaaagcacct

SEQ ID NO: 1242 - DNA, 20 bp, Artificial Sequence
  Primer
actgcctgacgttttgcagg

SEQ ID NO: 1243 - DNA, 20 bp, Artificial Sequence
  Primer
gccataacagtcaagatacg

SEQ ID NO: 1244 - DNA, 20 bp, Artificial Sequence
  Primer
gcgaataggacgatctccta

SEQ ID NO: 1245 - DNA, 20 bp, Artificial Sequence
  Primer
cctgcatagcttctccgatt

SEQ ID NO: 1246 - DNA, 20 bp, Artificial Sequence
  Primer
cgataggaggaaggaaatcc

SEQ ID NO: 1247 - DNA, 20 bp, Artificial Sequence
  Primer
gcatcgcggatcatttgttg

SEQ ID NO: 1248 - DNA, 20 bp, Artificial Sequence
  Primer
ccgaactcagatcggaacaa

SEQ ID NO: 1249 - DNA, 20 bp, Artificial Sequence
  Primer
gcaactttgtaggggactgt

SEQ ID NO: 1250 - DNA, 20 bp, Artificial Sequence
  Primer
ctcatagggaaggaagtgct

SEQ ID NO: 1251 - DNA, 20 bp, Artificial Sequence
  Primer
ctaggtagagcttagttgcc

SEQ ID NO: 1252 - DNA, 20 bp, Artificial Sequence
  Primer
gagtctgaggacacagacta

SEQ ID NO: 1253 - DNA, 20 bp, Artificial Sequence
  Primer
cgaatgttaggagtcgcaac

SEQ ID NO: 1254 - DNA, 20 bp, Artificial Sequence
  Primer
gtgcgagcgatttttcttgc

SEQ ID NO: 1255 - DNA, 20 bp, Artificial Sequence
  Primer
agaggcttcccaattctagg

SEQ ID NO: 1256 - DNA, 20 bp, Artificial Sequence
  Primer
ggttgggtggtatctccaat

SEQ ID NO: 1257 - DNA, 20 bp, Artificial Sequence
  Primer
ctctgcgctaatctggttca

SEQ ID NO: 1258 - DNA, 20 bp, Artificial Sequence
  Primer
cgtagttcgatacctccttc

SEQ ID NO: 1259 - DNA, 20 bp, Artificial Sequence
  Primer
ctgcagggacaacagcataa

SEQ ID NO: 1260 - DNA, 20 bp, Artificial Sequence
  Primer
gcaaacgctgcctgtaacaa

SEQ ID NO: 1261 - DNA, 20 bp, Artificial Sequence
  Primer
ggatcggaaatgaaggtgct

SEQ ID NO: 1262 - DNA, 20 bp, Artificial Sequence
  Primer
cgggtaactgaagttccaga

SEQ ID NO: 1263 - DNA, 20 bp, Artificial Sequence
  Primer
ccgcgatagaaatcttccga

SEQ ID NO: 1264 - DNA, 20 bp, Artificial Sequence
  Primer
tatccccggattctcgagtg

SEQ ID NO: 1265 - DNA, 20 bp, Artificial Sequence
  Primer
gcaaacgctgcctgtaacaa

SEQ ID NO: 1266 - DNA, 20 bp, Artificial Sequence
  Primer
gagacggcatcatgatgaga

SEQ ID NO: 1267 - DNA, 20 bp, Artificial Sequence
  Primer
ctgctttgaggttgatctcg

SEQ ID NO: 1268 - DNA, 20 bp, Artificial Sequence
  Primer
tcatccggcagcttttgtca

SEQ ID NO: 1269 - DNA, 20 bp, Artificial Sequence
  Primer
gtgtgcagggaagagatttc

SEQ ID NO: 1270 - DNA, 20 bp, Artificial Sequence
  Primer
cgggaattcctggtgctatt

SEQ ID NO: 1271 - DNA, 20 bp, Artificial Sequence
  Primer
gctttctgattgtaaggtgg

SEQ ID NO: 1272 - DNA, 20 bp, Artificial Sequence
  Primer
gagactatcggttagtgcct

SEQ ID NO: 1273 - DNA, 20 bp, Artificial Sequence
  Primer
cgccagtaccaactaactga

SEQ ID NO: 1274 - DNA, 20 bp, Artificial Sequence
  Primer
tgcaacgcgaaggaggagaa

SEQ ID NO: 1275 - DNA, 20 bp, Artificial Sequence
  Primer
ggagatcagttggttcaagc

SEQ ID NO: 1276 - DNA, 20 bp, Artificial Sequence
  Primer
ggcgttatgtgtttaacttg

SEQ ID NO: 1277 - DNA, 20 bp, Artificial Sequence
  Primer
cgtacattattggctgcaga

SEQ ID NO: 1278 - DNA, 20 bp, Artificial Sequence
  Primer
gctgcaatagctttaggagc

SEQ ID NO: 1279 - DNA, 20 bp, Artificial Sequence
  Primer
ccgcgctggtttttcaagat

SEQ ID NO: 1280 - DNA, 20 bp, Artificial Sequence
  Primer
ccgtcgctgttttagagcca

SEQ ID NO: 1281 - DNA, 20 bp, Artificial Sequence
  Primer
cctcgcaatcattttgcggt

SEQ ID NO: 1282 - DNA, 20 bp, Artificial Sequence
  Primer
aacacgatcattgtgtcagc

SEQ ID NO: 1283 - DNA, 20 bp, Artificial Sequence
  Primer
ggggctcgcaatatgcaaaa

SEQ ID NO: 1284 - DNA, 20 bp, Artificial Sequence
  Primer
ggagtatcctcaagcgactt

SEQ ID NO: 1285 - DNA, 20 bp, Artificial Sequence
  Primer
gcaaggcagaatatgtcgtc

SEQ ID NO: 1286 - DNA, 20 bp, Artificial Sequence
  Primer
ctgcagaagtattacgggag

SEQ ID NO: 1287 - DNA, 20 bp, Artificial Sequence
  Primer
gcgcaagctttagctgtttg

SEQ ID NO: 1288 - DNA, 20 bp, Artificial Sequence
  Primer
acaagttatgcggtcgggat

SEQ ID NO: 1289 - DNA, 20 bp, Artificial Sequence
  Primer
aggcctttctaccgaacaat

SEQ ID NO: 1290 - DNA, 20 bp, Artificial Sequence
  Primer
ggaccacaatccctatggat

SEQ ID NO: 1291 - DNA, 20 bp, Artificial Sequence
  Primer
gcgatgcttggagtttggaa

SEQ ID NO: 1292 - DNA, 20 bp, Artificial Sequence
  Primer
gttcgctccaggagttacaa

SEQ ID NO: 1293 - DNA, 20 bp, Artificial Sequence
  Primer
gacggccaggcaaagttttt

SEQ ID NO: 1294 - DNA, 20 bp, Artificial Sequence
  Primer
gagaagatgccaagtcacag

SEQ ID NO: 1295 - DNA, 20 bp, Artificial Sequence
  Primer
cctggaacagaaagggcttt

SEQ ID NO: 1296 - DNA, 20 bp, Artificial Sequence
  Primer
gcaagtaggatagcgaccat

SEQ ID NO: 1297 - DNA, 20 bp, Artificial Sequence
  Primer
gcagaagtacctttatcggc

SEQ ID NO: 1298 - DNA, 20 bp, Artificial Sequence
  Primer
gctagtaggagaccgtttct

SEQ ID NO: 1299 - DNA, 20 bp, Artificial Sequence
  Primer
gatcccattggatgtcacga

SEQ ID NO: 1300 - DNA, 20 bp, Artificial Sequence
  Primer
ggtgtaggggacgatattga

SEQ ID NO: 1301 - DNA, 20 bp, Artificial Sequence
  Primer
gggcacttaaagctctctct

SEQ ID NO: 1302 - DNA, 20 bp, Artificial Sequence
  Primer
gtttgggagagatgaggtct

SEQ ID NO: 1303 - DNA, 20 bp, Artificial Sequence
  Primer
aacagcaggcgctgcatttt

SEQ ID NO: 1304 - DNA, 20 bp, Artificial Sequence
  Primer
cagcttcagctccctcaaac

SEQ ID NO: 1305 - DNA, 20 bp, Artificial Sequence
  Primer
tggagaagcagagaggtgta

SEQ ID NO: 1306 - DNA, 20 bp, Artificial Sequence
  Primer
ggatttagctcagctagcga

SEQ ID NO: 1307 - DNA, 20 bp, Artificial Sequence
  Primer
gggggatgatatttagaggc

SEQ ID NO: 1308 - DNA, 20 bp, Artificial Sequence
  Primer
ccgtcttggtttcttctcct

SEQ ID NO: 1309 - DNA, 20 bp, Artificial Sequence
  Primer
ccacctgctcctataatagc

SEQ ID NO: 1310 - DNA, 20 bp, Artificial Sequence
  Primer
gtatgaagttgccctggtct

SEQ ID NO: 1311 - DNA, 20 bp, Artificial Sequence
  Primer
gacaaatggtggtaagggag

SEQ ID NO: 1312 - DNA, 20 bp, Artificial Sequence
  Primer
ccccaaaatatgggcgtaag

SEQ ID NO: 1313 - DNA, 20 bp, Artificial Sequence
  Primer
ggatggcagaatctgcgata

SEQ ID NO: 1314 - DNA, 20 bp, Artificial Sequence
  Primer
gcaaggatgggtaatgcatc

SEQ ID NO: 1315 - DNA, 20 bp, Artificial Sequence
  Primer
ctcgaatggctacacaagga

SEQ ID NO: 1316 - DNA, 20 bp, Artificial Sequence
  Primer
caggagtttctgtatcagcg

SEQ ID NO: 1317 - DNA, 20 bp, Artificial Sequence
  Primer
gcatgtgcaagtctttcagg

SEQ ID NO: 1318 - DNA, 20 bp, Artificial Sequence
  Primer
gggagcttctgcatgtgatt

SEQ ID NO: 1319 - DNA, 20 bp, Artificial Sequence
  Primer
gaggaacagcaatttctccg

SEQ ID NO: 1320 - DNA, 20 bp, Artificial Sequence
  Primer
gcatggttctcgtttaggga

SEQ ID NO: 1321 - DNA, 20 bp, Artificial Sequence
  Primer
gctcactatctctatgtgcg

SEQ ID NO: 1322 - DNA, 20 bp, Artificial Sequence
  Primer
ggattcggctacctatgttc

SEQ ID NO: 1323 - DNA, 20 bp, Artificial Sequence
  Primer
ggaggagtccttttaggaat

SEQ ID NO: 1324 - DNA, 20 bp, Artificial Sequence
  Primer
cctcaggctataacaaaggc

SEQ ID NO: 1325 - DNA, 20 bp, Artificial Sequence
  Primer
gccagagtctgttcgtgatt

SEQ ID NO: 1326 - DNA, 20 bp, Artificial Sequence
  Primer
cgtccacctctttctatacg

SEQ ID NO: 1327 - DNA, 20 bp, Artificial Sequence
  Primer
gagcggcattgactgaaaag

SEQ ID NO: 1328 - DNA, 20 bp, Artificial Sequence
  Primer
cgatcttgtgaagagagagc

SEQ ID NO: 1329 - DNA, 20 bp, Artificial Sequence
  Primer
cctcaggctataacaaaggc

SEQ ID NO: 1330 - DNA, 20 bp, Artificial Sequence
  Primer
ggcttgcctgttttctgaag

SEQ ID NO: 1331 - DNA, 20 bp, Artificial Sequence
  Primer
ctttgtatccagaggtcgtg

SEQ ID NO: 1332 - DNA, 20 bp, Artificial Sequence
  Primer
ttctagcttcggcttgcatc

SEQ ID NO: 1333 - DNA, 20 bp, Artificial Sequence
  Primer
gtcgtcctattgaagcttgg

SEQ ID NO: 1334 - DNA, 20 bp, Artificial Sequence
  Primer
gatgccagaaacgctattcc

SEQ ID NO: 1335 - DNA, 20 bp, Artificial Sequence
  Primer
ctgtgccctttattacgtct

SEQ ID NO: 1336 - DNA, 20 bp, Artificial Sequence
  Primer
ccgttgagggacttctgatt

SEQ ID NO: 1337 - DNA, 20 bp, Artificial Sequence
  Primer
ggagatcgtttccagaaagc

SEQ ID NO: 1338 - DNA, 20 bp, Artificial Sequence
  Primer
caaaagaggggcttccaaca

SEQ ID NO: 1339 - DNA, 20 bp, Artificial Sequence
  Primer
cttctgcagaggataaaccg

SEQ ID NO: 1340 - DNA, 20 bp, Artificial Sequence
  Primer
catgcgtctgggttgaaact

SEQ ID NO: 1341 - DNA, 20 bp, Artificial Sequence
  Primer
ttgtggtggcagagagatgt

SEQ ID NO: 1342 - DNA, 20 bp, Artificial Sequence
  Primer
cgagcaaagaaggctttgtc

SEQ ID NO: 1343 - DNA, 20 bp, Artificial Sequence
  Primer
gctttgccaaggcttgttga

SEQ ID NO: 1344 - DNA, 20 bp, Artificial Sequence
  Primer
ccagacccgagaccattttt

SEQ ID NO: 1345 - DNA, 20 bp, Artificial Sequence
  Primer
cgagtagtgaaacgtgctgt

SEQ ID NO: 1346 - DNA, 20 bp, Artificial Sequence
  Primer
catcttccatggcgtcttgt

SEQ ID NO: 1347 - DNA, 20 bp, Artificial Sequence
  Primer
atgctcagttgtccgttgcg

SEQ ID NO: 1348 - DNA, 20 bp, Artificial Sequence
  Primer
aaggtaaccgcttggttagc

SEQ ID NO: 1349 - DNA, 20 bp, Artificial Sequence
  Primer
cgagcaaagaaggctttgtc

SEQ ID NO: 1350 - DNA, 20 bp, Artificial Sequence
  Primer
cgcggatatcttcatccgtt

SEQ ID NO: 1351 - DNA, 20 bp, Artificial Sequence
  Primer
ggcttacatcgagtgtgtag

SEQ ID NO: 1352 - DNA, 20 bp, Artificial Sequence
  Primer
tgtgggtgtcctcagagaga

SEQ ID NO: 1353 - DNA, 20 bp, Artificial Sequence
  Primer
ggaccttcagaagtcgagat

SEQ ID NO: 1354 - DNA, 20 bp, Artificial Sequence
  Primer
tgagagcgcacaacgttagc

SEQ ID NO: 1355 - DNA, 20 bp, Artificial Sequence
  Primer
agggaagcggattttcagca

SEQ ID NO: 1356 - DNA, 20 bp, Artificial Sequence
  Primer
gcgtataaggcatctcgacg

SEQ ID NO: 1357 - DNA, 20 bp, Artificial Sequence
  Primer
cgagatagtcccataagctg

SEQ ID NO: 1358 - DNA, 20 bp, Artificial Sequence
  Primer
gaaggttctaccaagcctgt

SEQ ID NO: 1359 - DNA, 20 bp, Artificial Sequence
  Primer
gcatcgcttcagagaggaaa

SEQ ID NO: 1360 - DNA, 20 bp, Artificial Sequence
  Primer
tggagagagagggggggagt

SEQ ID NO: 1361 - DNA, 20 bp, Artificial Sequence
  Primer
ccattgtttccaatcacgcc

SEQ ID NO: 1362 - DNA, 20 bp, Artificial Sequence
  Primer
gggaaaggaatactccagag

SEQ ID NO: 1363 - DNA, 20 bp, Artificial Sequence
  Primer
ccgctggattctctggtatt

SEQ ID NO: 1364 - DNA, 20 bp, Artificial Sequence
  Primer
agcaagggttgtgtgcacat

SEQ ID NO: 1365 - DNA, 20 bp, Artificial Sequence
  Primer
cgcgacttcttggaaggatt

SEQ ID NO: 1366 - DNA, 20 bp, Artificial Sequence
  Primer
cctatagatcgagctctaag

SEQ ID NO: 1367 - DNA, 20 bp, Artificial Sequence
  Primer
cgatcatgcatgtctgtggt

SEQ ID NO: 1368 - DNA, 20 bp, Artificial Sequence
  Primer
agggattccccaatgtgcat

SEQ ID NO: 1369 - DNA, 20 bp, Artificial Sequence
  Primer
gccagatcaaggagttgtgt

SEQ ID NO: 1370 - DNA, 20 bp, Artificial Sequence
  Primer
cactctaaagtcgggggagc

SEQ ID NO: 1371 - DNA, 20 bp, Artificial Sequence
  Primer
ctgctggtagaatgatgcct

SEQ ID NO: 1372 - DNA, 20 bp, Artificial Sequence
  Primer
gaggtgtgataggagaggat

SEQ ID NO: 1373 - DNA, 20 bp, Artificial Sequence
  Primer
gttgtatatgtatcgggcgg

SEQ ID NO: 1374 - DNA, 20 bp, Artificial Sequence
  Primer
cggatgcagatccttttgtc

SEQ ID NO: 1375 - DNA, 20 bp, Artificial Sequence
  Primer
gaactccttgcggagggtat

SEQ ID NO: 1376 - DNA, 20 bp, Artificial Sequence
  Primer
gaggttaggaatgcagtggt

SEQ ID NO: 1377 - DNA, 20 bp, Artificial Sequence
  Primer
gaggtggccagagatctatt

SEQ ID NO: 1378 - DNA, 20 bp, Artificial Sequence
  Primer
gatatagcggacagtcgttg

SEQ ID NO: 1379 - DNA, 20 bp, Artificial Sequence
  Primer
gatgggcataacgagtgtag

SEQ ID NO: 1380 - DNA, 20 bp, Artificial Sequence
  Primer
gaatccttctgggatacacg

SEQ ID NO: 1381 - DNA, 20 bp, Artificial Sequence
  Primer
ggagccaggcagaatagaat

SEQ ID NO: 1382 - DNA, 20 bp, Artificial Sequence
  Primer
catcatgttgtagagcaggc

SEQ ID NO: 1383 - DNA, 20 bp, Artificial Sequence
  Primer
ctggctggaacagtatcttt

SEQ ID NO: 1384 - DNA, 20 bp, Artificial Sequence
  Primer
tctgcgcggaataagtctgc

SEQ ID NO: 1385 - DNA, 20 bp, Artificial Sequence
  Primer
gctaggagcgtcatgagtat

SEQ ID NO: 1386 - DNA, 20 bp, Artificial Sequence
  Primer
gggcgagagtaaattcgtag

SEQ ID NO: 1387 - DNA, 20 bp, Artificial Sequence
  Primer
ggccatctttgttgtcagca

SEQ ID NO: 1388 - DNA, 20 bp, Artificial Sequence
  Primer
ggcggtaccttcttgaagaa

SEQ ID NO: 1389 - DNA, 20 bp, Artificial Sequence
  Primer
ccgtatctgtatgtggagag

SEQ ID NO: 1390 - DNA, 20 bp, Artificial Sequence
  Primer
ccacatgttggacaaggacg

SEQ ID NO: 1391 - DNA, 20 bp, Artificial Sequence
  Primer
gctgttggttgtggtgatga

SEQ ID NO: 1392 - DNA, 20 bp, Artificial Sequence
  Primer
gccttctctatccgtcacta

SEQ ID NO: 1393 - DNA, 20 bp, Artificial Sequence
  Primer
cagctttagcaatggggaga

SEQ ID NO: 1394 - DNA, 20 bp, Artificial Sequence
  Primer
ctgaaccttggcattgtgga

SEQ ID NO: 1395 - DNA, 20 bp, Artificial Sequence
  Primer
gagagctatagctgttggag

SEQ ID NO: 1396 - DNA, 20 bp, Artificial Sequence
  Primer
gatctggtaaggagtctagc

SEQ ID NO: 1397 - DNA, 20 bp, Artificial Sequence
  Primer
gcgaggttgttctgcgaata

SEQ ID NO: 1398 - DNA, 20 bp, Artificial Sequence
  Primer
catcgagaagcttttccagc

SEQ ID NO: 1399 - DNA, 20 bp, Artificial Sequence
  Primer
ggagacattctcgaacggta

SEQ ID NO: 1400 - DNA, 20 bp, Artificial Sequence
  Primer
ctgctatgcctacatctgtg

SEQ ID NO: 1401 - DNA, 20 bp, Artificial Sequence
  Primer
cagctggaaaaaagcgtggt

SEQ ID NO: 1402 - DNA, 20 bp, Artificial Sequence
  Primer
gattggtgcccgacatcaaa

SEQ ID NO: 1403 - DNA, 20 bp, Artificial Sequence
  Primer
ccgtggctaaaattaaggcg

SEQ ID NO: 1404 - DNA, 20 bp, Artificial Sequence
  Primer
cgttggtcggaaagctgttt

SEQ ID NO: 1405 - DNA, 20 bp, Artificial Sequence
  Primer
gggtaagtagggattgtagg

SEQ ID NO: 1406 - DNA, 20 bp, Artificial Sequence
  Primer
ccatcttttggtttgcggtc

SEQ ID NO: 1407 - DNA, 20 bp, Artificial Sequence
  Primer
catcacacaatacagggagc

SEQ ID NO: 1408 - DNA, 20 bp, Artificial Sequence
  Primer
ggcccaagttggaaatggtt

SEQ ID NO: 1409 - DNA, 20 bp, Artificial Sequence
  Primer
gtatagctggtttagagagg

SEQ ID NO: 1410 - DNA, 20 bp, Artificial Sequence
  Primer
attctgctgcgaataggcgt

SEQ ID NO: 1411 - DNA, 20 bp, Artificial Sequence
  Primer
gctcgggaagctgccaaagc

SEQ ID NO: 1412 - DNA, 20 bp, Artificial Sequence
  Primer
ttgttggattgggcatgagg

SEQ ID NO: 1413 - DNA, 20 bp, Artificial Sequence
  Primer
gcgagtgaaaagctcttgag

SEQ ID NO: 1414 - DNA, 20 bp, Artificial Sequence
  Primer
ccagacctgttcttccatct

SEQ ID NO: 1415 - DNA, 20 bp, Artificial Sequence
  Primer
ctaaaggtctagcaaagagc

SEQ ID NO: 1416 - DNA, 20 bp, Artificial Sequence
  Primer
gttggacggtcatagagttg

SEQ ID NO: 1417 - DNA, 20 bp, Artificial Sequence
  Primer
gggctatttgtagagagagc

SEQ ID NO: 1418 - DNA, 20 bp, Artificial Sequence
  Primer
ccgcgtctgaagttactatg

SEQ ID NO: 1419 - DNA, 20 bp, Artificial Sequence
  Primer
cgggagtttctcctgaatag

SEQ ID NO: 1420 - DNA, 20 bp, Artificial Sequence
  Primer
gggcaagatcaccgaagaaa

SEQ ID NO: 1421 - DNA, 20 bp, Artificial Sequence
  Primer
gatcgttctagaaggtagag

SEQ ID NO: 1422 - DNA, 20 bp, Artificial Sequence
  Primer
gttgtgtcggaagtgttcca

SEQ ID NO: 1423 - DNA, 20 bp, Artificial Sequence
  Primer
gctattacgcgtacgttgtc

SEQ ID NO: 1424 - DNA, 20 bp, Artificial Sequence
  Primer
gctccctgttgtaatcactg

SEQ ID NO: 1425 - DNA, 20 bp, Artificial Sequence
  Primer
gaaggggatgctgcatacat

SEQ ID NO: 1426 - DNA, 20 bp, Artificial Sequence
  Primer
gcggaactgcgaaaaggtaa

SEQ ID NO: 1427 - DNA, 20 bp, Artificial Sequence
  Primer
tggtagagcagtggcctcca

SEQ ID NO: 1428 - DNA, 20 bp, Artificial Sequence
  Primer
gacagcaagttgttggactc

SEQ ID NO: 1429 - DNA, 20 bp, Artificial Sequence
  Primer
cgttgctctgtctgaagaag

SEQ ID NO: 1430 - DNA, 20 bp, Artificial Sequence
  Primer
cccggtacgtcttaacagat

SEQ ID NO: 1431 - DNA, 20 bp, Artificial Sequence
  Primer
cggcaattgctgagcaaaag

SEQ ID NO: 1432 - DNA, 20 bp, Artificial Sequence
  Primer
atggaggtatgggccttaga

SEQ ID NO: 1433 - DNA, 20 bp, Artificial Sequence
  Primer
gatggcatcgtgacagatga

SEQ ID NO: 1434 - DNA, 20 bp, Artificial Sequence
  Primer
gctgcttgcagcagtaagac

SEQ ID NO: 1435 - DNA, 20 bp, Artificial Sequence
  Primer
gaagtctcagacctcttgtc

SEQ ID NO: 1436 - DNA, 20 bp, Artificial Sequence
  Primer
ctcaccttttgttggtcgga

SEQ ID NO: 1437 - DNA, 20 bp, Artificial Sequence
  Primer
caagatgggagctcttcact

SEQ ID NO: 1438 - DNA, 20 bp, Artificial Sequence
  Primer
gatgctgagatgtgtgatgc

SEQ ID NO: 1439 - DNA, 20 bp, Artificial Sequence
  Primer
cttaatcgtacaacgaggcg

SEQ ID NO: 1440 - DNA, 20 bp, Artificial Sequence
  Primer
ggagagggtttccttgatac

SEQ ID NO: 1441 - DNA, 20 bp, Artificial Sequence
  Primer
ggttcaggatgctacgacaa

SEQ ID NO: 1442 - DNA, 20 bp, Artificial Sequence
  Primer
gttgaagagcgcaattgggt

SEQ ID NO: 1443 - DNA, 20 bp, Artificial Sequence
  Primer
gctagctgaaggtattcgca

SEQ ID NO: 1444 - DNA, 20 bp, Artificial Sequence
  Primer
gcttcctgatgaattcttcg

SEQ ID NO: 1445 - DNA, 20 bp, Artificial Sequence
  Primer
gagcttgaatgtgcgcaaag

SEQ ID NO: 1446 - DNA, 20 bp, Artificial Sequence
  Primer
gcagcaaaacgcatttgatg

SEQ ID NO: 1447 - DNA, 20 bp, Artificial Sequence
  Primer
gcgtttaacgcatttctcag

SEQ ID NO: 1448 - DNA, 20 bp, Artificial Sequence
  Primer
tagaaagtctgcagagcgga

SEQ ID NO: 1449 - DNA, 20 bp, Artificial Sequence
  Primer
gtagctgctcgagaatcttc

SEQ ID NO: 1450 - DNA, 20 bp, Artificial Sequence
  Primer
cagcagcataaggagtagtc

SEQ ID NO: 1451 - DNA, 20 bp, Artificial Sequence
  Primer
ggcgtaggtatgcaaacgat

SEQ ID NO: 1452 - DNA, 20 bp, Artificial Sequence
  Primer
gaaggagcgtcctaagggtt

SEQ ID NO: 1453 - DNA, 20 bp, Artificial Sequence
  Primer
cctcttgaagaagctttgga

SEQ ID NO: 1454 - DNA, 20 bp, Artificial Sequence
  Primer
ccccgcagtaggaattctaa

SEQ ID NO: 1455 - DNA, 20 bp, Artificial Sequence
  Primer
cggagagtctctattcgagt

SEQ ID NO: 1456 - DNA, 20 bp, Artificial Sequence
  Primer
ggaaatgtctagtgagagga

SEQ ID NO: 1457 - DNA, 20 bp, Artificial Sequence
  Primer
agagattggggctgtcgaat

SEQ ID NO: 1458 - DNA, 20 bp, Artificial Sequence
  Primer
ccaagatcggcaaggtatca

SEQ ID NO: 1459 - DNA, 20 bp, Artificial Sequence
  Primer
gcattaggggagtctttggt

SEQ ID NO: 1460 - DNA, 20 bp, Artificial Sequence
  Primer
cagaagctccaaaggacagt

SEQ ID NO: 1461 - DNA, 20 bp, Artificial Sequence
  Primer
gggatactgcgattgctgtt

SEQ ID NO: 1462 - DNA, 20 bp, Artificial Sequence
  Primer
ggaaaatgtgtggacggtga

SEQ ID NO: 1463 - DNA, 20 bp, Artificial Sequence
  Primer
tgttgttttgcctcctatcg

SEQ ID NO: 1464 - DNA, 20 bp, Artificial Sequence
  Primer
gccgatacgagaggagttat

SEQ ID NO: 1465 - DNA, 20 bp, Artificial Sequence
  Primer
cctgacgcgttcttatctga

SEQ ID NO: 1466 - DNA, 20 bp, Artificial Sequence
  Primer
gcccagattgcaccaagaaa

SEQ ID NO: 1467 - DNA, 20 bp, Artificial Sequence
  Primer
gctttagcgaacgtatccga

SEQ ID NO: 1468 - DNA, 20 bp, Artificial Sequence
  Primer
cgattccagccttgagcttg

SEQ ID NO: 1469 - DNA, 20 bp, Artificial Sequence
  Primer
catcaatcgttagggcggat

SEQ ID NO: 1470 - DNA, 20 bp, Artificial Sequence
  Primer
cgttcgctatcttcttcagc

SEQ ID NO: 1471 - DNA, 20 bp, Artificial Sequence
  Primer
gtagtaagcggacagcatct

SEQ ID NO: 1472 - DNA, 20 bp, Artificial Sequence
  Primer
tggagaatatcctcaggacg

SEQ ID NO: 1473 - DNA, 20 bp, Artificial Sequence
  Primer
gggccgaaacgattcttaac

SEQ ID NO: 1474 - DNA, 20 bp, Artificial Sequence
  Primer
ctgagccgaaaatgaagctg

SEQ ID NO: 1475 - DNA, 20 bp, Artificial Sequence
  Primer
ggggcttttcttttctggag

SEQ ID NO: 1476 - DNA, 20 bp, Artificial Sequence
  Primer
agaccacagcaaaccaggat

SEQ ID NO: 1477 - DNA, 20 bp, Artificial Sequence
  Primer
ggtcatgattaccgcttcgc

SEQ ID NO: 1478 - DNA, 20 bp, Artificial Sequence
  Primer
tgataggggaagatcttccg

SEQ ID NO: 1479 - DNA, 20 bp, Artificial Sequence
  Primer
acctcagcggaaacaagaac

SEQ ID NO: 1480 - DNA, 20 bp, Artificial Sequence
  Primer
gggtacgagattcaagttcg

SEQ ID NO: 1481 - DNA, 20 bp, Artificial Sequence
  Primer
gtggatagctcttgacagtg

SEQ ID NO: 1482 - DNA, 20 bp, Artificial Sequence
  Primer
tgggaaaatcgatgggagtg

SEQ ID NO: 1483 - DNA, 20 bp, Artificial Sequence
  Primer
gctggggatggttagctttt

SEQ ID NO: 1484 - DNA, 20 bp, Artificial Sequence
  Primer
tctttgcgagatgaagccag

SEQ ID NO: 1485 - DNA, 20 bp, Artificial Sequence
  Primer
cccgagcataattaattggg

SEQ ID NO: 1486 - DNA, 20 bp, Artificial Sequence
  Primer
ggagagggaattgctttacc

SEQ ID NO: 1487 - DNA, 20 bp, Artificial Sequence
  Primer
gaaggctatagactctcggt

SEQ ID NO: 1488 - DNA, 20 bp, Artificial Sequence
  Primer
gccgagctaacttcggtatt

SEQ ID NO: 1489 - DNA, 20 bp, Artificial Sequence
  Primer
cttattggagggccatctga

SEQ ID NO: 1490 - DNA, 20 bp, Artificial Sequence
  Primer
cagacatctgggctaatggt

SEQ ID NO: 1491 - DNA, 20 bp, Artificial Sequence
  Primer
catgcaagtcagatgagcca

SEQ ID NO: 1492 - DNA, 20 bp, Artificial Sequence
  Primer
cgtatgctaggttgatgagc

SEQ ID NO: 1493 - DNA, 20 bp, Artificial Sequence
  Primer
gccgagctaacttcggtatt

SEQ ID NO: 1494 - DNA, 20 bp, Artificial Sequence
  Primer
gcagaacaattgtccattcc

SEQ ID NO: 1495 - DNA, 20 bp, Artificial Sequence
  Primer
cttcatcatgcactctccac

SEQ ID NO: 1496 - DNA, 20 bp, Artificial Sequence
  Primer
gtaaggggtgaagatcatcc

SEQ ID NO: 1497 - DNA, 20 bp, Artificial Sequence
  Primer
catccccaatgctaaggaag

SEQ ID NO: 1498 - DNA, 20 bp, Artificial Sequence
  Primer
gctgcaggaattcctgtttg

SEQ ID NO: 1499 - DNA, 20 bp, Artificial Sequence
  Primer
ggatcgcagaacaattgtcc

SEQ ID NO: 1500 - DNA, 20 bp, Artificial Sequence
  Primer
cctgaatggcaaggtggaat

SEQ ID NO: 1501 - DNA, 20 bp, Artificial Sequence
  Primer
acatatcctggaggagatcc

SEQ ID NO: 1502 - DNA, 20 bp, Artificial Sequence
  Primer
ctgatcgagcagagtcttct

SEQ ID NO: 1503 - DNA, 20 bp, Artificial Sequence
  Primer
cgagtgcttcatcagtgatg

SEQ ID NO: 1504 - DNA, 20 bp, Artificial Sequence
  Primer
gcggtttctaaagctcaggt

SEQ ID NO: 1505 - DNA, 20 bp, Artificial Sequence
  Primer
gggaagggattttccctttg

SEQ ID NO: 1506 - DNA, 20 bp, Artificial Sequence
  Primer
ccctcactacgttcttagac

SEQ ID NO: 1507 - DNA, 20 bp, Artificial Sequence
  Primer
cctgcgcttgtaagctacat

SEQ ID NO: 1508 - DNA, 20 bp, Artificial Sequence
  Primer
gggggactagagaaaaccat

SEQ ID NO: 1509 - DNA, 20 bp, Artificial Sequence
  Primer
gggtctctttctctcttcgt

SEQ ID NO: 1510 - DNA, 20 bp, Artificial Sequence
  Primer
tatcgtctcaaatggcggga

SEQ ID NO: 1511 - DNA, 20 bp, Artificial Sequence
  Primer
gttacgaagggtatcggcga

SEQ ID NO: 1512 - DNA, 20 bp, Artificial Sequence
  Primer
gcgcccggttttgtgataaa

SEQ ID NO: 1513 - DNA, 20 bp, Artificial Sequence
  Primer
gtccatgttttagatgtccc

SEQ ID NO: 1514 - DNA, 20 bp, Artificial Sequence
  Primer
agctgagcgatcatccgaac

SEQ ID NO: 1515 - DNA, 20 bp, Artificial Sequence
  Primer
caaatagtcagggccaggat

SEQ ID NO: 1516 - DNA, 20 bp, Artificial Sequence
  Primer
cccggttgttaagatgctca

SEQ ID NO: 1517 - DNA, 20 bp, Artificial Sequence
  Primer
ccaaccacataaacgctacc

SEQ ID NO: 1518 - DNA, 20 bp, Artificial Sequence
  Primer
tcgaaagctgctttgagagc

SEQ ID NO: 1519 - DNA, 20 bp, Artificial Sequence
  Primer
ggcgagacttggatgccata

SEQ ID NO: 1520 - DNA, 20 bp, Artificial Sequence
  Primer
gatagcaatcgtgtttccgc

SEQ ID NO: 1521 - DNA, 20 bp, Artificial Sequence
  Primer
ggagaacatcttgggtagga

SEQ ID NO: 1522 - DNA, 20 bp, Artificial Sequence
  Primer
gggtctaagataacgagagc

SEQ ID NO: 1523 - DNA, 20 bp, Artificial Sequence
  Primer
ccacataagacggtctctgt

SEQ ID NO: 1524 - DNA, 20 bp, Artificial Sequence
  Primer
cgggggagggaaaaagtcaa

SEQ ID NO: 1525 - DNA, 20 bp, Artificial Sequence
  Primer
ggatatcgtcgacgagaagt

SEQ ID NO: 1526 - DNA, 20 bp, Artificial Sequence
  Primer
gtgttgcgctctttatcggt

SEQ ID NO: 1527 - DNA, 20 bp, Artificial Sequence
  Primer
atgcccttgacgaaggaacg

SEQ ID NO: 1528 - DNA, 20 bp, Artificial Sequence
  Primer
cgatgagattgctcgtatgg

SEQ ID NO: 1529 - DNA, 20 bp, Artificial Sequence
  Primer
gaaggcttgggtgtcatatc

SEQ ID NO: 1530 - DNA, 20 bp, Artificial Sequence
  Primer
acggatctcccgaatggtct

SEQ ID NO: 1531 - DNA, 20 bp, Artificial Sequence
  Primer
ggagtctttccttcctatcg

SEQ ID NO: 1532 - DNA, 20 bp, Artificial Sequence
  Primer
gaaagcgggagaggaaacta

SEQ ID NO: 1533 - DNA, 20 bp, Artificial Sequence
  Primer
cgaatcaacacgagtttcgc

SEQ ID NO: 1534 - DNA, 20 bp, Artificial Sequence
  Primer
ggtggagatagagatcgtgt

SEQ ID NO: 1535 - DNA, 20 bp, Artificial Sequence
  Primer
gtttctccttcaggagaaga

SEQ ID NO: 1536 - DNA, 20 bp, Artificial Sequence
  Primer
aaagagcgagccgctctttt

SEQ ID NO: 1537 - DNA, 20 bp, Artificial Sequence
  Primer
cgttgtgttggagttggtga

SEQ ID NO: 1538 - DNA, 20 bp, Artificial Sequence
  Primer
ccacgtgagaactgttatcc

SEQ ID NO: 1539 - DNA, 20 bp, Artificial Sequence
  Primer
ctcttggtcgagttcgtgaa

SEQ ID NO: 1540 - DNA, 20 bp, Artificial Sequence
  Primer
cgaaaaaacgatcgccgagt

SEQ ID NO: 1541 - DNA, 20 bp, Artificial Sequence
  Primer
cgtgggtagattttgtgcgt

SEQ ID NO: 1542 - DNA, 20 bp, Artificial Sequence
  Primer
aacagtgatgctgctgccat

SEQ ID NO: 1543 - DNA, 20 bp, Artificial Sequence
  Primer
cgaagaaccgttatacagcg

SEQ ID NO: 1544 - DNA, 20 bp, Artificial Sequence
  Primer
ggcagttaaaaggccgttgt

SEQ ID NO: 1545 - DNA, 20 bp, Artificial Sequence
  Primer
cgcagtgatcaaagaaccca

SEQ ID NO: 1546 - DNA, 20 bp, Artificial Sequence
  Primer
gctccggcaaatcctgcatt

SEQ ID NO: 1547 - DNA, 20 bp, Artificial Sequence
  Primer
cctcgcgctttttctagtag

SEQ ID NO: 1548 - DNA, 20 bp, Artificial Sequence
  Primer
cccagagtagtgccaacatt

SEQ ID NO: 1549 - DNA, 20 bp, Artificial Sequence
  Primer
gcagcagtccaatgtttctg

SEQ ID NO: 1550 - DNA, 20 bp, Artificial Sequence
  Primer
ggaggcaacttttgataccc

SEQ ID NO: 1551 - DNA, 20 bp, Artificial Sequence
  Primer
ggtttcttctgttacgtagg

SEQ ID NO: 1552 - DNA, 20 bp, Artificial Sequence
  Primer
ctggaaggaacgttctgaca

SEQ ID NO: 1553 - DNA, 20 bp, Artificial Sequence
  Primer
ggggacttcagaaagaggtt

SEQ ID NO: 1554 - DNA, 20 bp, Artificial Sequence
  Primer
ttagatctagaaggggtggc

SEQ ID NO: 1555 - DNA, 20 bp, Artificial Sequence
  Primer
ggaggcaacttttgataccc

SEQ ID NO: 1556 - DNA, 20 bp, Artificial Sequence
  Primer
cgtgatgactcagaccctat

SEQ ID NO: 1557 - DNA, 20 bp, Artificial Sequence
  Primer
ggtttagtcattgtcgggtg

SEQ ID NO: 1558 - DNA, 20 bp, Artificial Sequence
  Primer
gcagaacaaactcctaagag

SEQ ID NO: 1559 - DNA, 20 bp, Artificial Sequence
  Primer
cgtgttcttctggagcaact

SEQ ID NO: 1560 - DNA, 20 bp, Artificial Sequence
  Primer
ccccgagcacaagacaaaaa

SEQ ID NO: 1561 - DNA, 20 bp, Artificial Sequence
  Primer
ggaaaagctattcccactac

SEQ ID NO: 1562 - DNA, 20 bp, Artificial Sequence
  Primer
gagccggtaatcccaatagt

SEQ ID NO: 1563 - DNA, 20 bp, Artificial Sequence
  Primer
tgggcgtcatgcgttcttta

SEQ ID NO: 1564 - DNA, 20 bp, Artificial Sequence
  Primer
gccgaaagaagcaagtaacc

SEQ ID NO: 1565 - DNA, 20 bp, Artificial Sequence
  Primer
gtgtggagtctatgttgcag

SEQ ID NO: 1566 - DNA, 20 bp, Artificial Sequence
  Primer
gatctctgtggtgatttggg

SEQ ID NO: 1567 - DNA, 20 bp, Artificial Sequence
  Primer
gatatgccgtaccttctcgt

SEQ ID NO: 1568 - DNA, 20 bp, Artificial Sequence
  Primer
ccacatctgaaagcgactct

SEQ ID NO: 1569 - DNA, 20 bp, Artificial Sequence
  Primer
tgcccccaagcacactaagc

SEQ ID NO: 1570 - DNA, 20 bp, Artificial Sequence
  Primer
agtggagctatcgagggaat

SEQ ID NO: 1571 - DNA, 20 bp, Artificial Sequence
  Primer
cgtgcgaagatcttttttgc

SEQ ID NO: 1572 - DNA, 20 bp, Artificial Sequence
  Primer
ccctcgaactcctattccag

SEQ ID NO: 1573 - DNA, 20 bp, Artificial Sequence
  Primer
gctttacgaaggccttggtt

SEQ ID NO: 1574 - DNA, 20 bp, Artificial Sequence
  Primer
gggaacaatgatggcgttgt

SEQ ID NO: 1575 - DNA, 20 bp, Artificial Sequence
  Primer
gaccagtacttttggaggga

SEQ ID NO: 1576 - DNA, 20 bp, Artificial Sequence
  Primer
ggaagtgttctctcgagacc

SEQ ID NO: 1577 - DNA, 20 bp, Artificial Sequence
  Primer
caggctcttggggaatttct

SEQ ID NO: 1578 - DNA, 20 bp, Artificial Sequence
  Primer
ctctgatttgcttgctgcgt

SEQ ID NO: 1579 - DNA, 20 bp, Artificial Sequence
  Primer
gggaacaatgatggcgttgt

SEQ ID NO: 1580 - DNA, 20 bp, Artificial Sequence
  Primer
cttggggtcactgtaaatcc

SEQ ID NO: 1581 - DNA, 20 bp, Artificial Sequence
  Primer
cttttgctgcacattccgac

SEQ ID NO: 1582 - DNA, 20 bp, Artificial Sequence
  Primer
gggagatccattctttgttc

SEQ ID NO: 1583 - DNA, 20 bp, Artificial Sequence
  Primer
gggggattaggtcgacttgc

SEQ ID NO: 1584 - DNA, 20 bp, Artificial Sequence
  Primer
gggagatccattctttgttc

SEQ ID NO: 1585 - DNA, 20 bp, Artificial Sequence
  Primer
tgggggattaggtcgacttg

SEQ ID NO: 1586 - DNA, 20 bp, Artificial Sequence
  Primer
gataggagtgccaataggag

SEQ ID NO: 1587 - DNA, 20 bp, Artificial Sequence
  Primer
gggtcactgtaaatcctcag

SEQ ID NO: 1588 - DNA, 20 bp, Artificial Sequence
  Primer
agcgctgctccgattccaat

SEQ ID NO: 1589 - DNA, 20 bp, Artificial Sequence
  Primer
tcctctacgcttcctacagc

SEQ ID NO: 1590 - DNA, 20 bp, Artificial Sequence
  Primer
ctgcttctaggacagctgtt

SEQ ID NO: 1591 - DNA, 20 bp, Artificial Sequence
  Primer
tcagagctaaagcacaggct

SEQ ID NO: 1592 - DNA, 20 bp, Artificial Sequence
  Primer
ctgttcccatactccatcca

SEQ ID NO: 1593 - DNA, 20 bp, Artificial Sequence
  Primer
cagttactccagagaggtct

SEQ ID NO: 1594 - DNA, 20 bp, Artificial Sequence
  Primer
gagagtcagaggatgcatag

SEQ ID NO: 1595 - DNA, 20 bp, Artificial Sequence
  Primer
gagtcgccatctctagagtt

SEQ ID NO: 1596 - DNA, 20 bp, Artificial Sequence
  Primer
ctctgggagccatattttcc

SEQ ID NO: 1597 - DNA, 20 bp, Artificial Sequence
  Primer
cctgtttgttgcatgtggtg

SEQ ID NO: 1598 - DNA, 20 bp, Artificial Sequence
  Primer
gatatgatgatagcgccagc

SEQ ID NO: 1599 - DNA, 20 bp, Artificial Sequence
  Primer
gtaggcggattatcggaagt

SEQ ID NO: 1600 - DNA, 20 bp, Artificial Sequence
  Primer
cttccccatgctgttagaga

SEQ ID NO: 1601 - DNA, 20 bp, Artificial Sequence
  Primer
ggtgtctattgctctgatgt

SEQ ID NO: 1602 - DNA, 20 bp, Artificial Sequence
  Primer
ggaagagactactcaagacc

SEQ ID NO: 1603 - DNA, 20 bp, Artificial Sequence
  Primer
gctgcggaaacgaatccttt

SEQ ID NO: 1604 - DNA, 20 bp, Artificial Sequence
  Primer
atgctagagccatagcctca

SEQ ID NO: 1605 - DNA, 20 bp, Artificial Sequence
  Primer
agggagatccttcactcact

SEQ ID NO: 1606 - DNA, 20 bp, Artificial Sequence
  Primer
ggttagttcctcatcaggca

SEQ ID NO: 1607 - DNA, 20 bp, Artificial Sequence
  Primer
cagcgagttgcagaatcgtt

SEQ ID NO: 1608 - DNA, 20 bp, Artificial Sequence
  Primer
gtatgagagcgaggctatcc

SEQ ID NO: 1609 - DNA, 20 bp, Artificial Sequence
  Primer
gccaattcctggaagctttt

SEQ ID NO: 1610 - DNA, 20 bp, Artificial Sequence
  Primer
gaaggcatttcgttggctgt

SEQ ID NO: 1611 - DNA, 20 bp, Artificial Sequence
  Primer
ggggattgctttagacgaac

SEQ ID NO: 1612 - DNA, 20 bp, Artificial Sequence
  Primer
gagtaagtcctgaggatgtc

SEQ ID NO: 1613 - DNA, 20 bp, Artificial Sequence
  Primer
cgaaggacctgaagaagttc

SEQ ID NO: 1614 - DNA, 20 bp, Artificial Sequence
  Primer
ggttgcccttccgaaaagat

SEQ ID NO: 1615 - DNA, 20 bp, Artificial Sequence
  Primer
tgagagcgaggctatccgtt

SEQ ID NO: 1616 - DNA, 20 bp, Artificial Sequence
  Primer
gggagtactgcgcgattttt

SEQ ID NO: 1617 - DNA, 20 bp, Artificial Sequence
  Primer
tgatgccgagcaactccgca

SEQ ID NO: 1618 - DNA, 20 bp, Artificial Sequence
  Primer
ggcagcttctcagctccaat

SEQ ID NO: 1619 - DNA, 20 bp, Artificial Sequence
  Primer
ctgaggcaagaacgaactca

SEQ ID NO: 1620 - DNA, 20 bp, Artificial Sequence
  Primer
acagtgaagaaggggcctgg

SEQ ID NO: 1621 - DNA, 20 bp, Artificial Sequence
  Primer
tgaagaagtaggttggggag

SEQ ID NO: 1622 - DNA, 20 bp, Artificial Sequence
  Primer
ggctgtgagtgcaaaaagag

SEQ ID NO: 1623 - DNA, 20 bp, Artificial Sequence
  Primer
gcgatcattcccattgttgc

SEQ ID NO: 1624 - DNA, 20 bp, Artificial Sequence
  Primer
gcaactcccatcatcgacaa

SEQ ID NO: 1625 - DNA, 20 bp, Artificial Sequence
  Primer
gacgaccctatttcttgagg

SEQ ID NO: 1626 - DNA, 20 bp, Artificial Sequence
  Primer
gacctgtatctcaaggctcg

SEQ ID NO: 1627 - DNA, 20 bp, Artificial Sequence
  Primer
ccctccacaaactgtaacga

SEQ ID NO: 1628 - DNA, 20 bp, Artificial Sequence
  Primer
tcagtttttctgagaggggg

SEQ ID NO: 1629 - DNA, 20 bp, Artificial Sequence
  Primer
ccgttaacgattcctttccg

SEQ ID NO: 1630 - DNA, 20 bp, Artificial Sequence
  Primer
gttccgcaagagtaggatca

SEQ ID NO: 1631 - DNA, 20 bp, Artificial Sequence
  Primer
taaaggttccgccgccattt

SEQ ID NO: 1632 - DNA, 20 bp, Artificial Sequence
  Primer
ataaggcattatcggagcgg

SEQ ID NO: 1633 - DNA, 20 bp, Artificial Sequence
  Primer
gagggacattcatagaggct

SEQ ID NO: 1634 - DNA, 20 bp, Artificial Sequence
  Primer
gtccgatgtgcgcttagttt

SEQ ID NO: 1635 - DNA, 20 bp, Artificial Sequence
  Primer
gcattggtttctgtagcggc

SEQ ID NO: 1636 - DNA, 20 bp, Artificial Sequence
  Primer
gtggctttaggagtagggtt

SEQ ID NO: 1637 - DNA, 20 bp, Artificial Sequence
  Primer
gttaattcaggtgcacctgc

SEQ ID NO: 1638 - DNA, 20 bp, Artificial Sequence
  Primer
cgtgactcctggattagtgt

SEQ ID NO: 1639 - DNA, 20 bp, Artificial Sequence
  Primer
caggcatcccgtcgtaaaaa

SEQ ID NO: 1640 - DNA, 20 bp, Artificial Sequence
  Primer
ggaggagctgcaattattgg

SEQ ID NO: 1641 - DNA, 20 bp, Artificial Sequence
  Primer
gctgagcaacgtttgcgtaa

SEQ ID NO: 1642 - DNA, 20 bp, Artificial Sequence
  Primer
ctgttcgagccattgtgttg

SEQ ID NO: 1643 - DNA, 20 bp, Artificial Sequence
  Primer
gctagttctgactcttcgag

SEQ ID NO: 1644 - DNA, 20 bp, Artificial Sequence
  Primer
ctcggagaaaaggttctggc

SEQ ID NO: 1645 - DNA, 20 bp, Artificial Sequence
  Primer
gggggagtctattcttcctt

SEQ ID NO: 1646 - DNA, 20 bp, Artificial Sequence
  Primer
cgagggcttttagggcttta

SEQ ID NO: 1647 - DNA, 20 bp, Artificial Sequence
  Primer
ccccttctcgtaaagctcta

SEQ ID NO: 1648 - DNA, 20 bp, Artificial Sequence
  Primer
ggattcgaagacactaagtc

SEQ ID NO: 1649 - DNA, 20 bp, Artificial Sequence
  Primer
cctgcctgctaaagagaaac

SEQ ID NO: 1650 - DNA, 20 bp, Artificial Sequence
  Primer
tatcgttgtcgaacggttgc

SEQ ID NO: 1651 - DNA, 20 bp, Artificial Sequence
  Primer
atcgaaggaatgtgagaagc

SEQ ID NO: 1652 - DNA, 20 bp, Artificial Sequence
  Primer
cgagcctgatgatacagaac

SEQ ID NO: 1653 - DNA, 20 bp, Artificial Sequence
  Primer
gcccttttaggaagttctgc

SEQ ID NO: 1654 - DNA, 20 bp, Artificial Sequence
  Primer
gcaagggagagaaaagcaga

SEQ ID NO: 1655 - DNA, 20 bp, Artificial Sequence
  Primer
ggctgggaatacaacccttt

SEQ ID NO: 1656 - DNA, 20 bp, Artificial Sequence
  Primer
ctcttcagagaactcttcgg

SEQ ID NO: 1657 - DNA, 20 bp, Artificial Sequence
  Primer
gggagcctcgaaatcttctt

SEQ ID NO: 1658 - DNA, 20 bp, Artificial Sequence
  Primer
cggagtagagaaatcagcag

SEQ ID NO: 1659 - DNA, 20 bp, Artificial Sequence
  Primer
tgtgcggatggcgatatgat

SEQ ID NO: 1660 - DNA, 20 bp, Artificial Sequence
  Primer
tcaaggcaacagcaatacgc

SEQ ID NO: 1661 - DNA, 20 bp, Artificial Sequence
  Primer
gcgggcgataaaaaatgcac

SEQ ID NO: 1662 - DNA, 20 bp, Artificial Sequence
  Primer
ctgataactactgcaaggga

SEQ ID NO: 1663 - DNA, 20 bp, Artificial Sequence
  Primer
gcccgcaaattccgctttat

SEQ ID NO: 1664 - DNA, 20 bp, Artificial Sequence
  Primer
ggatgcgacatggcagattg

SEQ ID NO: 1665 - DNA, 20 bp, Artificial Sequence
  Primer
gctcgaatgagtccagaaac

SEQ ID NO: 1666 - DNA, 20 bp, Artificial Sequence
  Primer
ggcttgcagaagaaattgag

SEQ ID NO: 1667 - DNA, 20 bp, Artificial Sequence
  Primer
ggagcacccgattatttctg

SEQ ID NO: 1668 - DNA, 20 bp, Artificial Sequence
  Primer
gttgctcttctgtacagagg

SEQ ID NO: 1669 - DNA, 20 bp, Artificial Sequence
  Primer
tcttgagtagtggtctgcaa

SEQ ID NO: 1670 - DNA, 20 bp, Artificial Sequence
  Primer
acgtccttcaacacatgacg

SEQ ID NO: 1671 - DNA, 20 bp, Artificial Sequence
  Primer
caccaagggattttggtgag

SEQ ID NO: 1672 - DNA, 20 bp, Artificial Sequence
  Primer
ggcttcaaaaggagaaggag

SEQ ID NO: 1673 - DNA, 20 bp, Artificial Sequence
  Primer
gaggaatagaagccctcctt

SEQ ID NO: 1674 - DNA, 20 bp, Artificial Sequence
  Primer
gagctactataggaggagtg

SEQ ID NO: 1675 - DNA, 20 bp, Artificial Sequence
  Primer
ttttagagcagaagcgggga

SEQ ID NO: 1676 - DNA, 20 bp, Artificial Sequence
  Primer
gattgtttcaacacccgagc

SEQ ID NO: 1677 - DNA, 20 bp, Artificial Sequence
  Primer
ctcgacacgctctaacaggg

SEQ ID NO: 1678 - DNA, 20 bp, Artificial Sequence
  Primer
gctccaattgctcctcacat

SEQ ID NO: 1679 - DNA, 20 bp, Artificial Sequence
  Primer
ccaagagagaccacagagaa

SEQ ID NO: 1680 - DNA, 20 bp, Artificial Sequence
  Primer
gggatagagtagtggtcatc

SEQ ID NO: 1681 - DNA, 20 bp, Artificial Sequence
  Primer
cgcaatgttttcagggcctt

SEQ ID NO: 1682 - DNA, 20 bp, Artificial Sequence
  Primer
ctcctgacagtaaaactccg

SEQ ID NO: 1683 - DNA, 20 bp, Artificial Sequence
  Primer
cgcctcttatgtttggacct

SEQ ID NO: 1684 - DNA, 20 bp, Artificial Sequence
  Primer
gctagatggagataggaacg

SEQ ID NO: 1685 - DNA, 20 bp, Artificial Sequence
  Primer
gaagcagctattcctaatgc

SEQ ID NO: 1686 - DNA, 20 bp, Artificial Sequence
  Primer
agcggaaagatcggacttcg

SEQ ID NO: 1687 - DNA, 20 bp, Artificial Sequence
  Primer
ggttcagtagggataagctg

SEQ ID NO: 1688 - DNA, 20 bp, Artificial Sequence
  Primer
caagcagaagagaaatgccc

SEQ ID NO: 1689 - DNA, 20 bp, Artificial Sequence
  Primer
caaacccaaatgtgaggtct

SEQ ID NO: 1690 - DNA, 20 bp, Artificial Sequence
  Primer
gagtgcaaaccttcaagcct

SEQ ID NO: 1691 - DNA, 20 bp, Artificial Sequence
  Primer
ccttgaacgctcccaataac

SEQ ID NO: 1692 - DNA, 20 bp, Artificial Sequence
  Primer
caccgctttagttcttggag

SEQ ID NO: 1693 - DNA, 20 bp, Artificial Sequence
  Primer
cgctctccaagacctgtttt

SEQ ID NO: 1694 - DNA, 20 bp, Artificial Sequence
  Primer
gcgtgtaatatctgtgctgg

SEQ ID NO: 1695 - DNA, 20 bp, Artificial Sequence
  Primer
ggaagagcacgagtttctcg

SEQ ID NO: 1696 - DNA, 20 bp, Artificial Sequence
  Primer
cagaaggtcgcaacaaagtg

SEQ ID NO: 1697 - DNA, 20 bp, Artificial Sequence
  Primer
gttaggcattctcctcgaca

SEQ ID NO: 1698 - DNA, 20 bp, Artificial Sequence
  Primer
cgttagagtcactactaccc

SEQ ID NO: 1699 - DNA, 20 bp, Artificial Sequence
  Primer
gaaacggttgttttccccga

SEQ ID NO: 1700 - DNA, 20 bp, Artificial Sequence
  Primer
caaaccagccacctatagac

SEQ ID NO: 1701 - DNA, 20 bp, Artificial Sequence
  Primer
gctataggaatccagccagt

SEQ ID NO: 1702 - DNA, 20 bp, Artificial Sequence
  Primer
aactctccgctaaagcaggg

SEQ ID NO: 1703 - DNA, 20 bp, Artificial Sequence
  Primer
ctcctataacaaaggcgggt

SEQ ID NO: 1704 - DNA, 20 bp, Artificial Sequence
  Primer
ggtgtctgacgactaattcc

SEQ ID NO: 1705 - DNA, 20 bp, Artificial Sequence
  Primer
gggatcactcctccataaga

SEQ ID NO: 1706 - DNA, 20 bp, Artificial Sequence
  Primer
cggctttagcttctggtccg

SEQ ID NO: 1707 - DNA, 20 bp, Artificial Sequence
  Primer
ggttgtttccagccggcaca

SEQ ID NO: 1708 - DNA, 20 bp, Artificial Sequence
  Primer
caacggtactcttctgacct

SEQ ID NO: 1709 - DNA, 20 bp, Artificial Sequence
  Primer
gggagttgcagggttttgta

SEQ ID NO: 1710 - DNA, 20 bp, Artificial Sequence
  Primer
tcgccgtgccaaggaagcag

SEQ ID NO: 1711 - DNA, 20 bp, Artificial Sequence
  Primer
gtgagtccgaagacaaaggt

SEQ ID NO: 1712 - DNA, 20 bp, Artificial Sequence
  Primer
ctccgagaccatttgtctca

SEQ ID NO: 1713 - DNA, 20 bp, Artificial Sequence
  Primer
cagattccgggggatttcaa

SEQ ID NO: 1714 - DNA, 20 bp, Artificial Sequence
  Primer
ggccttggaagaaaaggaat

SEQ ID NO: 1715 - DNA, 20 bp, Artificial Sequence
  Primer
ggacgcgaaatttccgcttt

SEQ ID NO: 1716 - DNA, 20 bp, Artificial Sequence
  Primer
ggagctatttcggtaacgga

SEQ ID NO: 1717 - DNA, 20 bp, Artificial Sequence
  Primer
ctgactcacagcgctatctt

SEQ ID NO: 1718 - DNA, 20 bp, Artificial Sequence
  Primer
ccgttcttgccagacatcat

SEQ ID NO: 1719 - DNA, 20 bp, Artificial Sequence
  Primer
gcaggtgacatttggagcta

SEQ ID NO: 1720 - DNA, 20 bp, Artificial Sequence
  Primer
gctaacggtccttctacaac

SEQ ID NO: 1721 - DNA, 20 bp, Artificial Sequence
  Primer
gcctttggcagccctcgtaa

SEQ ID NO: 1722 - DNA, 20 bp, Artificial Sequence
  Primer
gcgcgcttcttcacaatttc

SEQ ID NO: 1723 - DNA, 20 bp, Artificial Sequence
  Primer
ccttcttctggatccagaac

SEQ ID NO: 1724 - DNA, 20 bp, Artificial Sequence
  Primer
gttcctggaaccttgcagtt

SEQ ID NO: 1725 - DNA, 20 bp, Artificial Sequence
  Primer
gatcagaagcttccttctgc

SEQ ID NO: 1726 - DNA, 20 bp, Artificial Sequence
  Primer
agagcttcctagaggtcaag

SEQ ID NO: 1727 - DNA, 20 bp, Artificial Sequence
  Primer
agcgtgtgaccatcttcacc

SEQ ID NO: 1728 - DNA, 20 bp, Artificial Sequence
  Primer
gagagagcccacaataccaa

SEQ ID NO: 1729 - DNA, 20 bp, Artificial Sequence
  Primer
cttctggaatgcgcaatcct

SEQ ID NO: 1730 - DNA, 20 bp, Artificial Sequence
  Primer
tgcacgcttgaagcataagc

SEQ ID NO: 1731 - DNA, 20 bp, Artificial Sequence
  Primer
cttgagagtcagcgataagc

SEQ ID NO: 1732 - DNA, 20 bp, Artificial Sequence
  Primer
cagaagtggcgatggagtat

SEQ ID NO: 1733 - DNA, 20 bp, Artificial Sequence
  Primer
gtaatgtggggccaaagtct

SEQ ID NO: 1734 - DNA, 20 bp, Artificial Sequence
  Primer
ccatcctaacaaggagatcg

SEQ ID NO: 1735 - DNA, 20 bp, Artificial Sequence
  Primer
aacatccatcgcactgagac

SEQ ID NO: 1736 - DNA, 20 bp, Artificial Sequence
  Primer
ctaaggtgcgaaactccaaa

SEQ ID NO: 1737 - DNA, 20 bp, Artificial Sequence
  Primer
ctacgcctccagtcaaaaag

SEQ ID NO: 1738 - DNA, 20 bp, Artificial Sequence
  Primer
cgtcaacgtgttgtgtttgc

SEQ ID NO: 1739 - DNA, 20 bp, Artificial Sequence
  Primer
gaacaagggttttccctaga

SEQ ID NO: 1740 - DNA, 20 bp, Artificial Sequence
  Primer
gagattctcccttcagggtt

SEQ ID NO: 1741 - DNA, 20 bp, Artificial Sequence
  Primer
agtctcccgaacattcggag

SEQ ID NO: 1742 - DNA, 20 bp, Artificial Sequence
  Primer
gaaagaaacccagagcccaa

SEQ ID NO: 1743 - DNA, 20 bp, Artificial Sequence
  Primer
gagcctttcacgtctttgga

SEQ ID NO: 1744 - DNA, 20 bp, Artificial Sequence
  Primer
cttgttggtttcggcattgc

SEQ ID NO: 1745 - DNA, 20 bp, Artificial Sequence
  Primer
ccgtaaaaggctgttatggc

SEQ ID NO: 1746 - DNA, 20 bp, Artificial Sequence
  Primer
ctcagtctgggcatatctct

SEQ ID NO: 1747 - DNA, 20 bp, Artificial Sequence
  Primer
gaggtttggagatcagacac

SEQ ID NO: 1748 - DNA, 20 bp, Artificial Sequence
  Primer
cggtctcatgaatctatggg

SEQ ID NO: 1749 - DNA, 20 bp, Artificial Sequence
  Primer
ctccagggtaacccaactaa

SEQ ID NO: 1750 - DNA, 20 bp, Artificial Sequence
  Primer
cggataccttctacgatctc

SEQ ID NO: 1751 - DNA, 20 bp, Artificial Sequence
  Primer
gcccaaaagctaaacttacg

SEQ ID NO: 1752 - DNA, 20 bp, Artificial Sequence
  Primer
cgccaagtagataagcgcca

SEQ ID NO: 1753 - DNA, 20 bp, Artificial Sequence
  Primer
cagcacatgtgcagcttctt

SEQ ID NO: 1754 - DNA, 20 bp, Artificial Sequence
  Primer
cagccagactcctcttgatt

SEQ ID NO: 1755 - DNA, 20 bp, Artificial Sequence
  Primer
agagcttttgccgcctcaat

SEQ ID NO: 1756 - DNA, 20 bp, Artificial Sequence
  Primer
gaaccctaagcaataggagc

SEQ ID NO: 1757 - DNA, 20 bp, Artificial Sequence
  Primer
gcaaacactgaccaagagca

SEQ ID NO: 1758 - DNA, 20 bp, Artificial Sequence
  Primer
cttgccacacaatggagaag

SEQ ID NO: 1759 - DNA, 20 bp, Artificial Sequence
  Primer
ccgtccacattactcttacc

SEQ ID NO: 1760 - DNA, 20 bp, Artificial Sequence
  Primer
ccattggagcgcttagggaa

SEQ ID NO: 1761 - DNA, 20 bp, Artificial Sequence
  Primer
cgtcttcacaggctctttgt

SEQ ID NO: 1762 - DNA, 20 bp, Artificial Sequence
  Primer
ttgctgcagaatcggcgact

SEQ ID NO: 1763 - DNA, 20 bp, Artificial Sequence
  Primer
ccttctggagagccatcttt

SEQ ID NO: 1764 - DNA, 20 bp, Artificial Sequence
  Primer
gaacaacagtggatcagagg

SEQ ID NO: 1765 - DNA, 20 bp, Artificial Sequence
  Primer
cttgccacacaatggagaag

SEQ ID NO: 1766 - DNA, 20 bp, Artificial Sequence
  Primer
cctccagaatctcaaccaac

SEQ ID NO: 1767 - DNA, 20 bp, Artificial Sequence
  Primer
ccgcaatagagaaacactca

SEQ ID NO: 1768 - DNA, 20 bp, Artificial Sequence
  Primer
gtcagctcgtgcacaacata

SEQ ID NO: 1769 - DNA, 20 bp, Artificial Sequence
  Primer
cacgtggctttcctcatcta

SEQ ID NO: 1770 - DNA, 20 bp, Artificial Sequence
  Primer
cacccaaacaaatccattca

SEQ ID NO: 1771 - DNA, 20 bp, Artificial Sequence
  Primer
gtggctcgcagcaaatagaa

SEQ ID NO: 1772 - DNA, 20 bp, Artificial Sequence
  Primer
taacagaccctaagcaaacc

SEQ ID NO: 1773 - DNA, 20 bp, Artificial Sequence
  Primer
cttattcaaaacccggcgct

SEQ ID NO: 1774 - DNA, 20 bp, Artificial Sequence
  Primer
ccgtacatcagcagcagaat

SEQ ID NO: 1775 - DNA, 20 bp, Artificial Sequence
  Primer
cggttcttctccgctaccta

SEQ ID NO: 1776 - DNA, 20 bp, Artificial Sequence
  Primer
ctcctatctgtccccagaga

SEQ ID NO: 1777 - DNA, 20 bp, Artificial Sequence
  Primer
ctatacagaggcctctcttg

SEQ ID NO: 1778 - DNA, 20 bp, Artificial Sequence
  Primer
cgaagtttttctgcatcggt

SEQ ID NO: 1779 - DNA, 20 bp, Artificial Sequence
  Primer
agagcgtcctgtgcctcatc

SEQ ID NO: 1780 - DNA, 20 bp, Artificial Sequence
  Primer
acactcacgcgtacaacgaa

SEQ ID NO: 1781 - DNA, 20 bp, Artificial Sequence
  Primer
gggtagagctgttgacattg

SEQ ID NO: 1782 - DNA, 20 bp, Artificial Sequence
  Primer
cgacggacctgtttaccaaa

SEQ ID NO: 1783 - DNA, 20 bp, Artificial Sequence
  Primer
ttttctccgaagcatcgcag

SEQ ID NO: 1784 - DNA, 20 bp, Artificial Sequence
  Primer
ggatgccgatttccttcttc

SEQ ID NO: 1785 - DNA, 20 bp, Artificial Sequence
  Primer
ccttcggttcatgacgaacg

SEQ ID NO: 1786 - DNA, 20 bp, Artificial Sequence
  Primer
cgcatactttaaacacggtg

SEQ ID NO: 1787 - DNA, 20 bp, Artificial Sequence
  Primer
cgcctcaacaagaataacca

SEQ ID NO: 1788 - DNA, 20 bp, Artificial Sequence
  Primer
atcgccaagaggttttgcag

SEQ ID NO: 1789 - DNA, 20 bp, Artificial Sequence
  Primer
gcacatgtcccattccttct

SEQ ID NO: 1790 - DNA, 20 bp, Artificial Sequence
  Primer
cgaggatcctaaagtccaca

SEQ ID NO: 1791 - DNA, 20 bp, Artificial Sequence
  Primer
ccatgacccagttttcggat

SEQ ID NO: 1792 - DNA, 20 bp, Artificial Sequence
  Primer
ggactcctgtgacttcagag

SEQ ID NO: 1793 - DNA, 20 bp, Artificial Sequence
  Primer
gaggtccatcagaaaagagc

SEQ ID NO: 1794 - DNA, 20 bp, Artificial Sequence
  Primer
ggactcaaaggttgagggtc

SEQ ID NO: 1795 - DNA, 20 bp, Artificial Sequence
  Primer
ccgcttaccccttcttcata

SEQ ID NO: 1796 - DNA, 20 bp, Artificial Sequence
  Primer
ccgaatctccgatgcgaata

SEQ ID NO: 1797 - DNA, 20 bp, Artificial Sequence
  Primer
cgctgtaaagcttcgtgaga

SEQ ID NO: 1798 - DNA, 20 bp, Artificial Sequence
  Primer
cctgcaacgaaaaatcccca

SEQ ID NO: 1799 - DNA, 20 bp, Artificial Sequence
  Primer
gtccgcttctagtggatgat

SEQ ID NO: 1800 - DNA, 20 bp, Artificial Sequence
  Primer
cctgaaggacgatcccccaa

SEQ ID NO: 1801 - DNA, 20 bp, Artificial Sequence
  Primer
gtagacggattcgccatact

SEQ ID NO: 1802 - DNA, 20 bp, Artificial Sequence
  Primer
agtttcgctctcccacaatc

SEQ ID NO: 1803 - DNA, 20 bp, Artificial Sequence
  Primer
ggagcatctggatctaaagc

SEQ ID NO: 1804 - DNA, 20 bp, Artificial Sequence
  Primer
ccgatttcggattagtcacg

SEQ ID NO: 1805 - DNA, 20 bp, Artificial Sequence
  Primer
cccttgctaacagggattga

SEQ ID NO: 1806 - DNA, 20 bp, Artificial Sequence
  Primer
cctcctttaacatctcctcc

SEQ ID NO: 1807 - DNA, 20 bp, Artificial Sequence
  Primer
caccaagcttgcatgacgaa

SEQ ID NO: 1808 - DNA, 20 bp, Artificial Sequence
  Primer
gaaccaacgtatccgtaagg

SEQ ID NO: 1809 - DNA, 20 bp, Artificial Sequence
  Primer
gctaaatccgtagtcgctac

SEQ ID NO: 1810 - DNA, 20 bp, Artificial Sequence
  Primer
gcccatgccgctaacataat

SEQ ID NO: 1811 - DNA, 20 bp, Artificial Sequence
  Primer
ctccgggcatttgacattac

SEQ ID NO: 1812 - DNA, 20 bp, Artificial Sequence
  Primer
ggattgggtggggcagcctt

SEQ ID NO: 1813 - DNA, 20 bp, Artificial Sequence
  Primer
cccctctttttgttctgagg

SEQ ID NO: 1814 - DNA, 20 bp, Artificial Sequence
  Primer
gctgactcttgaaggactcg

SEQ ID NO: 1815 - DNA, 20 bp, Artificial Sequence
  Primer
gcaggttcgtgttaattcgt

SEQ ID NO: 1816 - DNA, 20 bp, Artificial Sequence
  Primer
acgaactacctgcaaagagc

SEQ ID NO: 1817 - DNA, 20 bp, Artificial Sequence
  Primer
ctccagaatcgggcttaatc

SEQ ID NO: 1818 - DNA, 20 bp, Artificial Sequence
  Primer
gttgggcaacagcctctaat

SEQ ID NO: 1819 - DNA, 20 bp, Artificial Sequence
  Primer
cttctactccttttcctggg

SEQ ID NO: 1820 - DNA, 20 bp, Artificial Sequence
  Primer
cacgcacatggttgggaaaa

SEQ ID NO: 1821 - DNA, 20 bp, Artificial Sequence
  Primer
ccactggaatagctagagca

SEQ ID NO: 1822 - DNA, 20 bp, Artificial Sequence
  Primer
gctttagggagcactatacc

SEQ ID NO: 1823 - DNA, 20 bp, Artificial Sequence
  Primer
ggccctgttcatgtaacaac

SEQ ID NO: 1824 - DNA, 20 bp, Artificial Sequence
  Primer
cgcctgagcatctattccct

SEQ ID NO: 1825 - DNA, 20 bp, Artificial Sequence
  Primer
gtcagtcgctcatcttgctc

SEQ ID NO: 1826 - DNA, 20 bp, Artificial Sequence
  Primer
ggcccttgagcaaaacagaa

SEQ ID NO: 1827 - DNA, 20 bp, Artificial Sequence
  Primer
ggacagagctttttgggaag

SEQ ID NO: 1828 - DNA, 20 bp, Artificial Sequence
  Primer
cccagttccactttttgagc

SEQ ID NO: 1829 - DNA, 20 bp, Artificial Sequence
  Primer
ggatctccaggacactctat

SEQ ID NO: 1830 - DNA, 20 bp, Artificial Sequence
  Primer
cggggcttctaaagaagcct

SEQ ID NO: 1831 - DNA, 20 bp, Artificial Sequence
  Primer
cactattgagcatgcgattg

SEQ ID NO: 1832 - DNA, 20 bp, Artificial Sequence
  Primer
gcttctattggagaaacctc

SEQ ID NO: 1833 - DNA, 20 bp, Artificial Sequence
  Primer
tcatcccggaacaccaaacg

SEQ ID NO: 1834 - DNA, 20 bp, Artificial Sequence
  Primer
gttcggttctcaaacggcta

SEQ ID NO: 1835 - DNA, 20 bp, Artificial Sequence
  Primer
ggctcctcaaggtaggttgt

SEQ ID NO: 1836 - DNA, 20 bp, Artificial Sequence
  Primer
ggagctctttcccccaattt

SEQ ID NO: 1837 - DNA, 20 bp, Artificial Sequence
  Primer
ggagtttccgcttttcttgt

SEQ ID NO: 1838 - DNA, 20 bp, Artificial Sequence
  Primer
tccgagcgttggaaagaacg

SEQ ID NO: 1839 - DNA, 20 bp, Artificial Sequence
  Primer
gctctagttgctttaccctc

SEQ ID NO: 1840 - DNA, 20 bp, Artificial Sequence
  Primer
cgtctccagaaattgactgg

SEQ ID NO: 1841 - DNA, 20 bp, Artificial Sequence
  Primer
ctgcaacctatctggacctt

SEQ ID NO: 1842 - DNA, 20 bp, Artificial Sequence
  Primer
ggaaacagctctggttgttg

SEQ ID NO: 1843 - DNA, 20 bp, Artificial Sequence
  Primer
gagaaacgagtgaagcttcc

SEQ ID NO: 1844 - DNA, 20 bp, Artificial Sequence
  Primer
cgcacccgcgaagaagtaat

SEQ ID NO: 1845 - DNA, 20 bp, Artificial Sequence
  Primer
cccggtaagtttacgagtga

SEQ ID NO: 1846 - DNA, 20 bp, Artificial Sequence
  Primer
ggaaactcaacctgttctgg

SEQ ID NO: 1847 - DNA, 20 bp, Artificial Sequence
  Primer
aagcagaagtcggctcatca

SEQ ID NO: 1848 - DNA, 20 bp, Artificial Sequence
  Primer
gcacgggacaaatcaaccat

SEQ ID NO: 1849 - DNA, 20 bp, Artificial Sequence
  Primer
ctcgaaccgccactacataa

SEQ ID NO: 1850 - DNA, 20 bp, Artificial Sequence
  Primer
ctctttgaacttcaagaggg

SEQ ID NO: 1851 - DNA, 20 bp, Artificial Sequence
  Primer
cccgctcagccaagaaatta

SEQ ID NO: 1852 - DNA, 20 bp, Artificial Sequence
  Primer
gctagggtcgttttcgtatc

SEQ ID NO: 1853 - DNA, 20 bp, Artificial Sequence
  Primer
ctgttgcaactgcgattgcg

SEQ ID NO: 1854 - DNA, 20 bp, Artificial Sequence
  Primer
gctaaaagctggtccacgta

SEQ ID NO: 1855 - DNA, 20 bp, Artificial Sequence
  Primer
tctcttcccaactgcagcct

SEQ ID NO: 1856 - DNA, 20 bp, Artificial Sequence
  Primer
ccagtaatctcacaagcagc

SEQ ID NO: 1857 - DNA, 20 bp, Artificial Sequence
  Primer
cctgctttcttctgcctgtt

SEQ ID NO: 1858 - DNA, 20 bp, Artificial Sequence
  Primer
gcgcctcactttctttcttc

SEQ ID NO: 1859 - DNA, 20 bp, Artificial Sequence
  Primer
gctagggtcgttttcgtatc

SEQ ID NO: 1860 - DNA, 20 bp, Artificial Sequence
  Primer
ctgctttcaaaaacatggcg

SEQ ID NO: 1861 - DNA, 20 bp, Artificial Sequence
  Primer
aatctaccaggggaaggagt

SEQ ID NO: 1862 - DNA, 20 bp, Artificial Sequence
  Primer
ccctctatcctccttttctc

SEQ ID NO: 1863 - DNA, 20 bp, Artificial Sequence
  Primer
gctatctcgcctctatttgc

SEQ ID NO: 1864 - DNA, 20 bp, Artificial Sequence
  Primer
cctaggatctggtttcagag

SEQ ID NO: 1865 - DNA, 20 bp, Artificial Sequence
  Primer
cgaccagcggagaaacaata

SEQ ID NO: 1866 - DNA, 20 bp, Artificial Sequence
  Primer
agataagagagacgctctcc

SEQ ID NO: 1867 - DNA, 20 bp, Artificial Sequence
  Primer
cccctttgtttcctgagact

SEQ ID NO: 1868 - DNA, 20 bp, Artificial Sequence
  Primer
gccccagaaacactatctcc

SEQ ID NO: 1869 - DNA, 20 bp, Artificial Sequence
  Primer
ccacaaaaaccaggatgcac

SEQ ID NO: 1870 - DNA, 20 bp, Artificial Sequence
  Primer
ggctaaaggccctacaggag

SEQ ID NO: 1871 - DNA, 20 bp, Artificial Sequence
  Primer
tgcactgcgcagacaagaat

SEQ ID NO: 1872 - DNA, 20 bp, Artificial Sequence
  Primer
gcagcgattcccaaagctaa

SEQ ID NO: 1873 - DNA, 20 bp, Artificial Sequence
  Primer
ctcattagcagggaatgctc

SEQ ID NO: 1874 - DNA, 20 bp, Artificial Sequence
  Primer
gcagcgattcccaaagctaa

SEQ ID NO: 1875 - DNA, 20 bp, Artificial Sequence
  Primer
ctcattagcagggaatgctc

SEQ ID NO: 1876 - DNA, 20 bp, Artificial Sequence
  Primer
gccagatctcatttctcact

SEQ ID NO: 1877 - DNA, 20 bp, Artificial Sequence
  Primer
aaagaggaggtctccctcct

SEQ ID NO: 1878 - DNA, 20 bp, Artificial Sequence
  Primer
gccaacctcaacctaagaga

SEQ ID NO: 1879 - DNA, 20 bp, Artificial Sequence
  Primer
gaacaactgcttgcttagcc

SEQ ID NO: 1880 - DNA, 20 bp, Artificial Sequence
  Primer
ctgagagctgaggaaacaga

SEQ ID NO: 1881 - DNA, 20 bp, Artificial Sequence
  Primer
ctcaccgagttttcgagctt

SEQ ID NO: 1882 - DNA, 20 bp, Artificial Sequence
  Primer
gaccactgctactacttcac

SEQ ID NO: 1883 - DNA, 20 bp, Artificial Sequence
  Primer
ggcgcccatctctttgattt

SEQ ID NO: 1884 - DNA, 20 bp, Artificial Sequence
  Primer
ctcaaccctcaatgaaaccc

SEQ ID NO: 1885 - DNA, 20 bp, Artificial Sequence
  Primer
cttcttgatgcgcattgagc

SEQ ID NO: 1886 - DNA, 20 bp, Artificial Sequence
  Primer
cggatccgatttccctatcg

SEQ ID NO: 1887 - DNA, 20 bp, Artificial Sequence
  Primer
cttgccaatcacatcgatca

SEQ ID NO: 1888 - DNA, 20 bp, Artificial Sequence
  Primer
cttcctgacactgccaagaa

SEQ ID NO: 1889 - DNA, 20 bp, Artificial Sequence
  Primer
gagctgctaaccacagtctt

SEQ ID NO: 1890 - DNA, 20 bp, Artificial Sequence
  Primer
cggctctatcactgttgaag

SEQ ID NO: 1891 - DNA, 20 bp, Artificial Sequence
  Primer
gtcactctgatctgcgatag

SEQ ID NO: 1892 - DNA, 20 bp, Artificial Sequence
  Primer
gttggagctgcaacagagat

SEQ ID NO: 1893 - DNA, 20 bp, Artificial Sequence
  Primer
ggctcgcattcctcatttct

SEQ ID NO: 1894 - DNA, 20 bp, Artificial Sequence
  Primer
cgcggcttccgtagctggat

SEQ ID NO: 1895 - DNA, 20 bp, Artificial Sequence
  Primer
ccacggggcctcatagaata

SEQ ID NO: 1896 - DNA, 20 bp, Artificial Sequence
  Primer
cgagagccttactgtatctc

SEQ ID NO: 1897 - DNA, 20 bp, Artificial Sequence
  Primer
gcaagcctgttcagcatcat

SEQ ID NO: 1898 - DNA, 20 bp, Artificial Sequence
  Primer
ccattagggccatagtcact

SEQ ID NO: 1899 - DNA, 20 bp, Artificial Sequence
  Primer
caaattgctgcaaacgcagg

SEQ ID NO: 1900 - DNA, 20 bp, Artificial Sequence
  Primer
cgggaatctttccatccact

SEQ ID NO: 1901 - DNA, 20 bp, Artificial Sequence
  Primer
cgggagatatcgctcgtcct

SEQ ID NO: 1902 - DNA, 20 bp, Artificial Sequence
  Primer
cccttaccctttttacgcag

SEQ ID NO: 1903 - DNA, 20 bp, Artificial Sequence
  Primer
ctccagaacagcttaccatc

SEQ ID NO: 1904 - DNA, 20 bp, Artificial Sequence
  Primer
cccggattcttgtaaggatt

SEQ ID NO: 1905 - DNA, 20 bp, Artificial Sequence
  Primer
cttctgctcgagttctgttg

SEQ ID NO: 1906 - DNA, 20 bp, Artificial Sequence
  Primer
gggccattagctagccgtgc

SEQ ID NO: 1907 - DNA, 20 bp, Artificial Sequence
  Primer
cagcaaggcttacaagcatc

SEQ ID NO: 1908 - DNA, 20 bp, Artificial Sequence
  Primer
gaagaaccattctggctacc

SEQ ID NO: 1909 - DNA, 20 bp, Artificial Sequence
  Primer
ctcccggattcttgtaagga

SEQ ID NO: 1910 - DNA, 20 bp, Artificial Sequence
  Primer
gttggatgctcagctactca

SEQ ID NO: 1911 - DNA, 20 bp, Artificial Sequence
  Primer
tggaagctgagcaagtaggc

SEQ ID NO: 1912 - DNA, 20 bp, Artificial Sequence
  Primer
ctgtctagagtctctacgca

SEQ ID NO: 1913 - DNA, 20 bp, Artificial Sequence
  Primer
catcatccccagaagccata

SEQ ID NO: 1914 - DNA, 20 bp, Artificial Sequence
  Primer
gttgtggtggtcttatccac

SEQ ID NO: 1915 - DNA, 20 bp, Artificial Sequence
  Primer
gaagaaccattctggctacc

SEQ ID NO: 1916 - DNA, 20 bp, Artificial Sequence
  Primer
cccctccgatatccttgaaa

SEQ ID NO: 1917 - DNA, 20 bp, Artificial Sequence
  Primer
gctttggcatactccctctt

SEQ ID NO: 1918 - DNA, 20 bp, Artificial Sequence
  Primer
ggtatcgaaggactgatcca

SEQ ID NO: 1919 - DNA, 20 bp, Artificial Sequence
  Primer
cccggagcctataatgacta

SEQ ID NO: 1920 - DNA, 20 bp, Artificial Sequence
  Primer
tgctgcacatgctgcacgcc

SEQ ID NO: 1921 - DNA, 20 bp, Artificial Sequence
  Primer
cggcttaaaatctgagggag

SEQ ID NO: 1922 - DNA, 20 bp, Artificial Sequence
  Primer
gctcgcctaatcagtcagat

SEQ ID NO: 1923 - DNA, 20 bp, Artificial Sequence
  Primer
ggaaaacgtgttcgcggaaa

SEQ ID NO: 1924 - DNA, 20 bp, Artificial Sequence
  Primer
acagaaggaaccgtggtacg

SEQ ID NO: 1925 - DNA, 20 bp, Artificial Sequence
  Primer
gacgttcaaagctccagcta

SEQ ID NO: 1926 - DNA, 20 bp, Artificial Sequence
  Primer
ctttgtcgagagacctacag

SEQ ID NO: 1927 - DNA, 20 bp, Artificial Sequence
  Primer
gttcaatgcccagcacacat

SEQ ID NO: 1928 - DNA, 20 bp, Artificial Sequence
  Primer
gctaggcaggggttatctat

SEQ ID NO: 1929 - DNA, 20 bp, Artificial Sequence
  Primer
ctgctaaaactggcgaaggg

SEQ ID NO: 1930 - DNA, 20 bp, Artificial Sequence
  Primer
cctagaggcacatatccttg

SEQ ID NO: 1931 - DNA, 20 bp, Artificial Sequence
  Primer
cagcaagcacaagttggtga

SEQ ID NO: 1932 - DNA, 20 bp, Artificial Sequence
  Primer
cgcactctgtttgtcccatt

SEQ ID NO: 1933 - DNA, 20 bp, Artificial Sequence
  Primer
gtttcctggcaaatctggag

SEQ ID NO: 1934 - DNA, 20 bp, Artificial Sequence
  Primer
ggatcatagctatgggggta

SEQ ID NO: 1935 - DNA, 20 bp, Artificial Sequence
  Primer
gtgtggtatgctgaagctac

SEQ ID NO: 1936 - DNA, 20 bp, Artificial Sequence
  Primer
gatgcggccctgaatatgat

SEQ ID NO: 1937 - DNA, 20 bp, Artificial Sequence
  Primer
aatagaggtagcaactgccc

SEQ ID NO: 1938 - DNA, 20 bp, Artificial Sequence
  Primer
cgcggagcaatcaaacaaac

SEQ ID NO: 1939 - DNA, 20 bp, Artificial Sequence
  Primer
gttggggaaatccttctcta

SEQ ID NO: 1940 - DNA, 20 bp, Artificial Sequence
  Primer
ctcttaatggctgttcgcct

SEQ ID NO: 1941 - DNA, 20 bp, Artificial Sequence
  Primer
ccctacgttcgcggaaaaat

SEQ ID NO: 1942 - DNA, 20 bp, Artificial Sequence
  Primer
gtctatcaatggatctccgc

SEQ ID NO: 1943 - DNA, 20 bp, Artificial Sequence
  Primer
gcgctcttccttgaaactct

SEQ ID NO: 1944 - DNA, 20 bp, Artificial Sequence
  Primer
gctctgttcccggatttgat

SEQ ID NO: 1945 - DNA, 20 bp, Artificial Sequence
  Primer
gcgcgcttcctttatgcaaa

SEQ ID NO: 1946 - DNA, 20 bp, Artificial Sequence
  Primer
ggtctactgaggaaaatcgc

SEQ ID NO: 1947 - DNA, 20 bp, Artificial Sequence
  Primer
cacctgtaaattatgccgtc

SEQ ID NO: 1948 - DNA, 20 bp, Artificial Sequence
  Primer
aagctgatgaggcaacgcaa

SEQ ID NO: 1949 - DNA, 20 bp, Artificial Sequence
  Primer
ctgaggaaaatcgcttcctc

SEQ ID NO: 1950 - DNA, 20 bp, Artificial Sequence
  Primer
tccgctcgcattcctgtatg

SEQ ID NO: 1951 - DNA, 20 bp, Artificial Sequence
  Primer
tgtggaagcaccgctctctt

SEQ ID NO: 1952 - DNA, 20 bp, Artificial Sequence
  Primer
ggtctgagaatggcttcctt

SEQ ID NO: 1953 - DNA, 20 bp, Artificial Sequence
  Primer
cggagatcatttcggatact

SEQ ID NO: 1954 - DNA, 20 bp, Artificial Sequence
  Primer
ccaagcaacatcctggtttg

SEQ ID NO: 1955 - DNA, 20 bp, Artificial Sequence
  Primer
gcccttctcttcctggaata

SEQ ID NO: 1956 - DNA, 20 bp, Artificial Sequence
  Primer
gggccttgcgaaaaaaacca

SEQ ID NO: 1957 - DNA, 20 bp, Artificial Sequence
  Primer
ccattctttcgctcttgagg

SEQ ID NO: 1958 - DNA, 20 bp, Artificial Sequence
  Primer
caatcgccctctatgcctat

SEQ ID NO: 1959 - DNA, 20 bp, Artificial Sequence
  Primer
cctagcttctgtccaagcat

SEQ ID NO: 1960 - DNA, 20 bp, Artificial Sequence
  Primer
gcggccttacttatgcaaag

SEQ ID NO: 1961 - DNA, 20 bp, Artificial Sequence
  Primer
ctgggccttgcgaaaaaaac

SEQ ID NO: 1962 - DNA, 20 bp, Artificial Sequence
  Primer
gggtccgtatgacaattcct

SEQ ID NO: 1963 - DNA, 20 bp, Artificial Sequence
  Primer
cacatcgaactctttcgctc

SEQ ID NO: 1964 - DNA, 20 bp, Artificial Sequence
  Primer
gcgggagtcaatatcaacga

SEQ ID NO: 1965 - DNA, 20 bp, Artificial Sequence
  Primer
gagcacctctcttatcctgt

SEQ ID NO: 1966 - DNA, 20 bp, Artificial Sequence
  Primer
cccaaaccgatatggagcta

SEQ ID NO: 1967 - DNA, 20 bp, Artificial Sequence
  Primer
cggcctcagaaatctatgtg

SEQ ID NO: 1968 - DNA, 20 bp, Artificial Sequence
  Primer
ctcttacagccaactgcaca

SEQ ID NO: 1969 - DNA, 20 bp, Artificial Sequence
  Primer
cttggctgtcgcttcatcag

SEQ ID NO: 1970 - DNA, 20 bp, Artificial Sequence
  Primer
tttgtccagatcaccgcagc

SEQ ID NO: 1971 - DNA, 20 bp, Artificial Sequence
  Primer
cccttctcgaagattcttcc

SEQ ID NO: 1972 - DNA, 20 bp, Artificial Sequence
  Primer
ctccacaccaaaactacatc

SEQ ID NO: 1973 - DNA, 20 bp, Artificial Sequence
  Primer
ggaccggagatgaattccat

SEQ ID NO: 1974 - DNA, 20 bp, Artificial Sequence
  Primer
aagagctttctcaacgagcc

SEQ ID NO: 1975 - DNA, 20 bp, Artificial Sequence
  Primer
ctctctgagctagtagggtt

SEQ ID NO: 1976 - DNA, 20 bp, Artificial Sequence
  Primer
cccttgcaacgatagctttc

SEQ ID NO: 1977 - DNA, 20 bp, Artificial Sequence
  Primer
gcattccgtaggaggagtta

SEQ ID NO: 1978 - DNA, 20 bp, Artificial Sequence
  Primer
ccagggctgcaagaacaaaa

SEQ ID NO: 1979 - DNA, 20 bp, Artificial Sequence
  Primer
gcgagcatacaacaatctcc

SEQ ID NO: 1980 - DNA, 20 bp, Artificial Sequence
  Primer
agcactcgcttcgctagatg

SEQ ID NO: 1981 - DNA, 20 bp, Artificial Sequence
  Primer
ctccatcaatacccagggat

SEQ ID NO: 1982 - DNA, 20 bp, Artificial Sequence
  Primer
cggagctccttgtaagttgt

SEQ ID NO: 1983 - DNA, 20 bp, Artificial Sequence
  Primer
gactaacaacccatccatcc

SEQ ID NO: 1984 - DNA, 20 bp, Artificial Sequence
  Primer
cgatcaacccaggaatgagt

SEQ ID NO: 1985 - DNA, 20 bp, Artificial Sequence
  Primer
gcttccaaggcgacttacta

SEQ ID NO: 1986 - DNA, 20 bp, Artificial Sequence
  Primer
gacacagaccaacccaaaca

SEQ ID NO: 1987 - DNA, 20 bp, Artificial Sequence
  Primer
ctgacatcccacgaacatag

SEQ ID NO: 1988 - DNA, 20 bp, Artificial Sequence
  Primer
gcacgcactaatttagcagc

SEQ ID NO: 1989 - DNA, 20 bp, Artificial Sequence
  Primer
gaggcttcatcacagaaagg

SEQ ID NO: 1990 - DNA, 20 bp, Artificial Sequence
  Primer
gacagaagctaggcaaccaa

SEQ ID NO: 1991 - DNA, 20 bp, Artificial Sequence
  Primer
ctgccaaacctccaaaaacc

SEQ ID NO: 1992 - DNA, 20 bp, Artificial Sequence
  Primer
gccttggaaaatctctgacc

SEQ ID NO: 1993 - DNA, 20 bp, Artificial Sequence
  Primer
catccgacttccttgttcgt

SEQ ID NO: 1994 - DNA, 20 bp, Artificial Sequence
  Primer
ccaaacagatttctgctact

SEQ ID NO: 1995 - DNA, 20 bp, Artificial Sequence
  Primer
cacaatagtcttcccttcgc

SEQ ID NO: 1996 - DNA, 20 bp, Artificial Sequence
  Primer
tccgagacctttggtggtat

SEQ ID NO: 1997 - DNA, 20 bp, Artificial Sequence
  Primer
ctgaacgcattgtggcctgt

SEQ ID NO: 1998 - DNA, 20 bp, Artificial Sequence
  Primer
tgcagcagcagagaaggaag

SEQ ID NO: 1999 - DNA, 20 bp, Artificial Sequence
  Primer
ggagctttggaatgcttacg

SEQ ID NO: 2000 - DNA, 20 bp, Artificial Sequence
  Primer
gtgtttgctggtatctatcc

SEQ ID NO: 2001 - DNA, 20 bp, Artificial Sequence
  Primer
ctgcagagctcaaagctaag

SEQ ID NO: 2002 - DNA, 20 bp, Artificial Sequence
  Primer
gacgattcgagctttagcga

SEQ ID NO: 2003 - DNA, 20 bp, Artificial Sequence
  Primer
gagaaggaagcttcttctgc

SEQ ID NO: 2004 - DNA, 20 bp, Artificial Sequence
  Primer
gccggaaacctgtttctgaa

SEQ ID NO: 2005 - DNA, 20 bp, Artificial Sequence
  Primer
tagatacccctggacacgta

SEQ ID NO: 2006 - DNA, 20 bp, Artificial Sequence
  Primer
catagcgtcgctcagaatct

SEQ ID NO: 2007 - DNA, 20 bp, Artificial Sequence
  Primer
ccgctgtggatttttaggac

SEQ ID NO: 2008 - DNA, 20 bp, Artificial Sequence
  Primer
ggatcgaaccctaaataggc

SEQ ID NO: 2009 - DNA, 20 bp, Artificial Sequence
  Primer
ctgctgctccaaggaggtag

SEQ ID NO: 2010 - DNA, 20 bp, Artificial Sequence
  Primer
gccgatgcgctacattcttt

SEQ ID NO: 2011 - DNA, 20 bp, Artificial Sequence
  Primer
agcttgtcctcttgaggaac

SEQ ID NO: 2012 - DNA, 20 bp, Artificial Sequence
  Primer
gacaccgctcctaacaaagt

SEQ ID NO: 2013 - DNA, 20 bp, Artificial Sequence
  Primer
gtcaaacgctcatcaagagc

SEQ ID NO: 2014 - DNA, 20 bp, Artificial Sequence
  Primer
ttccacaccgaacgaatacc

SEQ ID NO: 2015 - DNA, 20 bp, Artificial Sequence
  Primer
cgaccaatatagctgccaag

SEQ ID NO: 2016 - DNA, 20 bp, Artificial Sequence
  Primer
cgtgattgaggtcttggaag

SEQ ID NO: 2017 - DNA, 20 bp, Artificial Sequence
  Primer
gcttcacctgagcaactact

SEQ ID NO: 2018 - DNA, 20 bp, Artificial Sequence
  Primer
gctattcgttgtggttgtcg

SEQ ID NO: 2019 - DNA, 20 bp, Artificial Sequence
  Primer
ccgctcctttagttatgacg

SEQ ID NO: 2020 - DNA, 20 bp, Artificial Sequence
  Primer
gctattcgttgtggttgtcg

SEQ ID NO: 2021 - DNA, 20 bp, Artificial Sequence
  Primer
ccgctcctttagttatgacg

SEQ ID NO: 2022 - DNA, 20 bp, Artificial Sequence
  Primer
ccgaacgcttttcgaccttc

SEQ ID NO: 2023 - DNA, 20 bp, Artificial Sequence
  Primer
cgaagaggctattcgttgtg

SEQ ID NO: 2024 - DNA, 20 bp, Artificial Sequence
  Primer
ccgagcagtagcaagaaaac

SEQ ID NO: 2025 - DNA, 20 bp, Artificial Sequence
  Primer
acgcttaggcaaagctatgc

SEQ ID NO: 2026 - DNA, 20 bp, Artificial Sequence
  Primer
aacactaccaacagcgaccg

SEQ ID NO: 2027 - DNA, 20 bp, Artificial Sequence
  Primer
gcagtttctcaacgcattcg

SEQ ID NO: 2028 - DNA, 20 bp, Artificial Sequence
  Primer
cctcgaagaactccagctaa

SEQ ID NO: 2029 - DNA, 20 bp, Artificial Sequence
  Primer
ctctccaactcgttggaaga

SEQ ID NO: 2030 - DNA, 20 bp, Artificial Sequence
  Primer
gaccccatcccctttggagt

SEQ ID NO: 2031 - DNA, 20 bp, Artificial Sequence
  Primer
gcccctgtaaatagccgtaa

SEQ ID NO: 2032 - DNA, 20 bp, Artificial Sequence
  Primer
gatcctgtaccagaaacacc

SEQ ID NO: 2033 - DNA, 20 bp, Artificial Sequence
  Primer
atcgcaatcgttggcgccga

SEQ ID NO: 2034 - DNA, 20 bp, Artificial Sequence
  Primer
ctctggggaatctgtacaac

SEQ ID NO: 2035 - DNA, 20 bp, Artificial Sequence
  Primer
ccaagcggcttctaaacaca

SEQ ID NO: 2036 - DNA, 20 bp, Artificial Sequence
  Primer
ccacagatgcagtcacattc

SEQ ID NO: 2037 - DNA, 20 bp, Artificial Sequence
  Primer
gcagaagaaatcatggcttc

SEQ ID NO: 2038 - DNA, 20 bp, Artificial Sequence
  Primer
gggaaacaatgtcaccgaca

SEQ ID NO: 2039 - DNA, 20 bp, Artificial Sequence
  Primer
gttaagcggagtagctactc

SEQ ID NO: 2040 - DNA, 20 bp, Artificial Sequence
  Primer
cggtatgcatcaaccacaac

SEQ ID NO: 2041 - DNA, 20 bp, Artificial Sequence
  Primer
ctattaagaccgcatccgac

SEQ ID NO: 2042 - DNA, 20 bp, Artificial Sequence
  Primer
ccccttgattctgagatagc

SEQ ID NO: 2043 - DNA, 20 bp, Artificial Sequence
  Primer
ggtccgacaactgcatctat

SEQ ID NO: 2044 - DNA, 20 bp, Artificial Sequence
  Primer
cgccatagccacaagtgtat

SEQ ID NO: 2045 - DNA, 20 bp, Artificial Sequence
  Primer
gcgaataagtcccgttatcc

SEQ ID NO: 2046 - DNA, 20 bp, Artificial Sequence
  Primer
cggtctttacgaagaagagc

SEQ ID NO: 2047 - DNA, 20 bp, Artificial Sequence
  Primer
tcctaatccccccgctttca

SEQ ID NO: 2048 - DNA, 20 bp, Artificial Sequence
  Primer
cctcaagagatgaagagcca

SEQ ID NO: 2049 - DNA, 20 bp, Artificial Sequence
  Primer
ccccttgattctgagatagc

SEQ ID NO: 2050 - DNA, 20 bp, Artificial Sequence
  Primer
cggcaggcttacgtactaca

SEQ ID NO: 2051 - DNA, 20 bp, Artificial Sequence
  Primer
ccatagccacaagtgtattc

SEQ ID NO: 2052 - DNA, 20 bp, Artificial Sequence
  Primer
agaaacaaccatagcacccg

SEQ ID NO: 2053 - DNA, 20 bp, Artificial Sequence
  Primer
cgctcagcaaaatactctcc

SEQ ID NO: 2054 - DNA, 20 bp, Artificial Sequence
  Primer
gcagtagaaaaggccagaac

SEQ ID NO: 2055 - DNA, 20 bp, Artificial Sequence
  Primer
gctacagtcttcttagctgc

SEQ ID NO: 2056 - DNA, 20 bp, Artificial Sequence
  Primer
cgagcttgcgccttcttatt

SEQ ID NO: 2057 - DNA, 20 bp, Artificial Sequence
  Primer
cggaatcgaatgttacccct

SEQ ID NO: 2058 - DNA, 20 bp, Artificial Sequence
  Primer
gtttaagccccccccctctt

SEQ ID NO: 2059 - DNA, 20 bp, Artificial Sequence
  Primer
ggaagaacaagagcatccgc

SEQ ID NO: 2060 - DNA, 20 bp, Artificial Sequence
  Primer
ggagccgatcattatctagc

SEQ ID NO: 2061 - DNA, 20 bp, Artificial Sequence
  Primer
ccccctcttctcttcatttc

SEQ ID NO: 2062 - DNA, 20 bp, Artificial Sequence
  Primer
tcctcttgcggttcgctgaa

SEQ ID NO: 2063 - DNA, 20 bp, Artificial Sequence
  Primer
ccctttaacccccattttgc

SEQ ID NO: 2064 - DNA, 20 bp, Artificial Sequence
  Primer
gcccacaaaactctgttagt

SEQ ID NO: 2065 - DNA, 20 bp, Artificial Sequence
  Primer
ggtagccatcagcagaagaa

SEQ ID NO: 2066 - DNA, 20 bp, Artificial Sequence
  Primer
gcaatcctgttatgcgcgaa

SEQ ID NO: 2067 - DNA, 20 bp, Artificial Sequence
  Primer
cacttgtcgatccgaaatgt

SEQ ID NO: 2068 - DNA, 20 bp, Artificial Sequence
  Primer
ctcccatattcccgttggat

SEQ ID NO: 2069 - DNA, 20 bp, Artificial Sequence
  Primer
ggagatgctgcttgtgatgt

SEQ ID NO: 2070 - DNA, 20 bp, Artificial Sequence
  Primer
atttcggggaaatgttccgc

SEQ ID NO: 2071 - DNA, 20 bp, Artificial Sequence
  Primer
cttgttcgcaattgcttgac

SEQ ID NO: 2072 - DNA, 20 bp, Artificial Sequence
  Primer
gcttcatctctttgccttac

SEQ ID NO: 2073 - DNA, 20 bp, Artificial Sequence
  Primer
gtggattcctttttgctggc

SEQ ID NO: 2074 - DNA, 20 bp, Artificial Sequence
  Primer
cagttcttctctgcctctct

SEQ ID NO: 2075 - DNA, 20 bp, Artificial Sequence
  Primer
gctagcactattctgcgctt

SEQ ID NO: 2076 - DNA, 20 bp, Artificial Sequence
  Primer
ccacggaatccgaagcaaat

SEQ ID NO: 2077 - DNA, 20 bp, Artificial Sequence
  Primer
cggggaaatgttccgcattt

SEQ ID NO: 2078 - DNA, 20 bp, Artificial Sequence
  Primer
caagctatgcactcccttct

SEQ ID NO: 2079 - DNA, 20 bp, Artificial Sequence
  Primer
ccggaatcatagcttacctg

SEQ ID NO: 2080 - DNA, 20 bp, Artificial Sequence
  Primer
cgacatattcttgatacccc

SEQ ID NO: 2081 - DNA, 20 bp, Artificial Sequence
  Primer
gtggatggccgctatattag

SEQ ID NO: 2082 - DNA, 20 bp, Artificial Sequence
  Primer
ctctctcctgtagcagacaa

SEQ ID NO: 2083 - DNA, 20 bp, Artificial Sequence
  Primer
ccaactcctcttttctctcc

SEQ ID NO: 2084 - DNA, 20 bp, Artificial Sequence
  Primer
ggtaagatacaagctccagc

SEQ ID NO: 2085 - DNA, 20 bp, Artificial Sequence
  Primer
gtaatcggcaccgcactgct

SEQ ID NO: 2086 - DNA, 20 bp, Artificial Sequence
  Primer
ccttcaccgtaagcaactct

SEQ ID NO: 2087 - DNA, 20 bp, Artificial Sequence
  Primer
cgcataaacatctgcaggca

SEQ ID NO: 2088 - DNA, 20 bp, Artificial Sequence
  Primer
acacttcagggaccgactca

SEQ ID NO: 2089 - DNA, 20 bp, Artificial Sequence
  Primer
gaactctagaaatctccgcc

SEQ ID NO: 2090 - DNA, 20 bp, Artificial Sequence
  Primer
taccacaggctctgccatca

SEQ ID NO: 2091 - DNA, 20 bp, Artificial Sequence
  Primer
cgtcttgagaaaagggggaa

SEQ ID NO: 2092 - DNA, 20 bp, Artificial Sequence
  Primer
ccttgtttcactaaagcccc

SEQ ID NO: 2093 - DNA, 20 bp, Artificial Sequence
  Primer
cgacttcaggatcttcaagc

SEQ ID NO: 2094 - DNA, 20 bp, Artificial Sequence
  Primer
actgttgcccaggagagaca

SEQ ID NO: 2095 - DNA, 20 bp, Artificial Sequence
  Primer
ccgcgcacccattggtgaga

SEQ ID NO: 2096 - DNA, 20 bp, Artificial Sequence
  Primer
cttgcaactcaacccctaag

SEQ ID NO: 2097 - DNA, 20 bp, Artificial Sequence
  Primer
tctctcgggtcattccctta

SEQ ID NO: 2098 - DNA, 20 bp, Artificial Sequence
  Primer
aatggggcaccaagccgcct

SEQ ID NO: 2099 - DNA, 20 bp, Artificial Sequence
  Primer
ccgttaccgcagacgtatgt

SEQ ID NO: 2100 - DNA, 20 bp, Artificial Sequence
  Primer
gttgggatcttctggcctat

SEQ ID NO: 2101 - DNA, 20 bp, Artificial Sequence
  Primer
gctcttcccaatttctagcc

SEQ ID NO: 2102 - DNA, 20 bp, Artificial Sequence
  Primer
cagctttaacgaccacgcta

SEQ ID NO: 2103 - DNA, 20 bp, Artificial Sequence
  Primer
gccgcatcctttaacgcaat

SEQ ID NO: 2104 - DNA, 20 bp, Artificial Sequence
  Primer
ccacctccataggtttcttc

SEQ ID NO: 2105 - DNA, 20 bp, Artificial Sequence
  Primer
ggtgacgaactgtaccttga

SEQ ID NO: 2106 - DNA, 20 bp, Artificial Sequence
  Primer
gcgatgcaagaagtctttgg

SEQ ID NO: 2107 - DNA, 20 bp, Artificial Sequence
  Primer
aaaggaaccactttggtccc

SEQ ID NO: 2108 - DNA, 20 bp, Artificial Sequence
  Primer
gccactacgtcttcaccatt

SEQ ID NO: 2109 - DNA, 20 bp, Artificial Sequence
  Primer
ccataatgcggtaagcctgt

SEQ ID NO: 2110 - DNA, 20 bp, Artificial Sequence
  Primer
ctgccccacaagaaagggca

SEQ ID NO: 2111 - DNA, 20 bp, Artificial Sequence
  Primer
tgcctctgtacttctccccg

SEQ ID NO: 2112 - DNA, 20 bp, Artificial Sequence
  Primer
cgagcagaaatgtatgggga

SEQ ID NO: 2113 - DNA, 20 bp, Artificial Sequence
  Primer
ggctgaagacttacccaaac

SEQ ID NO: 2114 - DNA, 20 bp, Artificial Sequence
  Primer
ggcgatcctacccaaataga

SEQ ID NO: 2115 - DNA, 20 bp, Artificial Sequence
  Primer
gcaaacagttgcaatgaggc

SEQ ID NO: 2116 - DNA, 20 bp, Artificial Sequence
  Primer
gctgcgttaaacacggtcat

SEQ ID NO: 2117 - DNA, 20 bp, Artificial Sequence
  Primer
aatatccccttccgtccctc

SEQ ID NO: 2118 - DNA, 20 bp, Artificial Sequence
  Primer
ccctgcaaacaatccagcaa

SEQ ID NO: 2119 - DNA, 20 bp, Artificial Sequence
  Primer
gtcttggcagacgagtccat

SEQ ID NO: 2120 - DNA, 20 bp, Artificial Sequence
  Primer
acgtttccctgtcaccagtt

SEQ ID NO: 2121 - DNA, 20 bp, Artificial Sequence
  Primer
ccatgtagagcaaatgcagc

SEQ ID NO: 2122 - DNA, 20 bp, Artificial Sequence
  Primer
cgatgctctcgtgattgtag

SEQ ID NO: 2123 - DNA, 20 bp, Artificial Sequence
  Primer
acagcaaaggctatcagagc

SEQ ID NO: 2124 - DNA, 20 bp, Artificial Sequence
  Primer
gcaggtattcgacatcgctt

SEQ ID NO: 2125 - DNA, 20 bp, Artificial Sequence
  Primer
acacctctgttggagatagc

SEQ ID NO: 2126 - DNA, 20 bp, Artificial Sequence
  Primer
ctttgctccctactctttgc

SEQ ID NO: 2127 - DNA, 20 bp, Artificial Sequence
  Primer
cgtctagctcaagggaatct

SEQ ID NO: 2128 - DNA, 20 bp, Artificial Sequence
  Primer
ggaaaggaggctgtcgttac

SEQ ID NO: 2129 - DNA, 20 bp, Artificial Sequence
  Primer
tttacgtagagcctgtctcg

SEQ ID NO: 2130 - DNA, 20 bp, Artificial Sequence
  Primer
gcaacgagccaaagagattc

SEQ ID NO: 2131 - DNA, 20 bp, Artificial Sequence
  Primer
cgatggaaaagaaagctgcg

SEQ ID NO: 2132 - DNA, 20 bp, Artificial Sequence
  Primer
gggagttcttcctcttgtca

SEQ ID NO: 2133 - DNA, 20 bp, Artificial Sequence
  Primer
gtttcgcaactgtctccttc

SEQ ID NO: 2134 - DNA, 20 bp, Artificial Sequence
  Primer
ccaccttttcccagctttag

SEQ ID NO: 2135 - DNA, 20 bp, Artificial Sequence
  Primer
tctctcttccatacacgccc

SEQ ID NO: 2136 - DNA, 20 bp, Artificial Sequence
  Primer
gagaaccctctccatagttt

SEQ ID NO: 2137 - DNA, 20 bp, Artificial Sequence
  Primer
gtcagaatatctctcgcata

SEQ ID NO: 2138 - DNA, 20 bp, Artificial Sequence
  Primer
tctacagcgcagccgaacaa

SEQ ID NO: 2139 - DNA, 20 bp, Artificial Sequence
  Primer
agcaaatcctccgctctgga

SEQ ID NO: 2140 - DNA, 20 bp, Artificial Sequence
  Primer
cctgctagtaaccctattgg

SEQ ID NO: 2141 - DNA, 20 bp, Artificial Sequence
  Primer
gctccctacttcctcgaggg

SEQ ID NO: 2142 - DNA, 20 bp, Artificial Sequence
  Primer
gggcatcttccaactccaat

SEQ ID NO: 2143 - DNA, 20 bp, Artificial Sequence
  Primer
gctttacgcacagcatcctt

SEQ ID NO: 2144 - DNA, 20 bp, Artificial Sequence
  Primer
gggttatggtctgcctaaac

SEQ ID NO: 2145 - DNA, 20 bp, Artificial Sequence
  Primer
gatcacatcacagcgctcaa

SEQ ID NO: 2146 - DNA, 20 bp, Artificial Sequence
  Primer
aattaggtgttcgtcggcct

SEQ ID NO: 2147 - DNA, 20 bp, Artificial Sequence
  Primer
cgaagtcaccatgtcttctc

SEQ ID NO: 2148 - DNA, 20 bp, Artificial Sequence
  Primer
ctcataacaaaccaacccaa

SEQ ID NO: 2149 - DNA, 20 bp, Artificial Sequence
  Primer
gacttctctatcccaacgct

SEQ ID NO: 2150 - DNA, 20 bp, Artificial Sequence
  Primer
gacaagtgcaaaccgttcag

SEQ ID NO: 2151 - DNA, 20 bp, Artificial Sequence
  Primer
cccgagttctccagaaatct

SEQ ID NO: 2152 - DNA, 20 bp, Artificial Sequence
  Primer
gcatcatagaagccttggct

SEQ ID NO: 2153 - DNA, 20 bp, Artificial Sequence
  Primer
ggaatcccatgcgacctgat

SEQ ID NO: 2154 - DNA, 20 bp, Artificial Sequence
  Primer
catgttccggcttacgaatc

SEQ ID NO: 2155 - DNA, 20 bp, Artificial Sequence
  Primer
cggcgctatttgctgtagta

SEQ ID NO: 2156 - DNA, 20 bp, Artificial Sequence
  Primer
cttacgagctcacctagaac

SEQ ID NO: 2157 - DNA, 20 bp, Artificial Sequence
  Primer
gggaacctctcttctcactt

SEQ ID NO: 2158 - DNA, 20 bp, Artificial Sequence
  Primer
ccctgcatccttggagtaat

SEQ ID NO: 2159 - DNA, 20 bp, Artificial Sequence
  Primer
cggcttacgaatcaaagagc

SEQ ID NO: 2160 - DNA, 20 bp, Artificial Sequence
  Primer
cgaaccttcttcagctcctg

SEQ ID NO: 2161 - DNA, 20 bp, Artificial Sequence
  Primer
cccaaagagagttgggcacc

SEQ ID NO: 2162 - DNA, 20 bp, Artificial Sequence
  Primer
ggtgcgataagcatcacaga

SEQ ID NO: 2163 - DNA, 20 bp, Artificial Sequence
  Primer
cacccagtatggcagtctta

SEQ ID NO: 2164 - DNA, 20 bp, Artificial Sequence
  Primer
catcgcggtcatgatagaag

SEQ ID NO: 2165 - DNA, 20 bp, Artificial Sequence
  Primer
ccccattcgtgctcatattg

SEQ ID NO: 2166 - DNA, 20 bp, Artificial Sequence
  Primer
acgcaagcttccagcttcct

SEQ ID NO: 2167 - DNA, 20 bp, Artificial Sequence
  Primer
gtctccgtattctgatcctg

SEQ ID NO: 2168 - DNA, 20 bp, Artificial Sequence
  Primer
caggcagtacggcaagtaat

SEQ ID NO: 2169 - DNA, 20 bp, Artificial Sequence
  Primer
ccaaagtaggagtttgctcc

SEQ ID NO: 2170 - DNA, 20 bp, Artificial Sequence
  Primer
cccccatttaaagagcagca

SEQ ID NO: 2171 - DNA, 20 bp, Artificial Sequence
  Primer
cattagctgggggcttagtc

SEQ ID NO: 2172 - DNA, 20 bp, Artificial Sequence
  Primer
caagtatcccccagtagtag

SEQ ID NO: 2173 - DNA, 20 bp, Artificial Sequence
  Primer
ggcagtacggcaagtaatga

SEQ ID NO: 2174 - DNA, 20 bp, Artificial Sequence
  Primer
gccattgtctctccaatagg

SEQ ID NO: 2175 - DNA, 20 bp, Artificial Sequence
  Primer
gccattcaaacagcacaagg

SEQ ID NO: 2176 - DNA, 20 bp, Artificial Sequence
  Primer
agctccctatcaggactagc

SEQ ID NO: 2177 - DNA, 20 bp, Artificial Sequence
  Primer
ggggctaaagaagatactcg

SEQ ID NO: 2178 - DNA, 20 bp, Artificial Sequence
  Primer
gatttcgctagagggaagtc

SEQ ID NO: 2179 - DNA, 20 bp, Artificial Sequence
  Primer
ggtaccagtacgtcagctaa

SEQ ID NO: 2180 - DNA, 20 bp, Artificial Sequence
  Primer
gatttcgctagagggaagtc

SEQ ID NO: 2181 - DNA, 20 bp, Artificial Sequence
  Primer
cgtcagctaatcctcctaga

SEQ ID NO: 2182 - DNA, 20 bp, Artificial Sequence
  Primer
tctcccagagctttcttggc

SEQ ID NO: 2183 - DNA, 20 bp, Artificial Sequence
  Primer
caagaaggtttcttgctggc

SEQ ID NO: 2184 - DNA, 20 bp, Artificial Sequence
  Primer
cggatcgacagtaaaagtcc

SEQ ID NO: 2185 - DNA, 20 bp, Artificial Sequence
  Primer
caaagccctctacacctcct

SEQ ID NO: 2186 - DNA, 20 bp, Artificial Sequence
  Primer
gaacctgcccagattctgtg

SEQ ID NO: 2187 - DNA, 20 bp, Artificial Sequence
  Primer
gcagactccgatcaagaaga

SEQ ID NO: 2188 - DNA, 20 bp, Artificial Sequence
  Primer
gactcgataatcttggggag

SEQ ID NO: 2189 - DNA, 20 bp, Artificial Sequence
  Primer
ctcttgtctcgcgatttcag

SEQ ID NO: 2190 - DNA, 20 bp, Artificial Sequence
  Primer
ccagctcatgcgaagaagaa

SEQ ID NO: 2191 - DNA, 20 bp, Artificial Sequence
  Primer
gtgtcctggaacccaatcta

SEQ ID NO: 2192 - DNA, 20 bp, Artificial Sequence
  Primer
cccttctatcctttccacag

SEQ ID NO: 2193 - DNA, 20 bp, Artificial Sequence
  Primer
ggcataaggatcatgagcca

SEQ ID NO: 2194 - DNA, 20 bp, Artificial Sequence
  Primer
ccaaacaagctattgacgct

SEQ ID NO: 2195 - DNA, 20 bp, Artificial Sequence
  Primer
gagaagttccacgtgttgag

SEQ ID NO: 2196 - DNA, 20 bp, Artificial Sequence
  Primer
gttcctgtgtatggaaacgc

SEQ ID NO: 2197 - DNA, 20 bp, Artificial Sequence
  Primer
catagatacgtggttccggc

SEQ ID NO: 2198 - DNA, 20 bp, Artificial Sequence
  Primer
ggttctttcgcacacctttc

SEQ ID NO: 2199 - DNA, 20 bp, Artificial Sequence
  Primer
gggaccttgaataggaactc

SEQ ID NO: 2200 - DNA, 20 bp, Artificial Sequence
  Primer
ggaaacctctgctcaaacac

SEQ ID NO: 2201 - DNA, 20 bp, Artificial Sequence
  Primer
caaccaagagagtgtcttcc

SEQ ID NO: 2202 - DNA, 20 bp, Artificial Sequence
  Primer
cgctccatatgcgccaaaaa

SEQ ID NO: 2203 - DNA, 20 bp, Artificial Sequence
  Primer
ccctccacaaatgccaatga

SEQ ID NO: 2204 - DNA, 20 bp, Artificial Sequence
  Primer
ctccacgcgtaaactatcag

SEQ ID NO: 2205 - DNA, 20 bp, Artificial Sequence
  Primer
ctccttaccttcttctcagg

SEQ ID NO: 2206 - DNA, 20 bp, Artificial Sequence
  Primer
ccagcattatccggaatgct

SEQ ID NO: 2207 - DNA, 20 bp, Artificial Sequence
  Primer
tctcaatgccaccaagcaag

SEQ ID NO: 2208 - DNA, 20 bp, Artificial Sequence
  Primer
ccagtacgaacaatcgctga

SEQ ID NO: 2209 - DNA, 20 bp, Artificial Sequence
  Primer
tagcgagcatcgtcgctaca

SEQ ID NO: 2210 - DNA, 20 bp, Artificial Sequence
  Primer
gcccctttctcccgtaattt

SEQ ID NO: 2211 - DNA, 20 bp, Artificial Sequence
  Primer
ccccaacattccactccttt

SEQ ID NO: 2212 - DNA, 20 bp, Artificial Sequence
  Primer
gtcaacatggaaagcagtgc

SEQ ID NO: 2213 - DNA, 20 bp, Artificial Sequence
  Primer
cagtacgaacaatcgctgag

SEQ ID NO: 2214 - DNA, 20 bp, Artificial Sequence
  Primer
cccatcctaagtattgctct

SEQ ID NO: 2215 - DNA, 20 bp, Artificial Sequence
  Primer
gcccctttctcccgtaattt

SEQ ID NO: 2216 - DNA, 20 bp, Artificial Sequence
  Primer
agactcggggagtgcaatta

SEQ ID NO: 2217 - DNA, 20 bp, Artificial Sequence
  Primer
cgtacaggagaatgtatggc

SEQ ID NO: 2218 - DNA, 20 bp, Artificial Sequence
  Primer
ctactcctagctcccttaac

SEQ ID NO: 2219 - DNA, 20 bp, Artificial Sequence
  Primer
tcccatagcaagagatacgg

SEQ ID NO: 2220 - DNA, 20 bp, Artificial Sequence
  Primer
ggagtagaccatatcttctc

SEQ ID NO: 2221 - DNA, 20 bp, Artificial Sequence
  Primer
agtcatcccactcgctgact

SEQ ID NO: 2222 - DNA, 20 bp, Artificial Sequence
  Primer
acgaggtcctgaccccaaaa

SEQ ID NO: 2223 - DNA, 20 bp, Artificial Sequence
  Primer
cgggaattgcggtcatcatt

SEQ ID NO: 2224 - DNA, 20 bp, Artificial Sequence
  Primer
gccaactcatagaggtgagt

SEQ ID NO: 2225 - DNA, 20 bp, Artificial Sequence
  Primer
cgttatcccggcgtaatgat

SEQ ID NO: 2226 - DNA, 20 bp, Artificial Sequence
  Primer
cactctagcccctttaatcg

SEQ ID NO: 2227 - DNA, 20 bp, Artificial Sequence
  Primer
ggagtagaccatatcttctc

SEQ ID NO: 2228 - DNA, 20 bp, Artificial Sequence
  Primer
ctacgagttcgttagtcaac

SEQ ID NO: 2229 - DNA, 20 bp, Artificial Sequence
  Primer
gctctcttcccctatgattc

SEQ ID NO: 2230 - DNA, 20 bp, Artificial Sequence
  Primer
ctcccatagcccttcctctc

SEQ ID NO: 2231 - DNA, 20 bp, Artificial Sequence
  Primer
ctctgaccattcatcaggga

SEQ ID NO: 2232 - DNA, 20 bp, Artificial Sequence
  Primer
ctacggctttcaatataggg

SEQ ID NO: 2233 - DNA, 20 bp, Artificial Sequence
  Primer
gcatcatgtggttccttcag

SEQ ID NO: 2234 - DNA, 20 bp, Artificial Sequence
  Primer
ttgttggacacggagtggga

SEQ ID NO: 2235 - DNA, 20 bp, Artificial Sequence
  Primer
cgtctcatggactggtcatt

SEQ ID NO: 2236 - DNA, 20 bp, Artificial Sequence
  Primer
cctccgctaattccttccaa

SEQ ID NO: 2237 - DNA, 20 bp, Artificial Sequence
  Primer
ccgaatggtgatgattggag

SEQ ID NO: 2238 - DNA, 20 bp, Artificial Sequence
  Primer
gaggcttaaataagcggctt

SEQ ID NO: 2239 - DNA, 20 bp, Artificial Sequence
  Primer
ccttttgtggcacaccatag

SEQ ID NO: 2240 - DNA, 20 bp, Artificial Sequence
  Primer
agctagctgaaacacctccg

SEQ ID NO: 2241 - DNA, 20 bp, Artificial Sequence
  Primer
cctaagccgagtagactcta

SEQ ID NO: 2242 - DNA, 20 bp, Artificial Sequence
  Primer
cgcgcaaacattcctgaaca

SEQ ID NO: 2243 - DNA, 20 bp, Artificial Sequence
  Primer
ccagctatccctctgatcaa

SEQ ID NO: 2244 - DNA, 20 bp, Artificial Sequence
  Primer
cgccacatccacagaatcta

SEQ ID NO: 2245 - DNA, 20 bp, Artificial Sequence
  Primer
ccttcatacaccatctcgac

SEQ ID NO: 2246 - DNA, 20 bp, Artificial Sequence
  Primer
ccacgcaaaaggagtcttct

SEQ ID NO: 2247 - DNA, 20 bp, Artificial Sequence
  Primer
cccctgtcttaacccaagaa

SEQ ID NO: 2248 - DNA, 20 bp, Artificial Sequence
  Primer
cctcatctagagccttcttc

SEQ ID NO: 2249 - DNA, 20 bp, Artificial Sequence
  Primer
gccatgctattatggctgtc

SEQ ID NO: 2250 - DNA, 20 bp, Artificial Sequence
  Primer
cggcagatgtgcagattgct

SEQ ID NO: 2251 - DNA, 20 bp, Artificial Sequence
  Primer
cctctctcatcgatctaacg

SEQ ID NO: 2252 - DNA, 20 bp, Artificial Sequence
  Primer
tgcgtccgtcgtttcctaat

SEQ ID NO: 2253 - DNA, 20 bp, Artificial Sequence
  Primer
ttcggaaactcggaacaggt

SEQ ID NO: 2254 - DNA, 20 bp, Artificial Sequence
  Primer
cgtgtagatggacgaaccac

SEQ ID NO: 2255 - DNA, 20 bp, Artificial Sequence
  Primer
gcgcgagaatttcttccttc

SEQ ID NO: 2256 - DNA, 20 bp, Artificial Sequence
  Primer
gcaacgctggaagattagtc

SEQ ID NO: 2257 - DNA, 20 bp, Artificial Sequence
  Primer
caagagaagttttcctccgc

SEQ ID NO: 2258 - DNA, 20 bp, Artificial Sequence
  Primer
cgtggacagcgagaatttca

SEQ ID NO: 2259 - DNA, 20 bp, Artificial Sequence
  Primer
ggatgcaggagttcctatca

SEQ ID NO: 2260 - DNA, 20 bp, Artificial Sequence
  Primer
ctgctcgaacatatctcgga

SEQ ID NO: 2261 - DNA, 20 bp, Artificial Sequence
  Primer
acacaagttctggcctcccc

SEQ ID NO: 2262 - DNA, 20 bp, Artificial Sequence
  Primer
cgccaaaaatcactccgaac

SEQ ID NO: 2263 - DNA, 20 bp, Artificial Sequence
  Primer
caccgctgtacgatcttttc

SEQ ID NO: 2264 - DNA, 20 bp, Artificial Sequence
  Primer
gtctctcgccatccataatc

SEQ ID NO: 2265 - DNA, 20 bp, Artificial Sequence
  Primer
ctcgagaagagagttcttgg

SEQ ID NO: 2266 - DNA, 20 bp, Artificial Sequence
  Primer
cgtagaattgctatcggcct

SEQ ID NO: 2267 - DNA, 20 bp, Artificial Sequence
  Primer
gggaagccccaaaaacacta

SEQ ID NO: 2268 - DNA, 20 bp, Artificial Sequence
  Primer
cagctcctctcatggcttat

SEQ ID NO: 2269 - DNA, 20 bp, Artificial Sequence
  Primer
ccttcgttcaggaaaaactg

SEQ ID NO: 2270 - DNA, 20 bp, Artificial Sequence
  Primer
cagggctttccctgaaaact

SEQ ID NO: 2271 - DNA, 20 bp, Artificial Sequence
  Primer
gcaccttcgaatacccgttt

SEQ ID NO: 2272 - DNA, 20 bp, Artificial Sequence
  Primer
ctgtgatcctgtctgcccat

SEQ ID NO: 2273 - DNA, 20 bp, Artificial Sequence
  Primer
agttttctgtacgcttagcc

SEQ ID NO: 2274 - DNA, 20 bp, Artificial Sequence
  Primer
tgactcactgctgtagcttc

SEQ ID NO: 2275 - DNA, 20 bp, Artificial Sequence
  Primer
gagcatatggacaaaggcac

SEQ ID NO: 2276 - DNA, 20 bp, Artificial Sequence
  Primer
cccgagagctagtgaaaaat

SEQ ID NO: 2277 - DNA, 20 bp, Artificial Sequence
  Primer
gtgggagctaacattctagc

SEQ ID NO: 2278 - DNA, 20 bp, Artificial Sequence
  Primer
ctggctcgacaaaagggaaa

SEQ ID NO: 2279 - DNA, 20 bp, Artificial Sequence
  Primer
gctccggccgccatggccgc

SEQ ID NO: 2280 - DNA, 20 bp, Artificial Sequence
  Primer
gctctatagggcacttcctc

SEQ ID NO: 2281 - DNA, 20 bp, Artificial Sequence
  Primer
gctgtagcttcataacgagc

SEQ ID NO: 2282 - DNA, 20 bp, Artificial Sequence
  Primer
gctactgaaccagttgctct

SEQ ID NO: 2283 - DNA, 20 bp, Artificial Sequence
  Primer
cctgcactccagcaatcaaa

SEQ ID NO: 2284 - DNA, 20 bp, Artificial Sequence
  Primer
gcagaaacgactcgccttat

SEQ ID NO: 2285 - DNA, 20 bp, Artificial Sequence
  Primer
agcaaacccttgagggtcat

SEQ ID NO: 2286 - DNA, 20 bp, Artificial Sequence
  Primer
ctgaaggcttgtctgcagga

SEQ ID NO: 2287 - DNA, 20 bp, Artificial Sequence
  Primer
cacacaggaggctctgagtt

SEQ ID NO: 2288 - DNA, 20 bp, Artificial Sequence
  Primer
ccatttccacaggttgcatc

SEQ ID NO: 2289 - DNA, 20 bp, Artificial Sequence
  Primer
cgctctggaaatagatccag

SEQ ID NO: 2290 - DNA, 20 bp, Artificial Sequence
  Primer
ccaaacctcaccactctaac

SEQ ID NO: 2291 - DNA, 20 bp, Artificial Sequence
  Primer
ctggcactactctagctaac

SEQ ID NO: 2292 - DNA, 20 bp, Artificial Sequence
  Primer
ttccccatggggatctctgt

SEQ ID NO: 2293 - DNA, 20 bp, Artificial Sequence
  Primer
gcctcttgaaaaaagatccc

SEQ ID NO: 2294 - DNA, 20 bp, Artificial Sequence
  Primer
gctcagggaaaacacgcaat

SEQ ID NO: 2295 - DNA, 20 bp, Artificial Sequence
  Primer
ccctgacttcttccattggt

SEQ ID NO: 2296 - DNA, 20 bp, Artificial Sequence
  Primer
gcctattactcagtggctgt

SEQ ID NO: 2297 - DNA, 20 bp, Artificial Sequence
  Primer
ctgagcacctcaaaagcttc

SEQ ID NO: 2298 - DNA, 20 bp, Artificial Sequence
  Primer
ggagcatagcaaggctattc

SEQ ID NO: 2299 - DNA, 20 bp, Artificial Sequence
  Primer
cggtcatcgcgatagacaat

SEQ ID NO: 2300 - DNA, 20 bp, Artificial Sequence
  Primer
tagggcaagctgttcatagc

SEQ ID NO: 2301 - DNA, 20 bp, Artificial Sequence
  Primer
aatttccgcgattcctgagg

SEQ ID NO: 2302 - DNA, 20 bp, Artificial Sequence
  Primer
ccacttcccaactgtaacag

SEQ ID NO: 2303 - DNA, 20 bp, Artificial Sequence
  Primer
cagtagactccagtgagtct

SEQ ID NO: 2304 - DNA, 20 bp, Artificial Sequence
  Primer
ccatcggaagggtatctttc

SEQ ID NO: 2305 - DNA, 20 bp, Artificial Sequence
  Primer
cctggagaaatcggatcatc

SEQ ID NO: 2306 - DNA, 20 bp, Artificial Sequence
  Primer
agacgatcccagtgtaagag

SEQ ID NO: 2307 - DNA, 20 bp, Artificial Sequence
  Primer
gagcctagaggaaatgccaa

SEQ ID NO: 2308 - DNA, 20 bp, Artificial Sequence
  Primer
gggaagatcctgactcaact

SEQ ID NO: 2309 - DNA, 20 bp, Artificial Sequence
  Primer
gagtctcgcaatatccgaga

SEQ ID NO: 2310 - DNA, 20 bp, Artificial Sequence
  Primer
cctgaggatactgcaagaca

SEQ ID NO: 2311 - DNA, 20 bp, Artificial Sequence
  Primer
gcccctgtgaacgcattcat

SEQ ID NO: 2312 - DNA, 20 bp, Artificial Sequence
  Primer
cgtctaggcccctttttttt

SEQ ID NO: 2313 - DNA, 20 bp, Artificial Sequence
  Primer
gtcggagtatgttccacttc

SEQ ID NO: 2314 - DNA, 20 bp, Artificial Sequence
  Primer
cgacaacctgttgctcgctt

SEQ ID NO: 2315 - DNA, 20 bp, Artificial Sequence
  Primer
cgcaacgcactcaaagactc

SEQ ID NO: 2316 - DNA, 20 bp, Artificial Sequence
  Primer
cacaatccataatcccccca

SEQ ID NO: 2317 - DNA, 20 bp, Artificial Sequence
  Primer
cactaacgaccccgacagtg

SEQ ID NO: 2318 - DNA, 20 bp, Artificial Sequence
  Primer
gtagcttatcagctgctgct

SEQ ID NO: 2319 - DNA, 20 bp, Artificial Sequence
  Primer
gcgtctaggccccttttttt

SEQ ID NO: 2320 - DNA, 20 bp, Artificial Sequence
  Primer
ctcttccgtatcgcagatga

SEQ ID NO: 2321 - DNA, 20 bp, Artificial Sequence
  Primer
ctcacaaggaattcctgcgt

SEQ ID NO: 2322 - DNA, 20 bp, Artificial Sequence
  Primer
ccagcgttgcaaaacaccaa

SEQ ID NO: 2323 - DNA, 20 bp, Artificial Sequence
  Primer
ctatcgatgacgatcgcaag

SEQ ID NO: 2324 - DNA, 20 bp, Artificial Sequence
  Primer
ctattacagtccccgcaaca

SEQ ID NO: 2325 - DNA, 20 bp, Artificial Sequence
  Primer
gtctcttgtcagaagaggca

SEQ ID NO: 2326 - DNA, 20 bp, Artificial Sequence
  Primer
taacgtcgtaggcaggaatc

SEQ ID NO: 2327 - DNA, 20 bp, Artificial Sequence
  Primer
cctcacgaatattcccatcc

SEQ ID NO: 2328 - DNA, 20 bp, Artificial Sequence
  Primer
cctatagctgcctgagaatg

SEQ ID NO: 2329 - DNA, 20 bp, Artificial Sequence
  Primer
gtgtccaggtcaatacttcc

SEQ ID NO: 2330 - DNA, 20 bp, Artificial Sequence
  Primer
cgtgtcattgctctatccct

SEQ ID NO: 2331 - DNA, 20 bp, Artificial Sequence
  Primer
ggactttcatgagcagcaca

SEQ ID NO: 2332 - DNA, 20 bp, Artificial Sequence
  Primer
ccgagccctactcaaaaact

SEQ ID NO: 2333 - DNA, 20 bp, Artificial Sequence
  Primer
cgcttgaggactctttacga

SEQ ID NO: 2334 - DNA, 20 bp, Artificial Sequence
  Primer
gctttctcttccagccaagt

SEQ ID NO: 2335 - DNA, 20 bp, Artificial Sequence
  Primer
cgaaggttcacacccataac

SEQ ID NO: 2336 - DNA, 20 bp, Artificial Sequence
  Primer
ggatctgctttgccatttcg

SEQ ID NO: 2337 - DNA, 20 bp, Artificial Sequence
  Primer
cctgcaatggccttaccaag

SEQ ID NO: 2338 - DNA, 20 bp, Artificial Sequence
  Primer
ctccgcatcaaacttctgac

SEQ ID NO: 2339 - DNA, 20 bp, Artificial Sequence
  Primer
catccggcacgaagaaaggc

SEQ ID NO: 2340 - DNA, 20 bp, Artificial Sequence
  Primer
cctcctcccaaactagcaat

SEQ ID NO: 2341 - DNA, 20 bp, Artificial Sequence
  Primer
gctccactaactcctagaac

SEQ ID NO: 2342 - DNA, 20 bp, Artificial Sequence
  Primer
ggatagctgctactacagac

SEQ ID NO: 2343 - DNA, 20 bp, Artificial Sequence
  Primer
gactccttgtcccattgcgt

SEQ ID NO: 2344 - DNA, 20 bp, Artificial Sequence
  Primer
aagacattcccagtgaaccc

SEQ ID NO: 2345 - DNA, 20 bp, Artificial Sequence
  Primer
tccctggtactccatttgtc

SEQ ID NO: 2346 - DNA, 20 bp, Artificial Sequence
  Primer
ccccatacttcccctaacaa

SEQ ID NO: 2347 - DNA, 20 bp, Artificial Sequence
  Primer
ctccgaacaaagctgttcca

SEQ ID NO: 2348 - DNA, 20 bp, Artificial Sequence
  Primer
ctcattcgcttggctaagca

SEQ ID NO: 2349 - DNA, 20 bp, Artificial Sequence
  Primer
cttctctatcccctggaaat

SEQ ID NO: 2350 - DNA, 20 bp, Artificial Sequence
  Primer
gtgatctcatttgcccccgt

SEQ ID NO: 2351 - DNA, 20 bp, Artificial Sequence
  Primer
ctctgatgcgagatcaactc

SEQ ID NO: 2352 - DNA, 20 bp, Artificial Sequence
  Primer
cgatagccctctatcttgtg

SEQ ID NO: 2353 - DNA, 20 bp, Artificial Sequence
  Primer
ggggaacgcgaatatcaaag

SEQ ID NO: 2354 - DNA, 20 bp, Artificial Sequence
  Primer
ttcccgcactctgacatctc

SEQ ID NO: 2355 - DNA, 20 bp, Artificial Sequence
  Primer
cgaacaaaacgaagatcccc

SEQ ID NO: 2356 - DNA, 20 bp, Artificial Sequence
  Primer
gtactagggatacaacagcg

SEQ ID NO: 2357 - DNA, 20 bp, Artificial Sequence
  Primer
tctgcaggcttgtccgaaga

SEQ ID NO: 2358 - DNA, 20 bp, Artificial Sequence
  Primer
gctgcgtcatcaagcattct

SEQ ID NO: 2359 - DNA, 20 bp, Artificial Sequence
  Primer
cgcccagaccaaaaaatagc

SEQ ID NO: 2360 - DNA, 20 bp, Artificial Sequence
  Primer
ggcgtttcaagatgacaagc

SEQ ID NO: 2361 - DNA, 20 bp, Artificial Sequence
  Primer
ggagcgatgattattgcagc

SEQ ID NO: 2362 - DNA, 20 bp, Artificial Sequence
  Primer
tcttctttatcggccgcagc

SEQ ID NO: 2363 - DNA, 20 bp, Artificial Sequence
  Primer
ggaatggtggatgcttgagc

SEQ ID NO: 2364 - DNA, 20 bp, Artificial Sequence
  Primer
gctctcttaacagcttgagc

SEQ ID NO: 2365 - DNA, 20 bp, Artificial Sequence
  Primer
ccgcactctgacatctcttt

SEQ ID NO: 2366 - DNA, 20 bp, Artificial Sequence
  Primer
cttacgtctagcgtcttcac

SEQ ID NO: 2367 - DNA, 20 bp, Artificial Sequence
  Primer
ctcttcgtatcggagaagtc

SEQ ID NO: 2368 - DNA, 20 bp, Artificial Sequence
  Primer
gcattgaccttgcttcttcc

SEQ ID NO: 2369 - DNA, 20 bp, Artificial Sequence
  Primer
cacaggctttctagccaatg

SEQ ID NO: 2370 - DNA, 20 bp, Artificial Sequence
  Primer
gcagctaagacagctttacc

SEQ ID NO: 2371 - DNA, 20 bp, Artificial Sequence
  Primer
ctaacaggcgttgtaatgcc

SEQ ID NO: 2372 - DNA, 20 bp, Artificial Sequence
  Primer
cgaacctccgatgcgcggta

SEQ ID NO: 2373 - DNA, 20 bp, Artificial Sequence
  Primer
cgaaacgcttccttctgtgt

SEQ ID NO: 2374 - DNA, 20 bp, Artificial Sequence
  Primer
ccgttagtaagagctacagg

SEQ ID NO: 2375 - DNA, 20 bp, Artificial Sequence
  Primer
ctcgcgcatctacaacgata

SEQ ID NO: 2376 - DNA, 20 bp, Artificial Sequence
  Primer
ctcgtgactgctcactttct

SEQ ID NO: 2377 - DNA, 20 bp, Artificial Sequence
  Primer
cacagccagagttattcgag

SEQ ID NO: 2378 - DNA, 20 bp, Artificial Sequence
  Primer
gcacaaagcaccgaactctt

SEQ ID NO: 2379 - DNA, 20 bp, Artificial Sequence
  Primer
gacctttgtccctactggaa

SEQ ID NO: 2380 - DNA, 20 bp, Artificial Sequence
  Primer
ctgcttcttgttgacactgc

SEQ ID NO: 2381 - DNA, 20 bp, Artificial Sequence
  Primer
gcgtagtgcttgtgttatcg

SEQ ID NO: 2382 - DNA, 20 bp, Artificial Sequence
  Primer
gcagcgcccactccagcagc

SEQ ID NO: 2383 - DNA, 20 bp, Artificial Sequence
  Primer
ccctctttcctcattcgtag

SEQ ID NO: 2384 - DNA, 20 bp, Artificial Sequence
  Primer
ccggaaagacgaacatactc

SEQ ID NO: 2385 - DNA, 20 bp, Artificial Sequence
  Primer
gcagctgcattagctattgg

SEQ ID NO: 2386 - DNA, 20 bp, Artificial Sequence
  Primer
ccgtatcacgtcagcttcta

SEQ ID NO: 2387 - DNA, 20 bp, Artificial Sequence
  Primer
gtccttacagataactgccc

SEQ ID NO: 2388 - DNA, 20 bp, Artificial Sequence
  Primer
cagcagcatccccatcaaat

SEQ ID NO: 2389 - DNA, 20 bp, Artificial Sequence
  Primer
ggtggacttaactactcaac

SEQ ID NO: 2390 - DNA, 20 bp, Artificial Sequence
  Primer
gtagtggcctctagttgggt

SEQ ID NO: 2391 - DNA, 20 bp, Artificial Sequence
  Primer
ccaccccagcacttttagca

SEQ ID NO: 2392 - DNA, 20 bp, Artificial Sequence
  Primer
ctccaatcctcttgttgctc

SEQ ID NO: 2393 - DNA, 20 bp, Artificial Sequence
  Primer
gctccacaaaacaaggagaa

SEQ ID NO: 2394 - DNA, 20 bp, Artificial Sequence
  Primer
cactcttagacaggacagtg

SEQ ID NO: 2395 - DNA, 20 bp, Artificial Sequence
  Primer
ccttctttgaacctccgaga

SEQ ID NO: 2396 - DNA, 20 bp, Artificial Sequence
  Primer
gcactgtcagcatgtagaaa

SEQ ID NO: 2397 - DNA, 20 bp, Artificial Sequence
  Primer
cctcttctttgctcccagaa

SEQ ID NO: 2398 - DNA, 20 bp, Artificial Sequence
  Primer
tcctccttatgaagagctgc

SEQ ID NO: 2399 - DNA, 20 bp, Artificial Sequence
  Primer
gaatgcatcccgtcgccctg

SEQ ID NO: 2400 - DNA, 20 bp, Artificial Sequence
  Primer
ccgtttcgcgattcaacact

SEQ ID NO: 2401 - DNA, 20 bp, Artificial Sequence
  Primer
ccttctgtttacagatggga

SEQ ID NO: 2402 - DNA, 20 bp, Artificial Sequence
  Primer
ggcatcattcctggatgctt

SEQ ID NO: 2403 - DNA, 20 bp, Artificial Sequence
  Primer
gaaactacttggcgctcgtt

SEQ ID NO: 2404 - DNA, 20 bp, Artificial Sequence
  Primer
gatcttttaggtgagatcct

SEQ ID NO: 2405 - DNA, 20 bp, Artificial Sequence
  Primer
ctggagacgagggtaaaagt

SEQ ID NO: 2406 - DNA, 20 bp, Artificial Sequence
  Primer
atgtacgcccaaatcttccg

SEQ ID NO: 2407 - DNA, 20 bp, Artificial Sequence
  Primer
gcgagaaaagctgctctaag

SEQ ID NO: 2408 - DNA, 20 bp, Artificial Sequence
  Primer
tgcggagccgattcaaaagc

SEQ ID NO: 2409 - DNA, 20 bp, Artificial Sequence
  Primer
gaccagcaagattccgaaga

SEQ ID NO: 2410 - DNA, 20 bp, Artificial Sequence
  Primer
gagcaacttctagcaatccg

SEQ ID NO: 2411 - DNA, 20 bp, Artificial Sequence
  Primer
cgctccatacacagaattgc

SEQ ID NO: 2412 - DNA, 20 bp, Artificial Sequence
  Primer
gcgcaacatattctcgcctt

SEQ ID NO: 2413 - DNA, 20 bp, Artificial Sequence
  Primer
gggggacaacaataccaaac

SEQ ID NO: 2414 - DNA, 20 bp, Artificial Sequence
  Primer
tctaccagagtttcatcccc

SEQ ID NO: 2415 - DNA, 20 bp, Artificial Sequence
  Primer
caaagcagcttttcgaacac

SEQ ID NO: 2416 - DNA, 20 bp, Artificial Sequence
  Primer
caaccgtcctttggctcaaa

SEQ ID NO: 2417 - DNA, 20 bp, Artificial Sequence
  Primer
cgccagtcacttaaacgctt

SEQ ID NO: 2418 - DNA, 20 bp, Artificial Sequence
  Primer
ggcctcatgtggcatttttg

SEQ ID NO: 2419 - DNA, 20 bp, Artificial Sequence
  Primer
gctgatccatgtactcacga

SEQ ID NO: 2420 - DNA, 20 bp, Artificial Sequence
  Primer
tccgttcacacgactaatcc

SEQ ID NO: 2421 - DNA, 20 bp, Artificial Sequence
  Primer
cgcctctatgcagaagtcat

SEQ ID NO: 2422 - DNA, 20 bp, Artificial Sequence
  Primer
taacagcgaggaagagccta

SEQ ID NO: 2423 - DNA, 20 bp, Artificial Sequence
  Primer
gcttctacgtctactcctac

SEQ ID NO: 2424 - DNA, 20 bp, Artificial Sequence
  Primer
gatgcgggcatcataattcc

SEQ ID NO: 2425 - DNA, 20 bp, Artificial Sequence
  Primer
caaaggagcaaaagacccct

SEQ ID NO: 2426 - DNA, 20 bp, Artificial Sequence
  Primer
gggacctctaaaggagtctc

SEQ ID NO: 2427 - DNA, 20 bp, Artificial Sequence
  Primer
ataagagcttctggagcgcc

SEQ ID NO: 2428 - DNA, 20 bp, Artificial Sequence
  Primer
gtctacgccaaaaccctatc

SEQ ID NO: 2429 - DNA, 20 bp, Artificial Sequence
  Primer
ccggttgatacagggacttt

SEQ ID NO: 2430 - DNA, 20 bp, Artificial Sequence
  Primer
gctcccggtgtgtttcttat

SEQ ID NO: 2431 - DNA, 20 bp, Artificial Sequence
  Primer
catctctgcgcaaagcttca

SEQ ID NO: 2432 - DNA, 20 bp, Artificial Sequence
  Primer
cctacgtccggctcatatta

SEQ ID NO: 2433 - DNA, 20 bp, Artificial Sequence
  Primer
ccgctgattacgctatccaa

SEQ ID NO: 2434 - DNA, 20 bp, Artificial Sequence
  Primer
gcctttaacctctgcaagaa

SEQ ID NO: 2435 - DNA, 20 bp, Artificial Sequence
  Primer
ctaaggcacatgggcataga

SEQ ID NO: 2436 - DNA, 20 bp, Artificial Sequence
  Primer
gcggctacaactgcataagt

SEQ ID NO: 2437 - DNA, 20 bp, Artificial Sequence
  Primer
ggcgatcctcttgatatctg

SEQ ID NO: 2438 - DNA, 20 bp, Artificial Sequence
  Primer
gccagagcaagattaggact

SEQ ID NO: 2439 - DNA, 20 bp, Artificial Sequence
  Primer
gtacttctatccggagtacc

SEQ ID NO: 2440 - DNA, 20 bp, Artificial Sequence
  Primer
gctcccatctgctctaatgc

SEQ ID NO: 2441 - DNA, 20 bp, Artificial Sequence
  Primer
ctggcctgagaataaccgat

SEQ ID NO: 2442 - DNA, 20 bp, Artificial Sequence
  Primer
catggtttggggaagggaag

SEQ ID NO: 2443 - DNA, 20 bp, Artificial Sequence
  Primer
ccaaacggctttgttcctgg

SEQ ID NO: 2444 - DNA, 20 bp, Artificial Sequence
  Primer
attcctcgttcctgcgcttc

SEQ ID NO: 2445 - DNA, 20 bp, Artificial Sequence
  Primer
gctcccatctgctctaatgc

SEQ ID NO: 2446 - DNA, 20 bp, Artificial Sequence
  Primer
ctaatgagagcagtgtgcgt

SEQ ID NO: 2447 - DNA, 20 bp, Artificial Sequence
  Primer
caaggaggagttcatccaca

SEQ ID NO: 2448 - DNA, 20 bp, Artificial Sequence
  Primer
cgggagaatttgtggtatcc

SEQ ID NO: 2449 - DNA, 20 bp, Artificial Sequence
  Primer
cctcgtctaaaagcccttct

SEQ ID NO: 2450 - DNA, 20 bp, Artificial Sequence
  Primer
aacggctctctcacagatga

SEQ ID NO: 2451 - DNA, 20 bp, Artificial Sequence
  Primer
ccattccctgatacacctgc

SEQ ID NO: 2452 - DNA, 20 bp, Artificial Sequence
  Primer
gcagtacgaacagcacgtaa

SEQ ID NO: 2453 - DNA, 20 bp, Artificial Sequence
  Primer
caatcttgggcaagagactc

SEQ ID NO: 2454 - DNA, 20 bp, Artificial Sequence
  Primer
tctctaccactttcccctcg

SEQ ID NO: 2455 - DNA, 20 bp, Artificial Sequence
  Primer
cccacgacgctcatgcagac

SEQ ID NO: 2456 - DNA, 20 bp, Artificial Sequence
  Primer
ggtaaggaatggtaactccc

SEQ ID NO: 2457 - DNA, 20 bp, Artificial Sequence
  Primer
tcctctcccgcactgtacac

SEQ ID NO: 2458 - DNA, 20 bp, Artificial Sequence
  Primer
ctgagcttctggaagataag

SEQ ID NO: 2459 - DNA, 20 bp, Artificial Sequence
  Primer
gaagctctcgatctccttca

SEQ ID NO: 2460 - DNA, 20 bp, Artificial Sequence
  Primer
gcaacatagggctcattttc

SEQ ID NO: 2461 - DNA, 20 bp, Artificial Sequence
  Primer
caagcttttcatcatgagcc

SEQ ID NO: 2462 - DNA, 20 bp, Artificial Sequence
  Primer
cgacaggatttctaacgacc

SEQ ID NO: 2463 - DNA, 20 bp, Artificial Sequence
  Primer
ggtaaggaatggtaactccc

SEQ ID NO: 2464 - DNA, 20 bp, Artificial Sequence
  Primer
ccgagaatcacaattgcctg

SEQ ID NO: 2465 - DNA, 20 bp, Artificial Sequence
  Primer
cattgcaatgacatacccgc

SEQ ID NO: 2466 - DNA, 20 bp, Artificial Sequence
  Primer
tggatactcctggagacgac

SEQ ID NO: 2467 - DNA, 20 bp, Artificial Sequence
  Primer
gtactacacgacaaagctcg

SEQ ID NO: 2468 - DNA, 20 bp, Artificial Sequence
  Primer
cagctgtagggatatatgct

SEQ ID NO: 2469 - DNA, 20 bp, Artificial Sequence
  Primer
ccgagaatcacaattgcctg

SEQ ID NO: 2470 - DNA, 20 bp, Artificial Sequence
  Primer
cgccatatgcccaaggataa

SEQ ID NO: 2471 - DNA, 20 bp, Artificial Sequence
  Primer
cgcactccaggattctgcat

SEQ ID NO: 2472 - DNA, 20 bp, Artificial Sequence
  Primer
ctttcctctactagcagtct

SEQ ID NO: 2473 - DNA, 20 bp, Artificial Sequence
  Primer
ccgccaacacagatgcaaaa

SEQ ID NO: 2474 - DNA, 20 bp, Artificial Sequence
  Primer
gcagaactatctcgcgatca

SEQ ID NO: 2475 - DNA, 20 bp, Artificial Sequence
  Primer
caccgattgtaggctcaatg

SEQ ID NO: 2476 - DNA, 20 bp, Artificial Sequence
  Primer
ccaagtctcggcttcaatgt

SEQ ID NO: 2477 - DNA, 20 bp, Artificial Sequence
  Primer
cgactgtcaatagcaactcc

SEQ ID NO: 2478 - DNA, 20 bp, Artificial Sequence
  Primer
cccctctaaaatccctactg

SEQ ID NO: 2479 - DNA, 20 bp, Artificial Sequence
  Primer
gccctcgcctctcaaaaaga

SEQ ID NO: 2480 - DNA, 20 bp, Artificial Sequence
  Primer
ctatcgccagaagcgactct

SEQ ID NO: 2481 - DNA, 20 bp, Artificial Sequence
  Primer
gtctttttccttttctgccc

SEQ ID NO: 2482 - DNA, 20 bp, Artificial Sequence
  Primer
ccataacacgcttaacccgt

SEQ ID NO: 2483 - DNA, 20 bp, Artificial Sequence
  Primer
gcacctttgaatgctgtgct

SEQ ID NO: 2484 - DNA, 20 bp, Artificial Sequence
  Primer
ggataccgaaggaatcttcc

SEQ ID NO: 2485 - DNA, 20 bp, Artificial Sequence
  Primer
tcctctggtagtgaatagcg

SEQ ID NO: 2486 - DNA, 20 bp, Artificial Sequence
  Primer
gcacacgcttatctaaagcc

SEQ ID NO: 2487 - DNA, 20 bp, Artificial Sequence
  Primer
gcgtatcgaccttcacaact

SEQ ID NO: 2488 - DNA, 20 bp, Artificial Sequence
  Primer
gggatggaatatcctctgct

SEQ ID NO: 2489 - DNA, 20 bp, Artificial Sequence
  Primer
cgaaacaaacgctttccctc

SEQ ID NO: 2490 - DNA, 20 bp, Artificial Sequence
  Primer
ctggcctgcattctatctca

SEQ ID NO: 2491 - DNA, 20 bp, Artificial Sequence
  Primer
ggcatccaccaatagctctt

SEQ ID NO: 2492 - DNA, 20 bp, Artificial Sequence
  Primer
caagggcaacgacatctcaa

SEQ ID NO: 2493 - DNA, 20 bp, Artificial Sequence
  Primer
ctaagtgctggcaactaacg

SEQ ID NO: 2494 - DNA, 20 bp, Artificial Sequence
  Primer
ctgaggaagaaggacaaaga

SEQ ID NO: 2495 - DNA, 20 bp, Artificial Sequence
  Primer
ttctggagtatggcggatac

SEQ ID NO: 2496 - DNA, 20 bp, Artificial Sequence
  Primer
ctgaggaagaaggacaaaga

SEQ ID NO: 2497 - DNA, 20 bp, Artificial Sequence
  Primer
caccgtgcatgaaaaggatg

SEQ ID NO: 2498 - DNA, 20 bp, Artificial Sequence
  Primer
ctccagaagctatttcctgg

SEQ ID NO: 2499 - DNA, 20 bp, Artificial Sequence
  Primer
gcctgtatcccaaacactca

SEQ ID NO: 2500 - DNA, 20 bp, Artificial Sequence
  Primer
gtcaaatcaagcagacaggg

SEQ ID NO: 2501 - DNA, 20 bp, Artificial Sequence
  Primer
gcccaaggacgtattgacat

SEQ ID NO: 2502 - DNA, 20 bp, Artificial Sequence
  Primer
cctagcccttttctccttcg

SEQ ID NO: 2503 - DNA, 20 bp, Artificial Sequence
  Primer
tttgctctagcacggattcg

SEQ ID NO: 2504 - DNA, 20 bp, Artificial Sequence
  Primer
ggctagcaaactagcaactg

SEQ ID NO: 2505 - DNA, 20 bp, Artificial Sequence
  Primer
gacgctattagggccttctt

SEQ ID NO: 2506 - DNA, 20 bp, Artificial Sequence
  Primer
gcgtatgctttctcactagc

SEQ ID NO: 2507 - DNA, 20 bp, Artificial Sequence
  Primer
ggatacccaatgggaagttc

SEQ ID NO: 2508 - DNA, 20 bp, Artificial Sequence
  Primer
caaggttcagcgctttctat

SEQ ID NO: 2509 - DNA, 20 bp, Artificial Sequence
  Primer
gaggctcctgaagaaaaagc

SEQ ID NO: 2510 - DNA, 20 bp, Artificial Sequence
  Primer
agaagcctgttcgcgctaca

SEQ ID NO: 2511 - DNA, 20 bp, Artificial Sequence
  Primer
gttctctgacctgctgacat

SEQ ID NO: 2512 - DNA, 20 bp, Artificial Sequence
  Primer
ccgtggatatggaagtgttt

SEQ ID NO: 2513 - DNA, 20 bp, Artificial Sequence
  Primer
ccatgaacagcttccagaga

SEQ ID NO: 2514 - DNA, 20 bp, Artificial Sequence
  Primer
gtctcgttgaaattccaggg

SEQ ID NO: 2515 - DNA, 20 bp, Artificial Sequence
  Primer
cctctttccccttctcattg

SEQ ID NO: 2516 - DNA, 20 bp, Artificial Sequence
  Primer
gtaagcaatgcaaagtccgc

SEQ ID NO: 2517 - DNA, 20 bp, Artificial Sequence
  Primer
cacctcttatcccatcccaa

SEQ ID NO: 2518 - DNA, 20 bp, Artificial Sequence
  Primer
agagcgtcggattgtggttc

SEQ ID NO: 2519 - DNA, 20 bp, Artificial Sequence
  Primer
cgccattactagcaattccg

SEQ ID NO: 2520 - DNA, 20 bp, Artificial Sequence
  Primer
ccctcatatgctaactcctg

SEQ ID NO: 2521 - DNA, 20 bp, Artificial Sequence
  Primer
gtttcaccatggcgaacgta

SEQ ID NO: 2522 - DNA, 20 bp, Artificial Sequence
  Primer
ccaggttctatggatcctga

SEQ ID NO: 2523 - DNA, 20 bp, Artificial Sequence
  Primer
gaaaagcagcagcttttggc

SEQ ID NO: 2524 - DNA, 20 bp, Artificial Sequence
  Primer
cacctcttggattacacacc

SEQ ID NO: 2525 - DNA, 20 bp, Artificial Sequence
  Primer
cccatttgtactagcaggag

SEQ ID NO: 2526 - DNA, 20 bp, Artificial Sequence
  Primer
cgggatgcaaggaaatgtga

SEQ ID NO: 2527 - DNA, 20 bp, Artificial Sequence
  Primer
cgcaatgtggatatcgaagc

SEQ ID NO: 2528 - DNA, 20 bp, Artificial Sequence
  Primer
cactaggaggaacatctgga

SEQ ID NO: 2529 - DNA, 20 bp, Artificial Sequence
  Primer
cctcgacaactttcctccaa

SEQ ID NO: 2530 - DNA, 20 bp, Artificial Sequence
  Primer
gaagtaaactgtagccctcg

SEQ ID NO: 2531 - DNA, 20 bp, Artificial Sequence
  Primer
gggcctttgaaaacgggata

SEQ ID NO: 2532 - DNA, 20 bp, Artificial Sequence
  Primer
ccaagttagtatccctccca

SEQ ID NO: 2533 - DNA, 20 bp, Artificial Sequence
  Primer
gctatcactatggtccgttg

SEQ ID NO: 2534 - DNA, 20 bp, Artificial Sequence
  Primer
gagaactacagggtgtttgc

SEQ ID NO: 2535 - DNA, 20 bp, Artificial Sequence
  Primer
gggaggtaagagagtgacta

SEQ ID NO: 2536 - DNA, 20 bp, Artificial Sequence
  Primer
caatgcagaagctcgatctc

SEQ ID NO: 2537 - DNA, 20 bp, Artificial Sequence
  Primer
gcaagaggatggatctctct

SEQ ID NO: 2538 - DNA, 20 bp, Artificial Sequence
  Primer
gcaaagagtctgaaagcgca

SEQ ID NO: 2539 - DNA, 20 bp, Artificial Sequence
  Primer
ctgagccatagccaaagcaa

SEQ ID NO: 2540 - DNA, 20 bp, Artificial Sequence
  Primer
atcaacactccgcaagcaac

SEQ ID NO: 2541 - DNA, 20 bp, Artificial Sequence
  Primer
caatccctctctatcctctc

SEQ ID NO: 2542 - DNA, 20 bp, Artificial Sequence
  Primer
cgcgccgatgagattttagt

SEQ ID NO: 2543 - DNA, 20 bp, Artificial Sequence
  Primer
catcatttgctcgcctctct

SEQ ID NO: 2544 - DNA, 20 bp, Artificial Sequence
  Primer
cggcaaggattaagtctcct

SEQ ID NO: 2545 - DNA, 20 bp, Artificial Sequence
  Primer
cgcgaactgcccgtggcaat

SEQ ID NO: 2546 - DNA, 20 bp, Artificial Sequence
  Primer
aacaaacggtacgagcccca

SEQ ID NO: 2547 - DNA, 20 bp, Artificial Sequence
  Primer
cttagcgacaggacatcctt

SEQ ID NO: 2548 - DNA, 20 bp, Artificial Sequence
  Primer
agaaccgattccttgatgcc

SEQ ID NO: 2549 - DNA, 20 bp, Artificial Sequence
  Primer
gctccacaatcacaacgaca

SEQ ID NO: 2550 - DNA, 20 bp, Artificial Sequence
  Primer
agaggagcggcacgatggca

SEQ ID NO: 2551 - DNA, 20 bp, Artificial Sequence
  Primer
ccgcccgagctaattctcct

SEQ ID NO: 2552 - DNA, 20 bp, Artificial Sequence
  Primer
ttatcctcatcccctcaagc

SEQ ID NO: 2553 - DNA, 20 bp, Artificial Sequence
  Primer
gcaacggctttgcgcataaa

SEQ ID NO: 2554 - DNA, 20 bp, Artificial Sequence
  Primer
gtccagaatcgcctctgttt

SEQ ID NO: 2555 - DNA, 20 bp, Artificial Sequence
  Primer
tcagaatacgagcacttcgg

SEQ ID NO: 2556 - DNA, 20 bp, Artificial Sequence
  Primer
ctttcttctctcccttggct

SEQ ID NO: 2557 - DNA, 20 bp, Artificial Sequence
  Primer
gcgcctgataaaaaacgcga

SEQ ID NO: 2558 - DNA, 20 bp, Artificial Sequence
  Primer
gcggttgatgattttggacg

SEQ ID NO: 2559 - DNA, 20 bp, Artificial Sequence
  Primer
cctgttcaggatgcgaagat

SEQ ID NO: 2560 - DNA, 20 bp, Artificial Sequence
  Primer
cgccaggataacaaaagagc

SEQ ID NO: 2561 - DNA, 20 bp, Artificial Sequence
  Primer
gggcttgggttctctattct

SEQ ID NO: 2562 - DNA, 20 bp, Artificial Sequence
  Primer
gccagtccttttgtctttcg

SEQ ID NO: 2563 - DNA, 20 bp, Artificial Sequence
  Primer
gagacgttgcaggctgatta

SEQ ID NO: 2564 - DNA, 20 bp, Artificial Sequence
  Primer
gtacggagaactccaaggaa

SEQ ID NO: 2565 - DNA, 20 bp, Artificial Sequence
  Primer
cgcggctttttcgaaagcaa

SEQ ID NO: 2566 - DNA, 20 bp, Artificial Sequence
  Primer
gttcgggcatctctcccttc

SEQ ID NO: 2567 - DNA, 20 bp, Artificial Sequence
  Primer
gccagtccttttgtctttcg

SEQ ID NO: 2568 - DNA, 20 bp, Artificial Sequence
  Primer
gtggacgaacagtctctact

SEQ ID NO: 2569 - DNA, 20 bp, Artificial Sequence
  Primer
tccgaaatggtgaaagaggc

SEQ ID NO: 2570 - DNA, 20 bp, Artificial Sequence
  Primer
gcctatcctcgattgtcttg

SEQ ID NO: 2571 - DNA, 20 bp, Artificial Sequence
  Primer
tctctgcattagcaaccgcc

SEQ ID NO: 2572 - DNA, 20 bp, Artificial Sequence
  Primer
cttatgccgtctctcccata

SEQ ID NO: 2573 - DNA, 20 bp, Artificial Sequence
  Primer
cagaagagtggggagctctc

SEQ ID NO: 2574 - DNA, 20 bp, Artificial Sequence
  Primer
gcatttctttctctcccctc

SEQ ID NO: 2575 - DNA, 20 bp, Artificial Sequence
  Primer
gcctatcctcgattgtcttg

SEQ ID NO: 2576 - DNA, 20 bp, Artificial Sequence
  Primer
caggagcacatcgcgaaaat

SEQ ID NO: 2577 - DNA, 20 bp, Artificial Sequence
  Primer
ctcccatgagcttctttctc

SEQ ID NO: 2578 - DNA, 20 bp, Artificial Sequence
  Primer
cgaatgctttgctcctctca

SEQ ID NO: 2579 - DNA, 20 bp, Artificial Sequence
  Primer
cctagaacgtgctgggaata

SEQ ID NO: 2580 - DNA, 20 bp, Artificial Sequence
  Primer
gtctatcgcgttctctacga

SEQ ID NO: 2581 - DNA, 20 bp, Artificial Sequence
  Primer
gctctatcctgtttcctctg

SEQ ID NO: 2582 - DNA, 20 bp, Artificial Sequence
  Primer
gactatcgccatgcttcttg

SEQ ID NO: 2583 - DNA, 20 bp, Artificial Sequence
  Primer
gcgcaaaagagaacatgctc

SEQ ID NO: 2584 - DNA, 20 bp, Artificial Sequence
  Primer
ccggacgacagcttcaaaaa

SEQ ID NO: 2585 - DNA, 20 bp, Artificial Sequence
  Primer
gatcgaacagttgtctgtgc

SEQ ID NO: 2586 - DNA, 20 bp, Artificial Sequence
  Primer
cgcaaactctctacgaactc

SEQ ID NO: 2587 - DNA, 20 bp, Artificial Sequence
  Primer
tgtactatccgcactgtccg

SEQ ID NO: 2588 - DNA, 20 bp, Artificial Sequence
  Primer
ctggaatcggatggtttctc

SEQ ID NO: 2589 - DNA, 20 bp, Artificial Sequence
  Primer
tcctgatcgttcgctgagcg

SEQ ID NO: 2590 - DNA, 20 bp, Artificial Sequence
  Primer
tcctgctggttcatttgtcg

SEQ ID NO: 2591 - DNA, 20 bp, Artificial Sequence
  Primer
ctccggaggattccaattct

SEQ ID NO: 2592 - DNA, 20 bp, Artificial Sequence
  Primer
cttcgcttcgaccatagcat

SEQ ID NO: 2593 - DNA, 20 bp, Artificial Sequence
  Primer
gctgatgcatagctcgcatt

SEQ ID NO: 2594 - DNA, 20 bp, Artificial Sequence
  Primer
gccccttgcttttttcatcc

SEQ ID NO: 2595 - DNA, 20 bp, Artificial Sequence
  Primer
ctcatccacttcatcaggca

SEQ ID NO: 2596 - DNA, 20 bp, Artificial Sequence
  Primer
gcgacatcactaggagaaga

SEQ ID NO: 2597 - DNA, 20 bp, Artificial Sequence
  Primer
cgtagtgataggtgtaggtg

SEQ ID NO: 2598 - DNA, 20 bp, Artificial Sequence
  Primer
accgcatgagtctgtgcatc

SEQ ID NO: 2599 - DNA, 20 bp, Artificial Sequence
  Primer
cgtgaatagtgagtccgcat

SEQ ID NO: 2600 - DNA, 20 bp, Artificial Sequence
  Primer
ctcgtcatagacaaacccag

SEQ ID NO: 2601 - DNA, 20 bp, Artificial Sequence
  Primer
cggttctgcaaactcaggat

SEQ ID NO: 2602 - DNA, 20 bp, Artificial Sequence
  Primer
gcactaaaagactggagcgt

SEQ ID NO: 2603 - DNA, 20 bp, Artificial Sequence
  Primer
cctggcatgaggaaatcgaa

SEQ ID NO: 2604 - DNA, 20 bp, Artificial Sequence
  Primer
gacgctctcttcttcctcta

SEQ ID NO: 2605 - DNA, 20 bp, Artificial Sequence
  Primer
ctcgccgcgcttttttcaat

SEQ ID NO: 2606 - DNA, 20 bp, Artificial Sequence
  Primer
gttgctcgtgatcgattgac

SEQ ID NO: 2607 - DNA, 20 bp, Artificial Sequence
  Primer
ccttagagtaggtaactacc

SEQ ID NO: 2608 - DNA, 20 bp, Artificial Sequence
  Primer
cattcaactgcaagctgctg

SEQ ID NO: 2609 - DNA, 20 bp, Artificial Sequence
  Primer
gggtattctgtgtcttcacg

SEQ ID NO: 2610 - DNA, 20 bp, Artificial Sequence
  Primer
cggagccagctaacgcgatt

SEQ ID NO: 2611 - DNA, 20 bp, Artificial Sequence
  Primer
gaggctaccctccaaaagat

SEQ ID NO: 2612 - DNA, 20 bp, Artificial Sequence
  Primer
gtcggttactaggggaacta

SEQ ID NO: 2613 - DNA, 20 bp, Artificial Sequence
  Primer
acggcttttgcaagcagcag

SEQ ID NO: 2614 - DNA, 20 bp, Artificial Sequence
  Primer
ccgcaggtcattaatggcaa

SEQ ID NO: 2615 - DNA, 20 bp, Artificial Sequence
  Primer
cctcgagtggatttttacgc

SEQ ID NO: 2616 - DNA, 20 bp, Artificial Sequence
  Primer
ccagcccaaaatgccaactt

SEQ ID NO: 2617 - DNA, 20 bp, Artificial Sequence
  Primer
ccgcttatgtagacgctctt

SEQ ID NO: 2618 - DNA, 20 bp, Artificial Sequence
  Primer
ggatctttttgcccaacgga

SEQ ID NO: 2619 - DNA, 20 bp, Artificial Sequence
  Primer
ccctgtaccttctgtagaag

SEQ ID NO: 2620 - DNA, 20 bp, Artificial Sequence
  Primer
caatgatccgcatgagcatc

SEQ ID NO: 2621 - DNA, 20 bp, Artificial Sequence
  Primer
catcgatgttgcctatacgc

SEQ ID NO: 2622 - DNA, 20 bp, Artificial Sequence
  Primer
ctaattccgctacgcgatct

SEQ ID NO: 2623 - DNA, 20 bp, Artificial Sequence
  Primer
cgcagtcctacttcagaacg

SEQ ID NO: 2624 - DNA, 20 bp, Artificial Sequence
  Primer
aaatcccgaagctgttccgt

SEQ ID NO: 2625 - DNA, 20 bp, Artificial Sequence
  Primer
gcaagcatcgcagagaactt

SEQ ID NO: 2626 - DNA, 20 bp, Artificial Sequence
  Primer
aaaggcgcctatacaacaag

SEQ ID NO: 2627 - DNA, 20 bp, Artificial Sequence
  Primer
taaccgcgccaacctttcca

SEQ ID NO: 2628 - DNA, 20 bp, Artificial Sequence
  Primer
tgcgaccgcccactctttta

SEQ ID NO: 2629 - DNA, 20 bp, Artificial Sequence
  Primer
gaacctacccactcacaatc

SEQ ID NO: 2630 - DNA, 20 bp, Artificial Sequence
  Primer
gcggctgatttgctcttctt

SEQ ID NO: 2631 - DNA, 20 bp, Artificial Sequence
  Primer
cagcataactttgacaacgg

SEQ ID NO: 2632 - DNA, 20 bp, Artificial Sequence
  Primer
ctcaatactacgcagttagg

SEQ ID NO: 2633 - DNA, 20 bp, Artificial Sequence
  Primer
ggaaagtggaagcgatggta

SEQ ID NO: 2634 - DNA, 20 bp, Artificial Sequence
  Primer
catctcctgattccgaggga

SEQ ID NO: 2635 - DNA, 20 bp, Artificial Sequence
  Primer
cggaccggatgctatttcta

SEQ ID NO: 2636 - DNA, 20 bp, Artificial Sequence
  Primer
gcctcgtgactacgcggaga

SEQ ID NO: 2637 - DNA, 20 bp, Artificial Sequence
  Primer
gattcgctccctaaacatcg

SEQ ID NO: 2638 - DNA, 20 bp, Artificial Sequence
  Primer
ctgtagggaaacgagaatct

SEQ ID NO: 2639 - DNA, 20 bp, Artificial Sequence
  Primer
ccgaagtcactgagaatgtc

SEQ ID NO: 2640 - DNA, 20 bp, Artificial Sequence
  Primer
gctccacaaaagttgatccc

SEQ ID NO: 2641 - DNA, 20 bp, Artificial Sequence
  Primer
cctgattccgagggaatcat

SEQ ID NO: 2642 - DNA, 20 bp, Artificial Sequence
  Primer
cagcgtttccgagctctcgg

SEQ ID NO: 2643 - DNA, 20 bp, Artificial Sequence
  Primer
ctctcccttcctgagagaaa

SEQ ID NO: 2644 - DNA, 20 bp, Artificial Sequence
  Primer
ctccgccgaagcaataactt

SEQ ID NO: 2645 - DNA, 20 bp, Artificial Sequence
  Primer
gccaagcgatctattatccc

SEQ ID NO: 2646 - DNA, 20 bp, Artificial Sequence
  Primer
cgctacgaatacgcacatca

SEQ ID NO: 2647 - DNA, 20 bp, Artificial Sequence
  Primer
cccgtaacgcacgcttgacg

SEQ ID NO: 2648 - DNA, 20 bp, Artificial Sequence
  Primer
cgctacgaatacgcacatca

SEQ ID NO: 2649 - DNA, 20 bp, Artificial Sequence
  Primer
acccgtaacgcacgcttgac

SEQ ID NO: 2650 - DNA, 20 bp, Artificial Sequence
  Primer
gagctaccagcccactttct

SEQ ID NO: 2651 - DNA, 20 bp, Artificial Sequence
  Primer
cccttaaaaaggtgtacccc

SEQ ID NO: 2652 - DNA, 20 bp, Artificial Sequence
  Primer
ccttcattaattccctctgc

SEQ ID NO: 2653 - DNA, 20 bp, Artificial Sequence
  Primer
tctaccaggagaaagttgcg

SEQ ID NO: 2654 - DNA, 20 bp, Artificial Sequence
  Primer
gcgctgaaaagtgggaaaag

SEQ ID NO: 2655 - DNA, 20 bp, Artificial Sequence
  Primer
ccacatgaagaatcgctcag

SEQ ID NO: 2656 - DNA, 20 bp, Artificial Sequence
  Primer
gcaggccgtatggaagaata

SEQ ID NO: 2657 - DNA, 20 bp, Artificial Sequence
  Primer
tagcatgcgttgtcgacact

SEQ ID NO: 2658 - DNA, 20 bp, Artificial Sequence
  Primer
agcaacaagcgcgactcacc

SEQ ID NO: 2659 - DNA, 20 bp, Artificial Sequence
  Primer
ccatcagcttgccgttcttt

SEQ ID NO: 2660 - DNA, 20 bp, Artificial Sequence
  Primer
acgtcgaggttgaaaagggc

SEQ ID NO: 2661 - DNA, 20 bp, Artificial Sequence
  Primer
acatgggagtcgttgccgaa

SEQ ID NO: 2662 - DNA, 20 bp, Artificial Sequence
  Primer
ccgatccacgaacctacttt

SEQ ID NO: 2663 - DNA, 20 bp, Artificial Sequence
  Primer
cgcttcctctccttctacaa

SEQ ID NO: 2664 - DNA, 20 bp, Artificial Sequence
  Primer
cacgatgatttctgcaggca

SEQ ID NO: 2665 - DNA, 20 bp, Artificial Sequence
  Primer
gaactgtaagtagctgctcg

SEQ ID NO: 2666 - DNA, 20 bp, Artificial Sequence
  Primer
cttctggagatagctccagt

SEQ ID NO: 2667 - DNA, 20 bp, Artificial Sequence
  Primer
gctgtgtaaagagctcggtt

SEQ ID NO: 2668 - DNA, 20 bp, Artificial Sequence
  Primer
gaagcatttctagcctacac

SEQ ID NO: 2669 - DNA, 20 bp, Artificial Sequence
  Primer
cctgtttctgcagttttggg

SEQ ID NO: 2670 - DNA, 20 bp, Artificial Sequence
  Primer
cgaagagaaagaaggtgctg

SEQ ID NO: 2671 - DNA, 20 bp, Artificial Sequence
  Primer
cgctacagacatagtgatgc

SEQ ID NO: 2672 - DNA, 20 bp, Artificial Sequence
  Primer
cctgaactgcaattcgagat

SEQ ID NO: 2673 - DNA, 20 bp, Artificial Sequence
  Primer
tttcggcaggcattacaagc

SEQ ID NO: 2674 - DNA, 20 bp, Artificial Sequence
  Primer
cccagagctcgataaaatgc

SEQ ID NO: 2675 - DNA, 20 bp, Artificial Sequence
  Primer
ccctacagaaaccatgtacc

SEQ ID NO: 2676 - DNA, 20 bp, Artificial Sequence
  Primer
ccgagtctaactctaaggac

SEQ ID NO: 2677 - DNA, 20 bp, Artificial Sequence
  Primer
gctcaaattgtccggactct

SEQ ID NO: 2678 - DNA, 20 bp, Artificial Sequence
  Primer
gcttaagggcttcttcctgg

SEQ ID NO: 2679 - DNA, 20 bp, Artificial Sequence
  Primer
cgcgaaaagcttgtacctct

SEQ ID NO: 2680 - DNA, 20 bp, Artificial Sequence
  Primer
ccctcctatctctcttacca

SEQ ID NO: 2681 - DNA, 20 bp, Artificial Sequence
  Primer
gggtgcgtcgttttcttttc

SEQ ID NO: 2682 - DNA, 20 bp, Artificial Sequence
  Primer
ccacgttattccttgcaacg

SEQ ID NO: 2683 - DNA, 20 bp, Artificial Sequence
  Primer
ggcaatgctgcagctccatc

SEQ ID NO: 2684 - DNA, 20 bp, Artificial Sequence
  Primer
gcaagtcagccacagttctt

SEQ ID NO: 2685 - DNA, 20 bp, Artificial Sequence
  Primer
cgatgagagagctgctcacg

SEQ ID NO: 2686 - DNA, 20 bp, Artificial Sequence
  Primer
gcgagcctgtgaattaaagg

SEQ ID NO: 2687 - DNA, 20 bp, Artificial Sequence
  Primer
ctttgcctcagagagatggt

SEQ ID NO: 2688 - DNA, 20 bp, Artificial Sequence
  Primer
cagaggatgctgtgaaaagc

SEQ ID NO: 2689 - DNA, 20 bp, Artificial Sequence
  Primer
ccgagaaacaaaagaaggcg

SEQ ID NO: 2690 - DNA, 20 bp, Artificial Sequence
  Primer
aagcagcagagatccgtgat

SEQ ID NO: 2691 - DNA, 20 bp, Artificial Sequence
  Primer
gcctgcagattaatcgggtt

SEQ ID NO: 2692 - DNA, 20 bp, Artificial Sequence
  Primer
tgcctaggaatgcccaaagc

SEQ ID NO: 2693 - DNA, 20 bp, Artificial Sequence
  Primer
acaggggttcgaatcccctt

SEQ ID NO: 2694 - DNA, 20 bp, Artificial Sequence
  Primer
cttcggattgcggtagatca

SEQ ID NO: 2695 - DNA, 20 bp, Artificial Sequence
  Primer
cgttgctctaccaactgagc

SEQ ID NO: 2696 - DNA, 20 bp, Artificial Sequence
  Primer
cctggagagcttttctttgc

SEQ ID NO: 2697 - DNA, 20 bp, Artificial Sequence
  Primer
atctagggcgctcaataacc

SEQ ID NO: 2698 - DNA, 20 bp, Artificial Sequence
  Primer
gaaatcgttgcaccccccct

SEQ ID NO: 2699 - DNA, 20 bp, Artificial Sequence
  Primer
ccattgctgttgtcacgtag

SEQ ID NO: 2700 - DNA, 20 bp, Artificial Sequence
  Primer
tcaaccctaccttacgactg

SEQ ID NO: 2701 - DNA, 20 bp, Artificial Sequence
  Primer
ctctgtttctcttcccagag

SEQ ID NO: 2702 - DNA, 20 bp, Artificial Sequence
  Primer
cgtagaatgacagaggactc

SEQ ID NO: 2703 - DNA, 20 bp, Artificial Sequence
  Primer
tgtttgtgcgacaggagctt

SEQ ID NO: 2704 - DNA, 20 bp, Artificial Sequence
  Primer
accgtccaccaaaaaaacgg

SEQ ID NO: 2705 - DNA, 20 bp, Artificial Sequence
  Primer
cactatgttcaccggactct

SEQ ID NO: 2706 - DNA, 20 bp, Artificial Sequence
  Primer
tacagcagctgcaacagaca

SEQ ID NO: 2707 - DNA, 20 bp, Artificial Sequence
  Primer
ctcttccggagcagataact

SEQ ID NO: 2708 - DNA, 20 bp, Artificial Sequence
  Primer
aacagcaccctcttcagagc

SEQ ID NO: 2709 - DNA, 20 bp, Artificial Sequence
  Primer
gatacacccgatctgagcat

SEQ ID NO: 2710 - DNA, 20 bp, Artificial Sequence
  Primer
gtcatctaattgctcgcgga

SEQ ID NO: 2711 - DNA, 20 bp, Artificial Sequence
  Primer
cagcatctcctgtatctgga

SEQ ID NO: 2712 - DNA, 20 bp, Artificial Sequence
  Primer
cccctaaaggagaaaggaag

SEQ ID NO: 2713 - DNA, 20 bp, Artificial Sequence
  Primer
cgtctcctttgctctcttct

SEQ ID NO: 2714 - DNA, 20 bp, Artificial Sequence
  Primer
caggatcgatcaactgcgaa

SEQ ID NO: 2715 - DNA, 20 bp, Artificial Sequence
  Primer
cgcgttcacgcaatttctct

SEQ ID NO: 2716 - DNA, 20 bp, Artificial Sequence
  Primer
cactccaattctcgggatct

SEQ ID NO: 2717 - DNA, 20 bp, Artificial Sequence
  Primer
cccggccactaacacagtat

SEQ ID NO: 2718 - DNA, 20 bp, Artificial Sequence
  Primer
caccgcagtcaagatattgg

SEQ ID NO: 2719 - DNA, 20 bp, Artificial Sequence
  Primer
ctgagacgactgatcagaag

SEQ ID NO: 2720 - DNA, 20 bp, Artificial Sequence
  Primer
cccgcgagtaatgtttgttg

SEQ ID NO: 2721 - DNA, 20 bp, Artificial Sequence
  Primer
acggatccggtggagcttta

SEQ ID NO: 2722 - DNA, 20 bp, Artificial Sequence
  Primer
aacagaaaccggcctcggaa

SEQ ID NO: 2723 - DNA, 20 bp, Artificial Sequence
  Primer
gcacaagatgtccagcaaga

SEQ ID NO: 2724 - DNA, 20 bp, Artificial Sequence
  Primer
gaaaggctgaatagggcagc

SEQ ID NO: 2725 - DNA, 20 bp, Artificial Sequence
  Primer
gagaagcctctgcctttagc

SEQ ID NO: 2726 - DNA, 20 bp, Artificial Sequence
  Primer
ctctcggttggcttattctc

SEQ ID NO: 2727 - DNA, 20 bp, Artificial Sequence
  Primer
cacataggatccatcggcat

SEQ ID NO: 2728 - DNA, 20 bp, Artificial Sequence
  Primer
gccacaaagatgccactttc

SEQ ID NO: 2729 - DNA, 20 bp, Artificial Sequence
  Primer
ccctctcatcattccctttc

SEQ ID NO: 2730 - DNA, 20 bp, Artificial Sequence
  Primer
gacctacctaccgagagagt

SEQ ID NO: 2731 - DNA, 20 bp, Artificial Sequence
  Primer
gagggaaacctatgaacgtc

SEQ ID NO: 2732 - DNA, 20 bp, Artificial Sequence
  Primer
atggcttccttaccgccttc

SEQ ID NO: 2733 - DNA, 20 bp, Artificial Sequence
  Primer
cggatctcatgaccttccat

SEQ ID NO: 2734 - DNA, 20 bp, Artificial Sequence
  Primer
cggacacgccctaactcaat

SEQ ID NO: 2735 - DNA, 20 bp, Artificial Sequence
  Primer
gggaaacaacgatcagcgaa

SEQ ID NO: 2736 - DNA, 20 bp, Artificial Sequence
  Primer
gaatcccgaactgctgtttc

SEQ ID NO: 2737 - DNA, 20 bp, Artificial Sequence
  Primer
attcctacgagaaggagctg

SEQ ID NO: 2738 - DNA, 20 bp, Artificial Sequence
  Primer
cccatagtgctggaagatac

SEQ ID NO: 2739 - DNA, 20 bp, Artificial Sequence
  Primer
caatcacacgaaccatccag

SEQ ID NO: 2740 - DNA, 20 bp, Artificial Sequence
  Primer
ttcttcgtcgctttgggttc

SEQ ID NO: 2741 - DNA, 20 bp, Artificial Sequence
  Primer
cccctagggataacggatgg

SEQ ID NO: 2742 - DNA, 20 bp, Artificial Sequence
  Primer
actgtcgagaactcttatcg

SEQ ID NO: 2743 - DNA, 20 bp, Artificial Sequence
  Primer
ctgcacacctcttcttcgag

SEQ ID NO: 2744 - DNA, 20 bp, Artificial Sequence
  Primer
cttcgttagctatcgcggct

SEQ ID NO: 2745 - DNA, 20 bp, Artificial Sequence
  Primer
gacgtgcattctccagatga

SEQ ID NO: 2746 - DNA, 20 bp, Artificial Sequence
  Primer
ccctgagacgttaatacgct

SEQ ID NO: 2747 - DNA, 20 bp, Artificial Sequence
  Primer
cctgtgaccaatgatgtgtc

SEQ ID NO: 2748 - DNA, 20 bp, Artificial Sequence
  Primer
aaatccctgggagcgtggga

SEQ ID NO: 2749 - DNA, 20 bp, Artificial Sequence
  Primer
gaaatcgcgtgtgttcttgc

SEQ ID NO: 2750 - DNA, 20 bp, Artificial Sequence
  Primer
ctcccgcatcaaaacctttc

SEQ ID NO: 2751 - DNA, 20 bp, Artificial Sequence
  Primer
ctcggtggctggtagataaa

SEQ ID NO: 2752 - DNA, 20 bp, Artificial Sequence
  Primer
gatctctaggtgccttactc

SEQ ID NO: 2753 - DNA, 20 bp, Artificial Sequence
  Primer
gctgatttacattcacggga

SEQ ID NO: 2754 - DNA, 20 bp, Artificial Sequence
  Primer
ggttgccatctgcgacctct

SEQ ID NO: 2755 - DNA, 20 bp, Artificial Sequence
  Primer
cagctttcagctgctatctc

SEQ ID NO: 2756 - DNA, 20 bp, Artificial Sequence
  Primer
gtcggttctcttgcgctaac

SEQ ID NO: 2757 - DNA, 20 bp, Artificial Sequence
  Primer
gatctctaggtgccttactc

SEQ ID NO: 2758 - DNA, 20 bp, Artificial Sequence
  Primer
gctgaggagagagaaaatcg

SEQ ID NO: 2759 - DNA, 20 bp, Artificial Sequence
  Primer
cgctgtctagaagactctac

SEQ ID NO: 2760 - DNA, 20 bp, Artificial Sequence
  Primer
tgcctgtcagtcggagctta

SEQ ID NO: 2761 - DNA, 20 bp, Artificial Sequence
  Primer
cgtggcgtcagtttgcaata

SEQ ID NO: 2762 - DNA, 20 bp, Artificial Sequence
  Primer
caattggggaaactcgcttg

SEQ ID NO: 2763 - DNA, 20 bp, Artificial Sequence
  Primer
cctcgatctcttctccttct

SEQ ID NO: 2764 - DNA, 20 bp, Artificial Sequence
  Primer
cgagtttagaaaggctccac

SEQ ID NO: 2765 - DNA, 20 bp, Artificial Sequence
  Primer
caagacttccccgtgaggaa

SEQ ID NO: 2766 - DNA, 20 bp, Artificial Sequence
  Primer
ctatgcagtaaataggcagc

SEQ ID NO: 2767 - DNA, 20 bp, Artificial Sequence
  Primer
ctgcttcgtcatttcccagt

SEQ ID NO: 2768 - DNA, 20 bp, Artificial Sequence
  Primer
gcgttcgtacagcatctaca

SEQ ID NO: 2769 - DNA, 20 bp, Artificial Sequence
  Primer
gctcagcaaagtacgtaacg

SEQ ID NO: 2770 - DNA, 20 bp, Artificial Sequence
  Primer
cccagcttctccctttttga

SEQ ID NO: 2771 - DNA, 20 bp, Artificial Sequence
  Primer
ctatgcagtaaataggcagc

SEQ ID NO: 2772 - DNA, 20 bp, Artificial Sequence
  Primer
gcgcttgtggaatagcaaca

SEQ ID NO: 2773 - DNA, 20 bp, Artificial Sequence
  Primer
tccctattcctgacttctcg

SEQ ID NO: 2774 - DNA, 20 bp, Artificial Sequence
  Primer
ggacccaatgatattgggtc

SEQ ID NO: 2775 - DNA, 20 bp, Artificial Sequence
  Primer
gagtgtatcgtaaatcgcgg

SEQ ID NO: 2776 - DNA, 20 bp, Artificial Sequence
  Primer
ccttggataggcctttcttg

SEQ ID NO: 2777 - DNA, 20 bp, Artificial Sequence
  Primer
gcattgaccaacgccatatc

SEQ ID NO: 2778 - DNA, 20 bp, Artificial Sequence
  Primer
caacggaatggatgtggaag

SEQ ID NO: 2779 - DNA, 20 bp, Artificial Sequence
  Primer
cgattcaactacgcaagggt

SEQ ID NO: 2780 - DNA, 20 bp, Artificial Sequence
  Primer
acctgggccctttgtagggt

SEQ ID NO: 2781 - DNA, 20 bp, Artificial Sequence
  Primer
gatttcgatgacccgagtga

SEQ ID NO: 2782 - DNA, 20 bp, Artificial Sequence
  Primer
cgatccacctgtatgatctc

SEQ ID NO: 2783 - DNA, 20 bp, Artificial Sequence
  Primer
gaactgtttcaaccctacga

SEQ ID NO: 2784 - DNA, 20 bp, Artificial Sequence
  Primer
ggcaaggaatcgtcgactta

SEQ ID NO: 2785 - DNA, 20 bp, Artificial Sequence
  Primer
agcgtgcaacaacatctgaa

SEQ ID NO: 2786 - DNA, 20 bp, Artificial Sequence
  Primer
ggagatgaaacctcttgcta

SEQ ID NO: 2787 - DNA, 20 bp, Artificial Sequence
  Primer
tctgaaaactcactgcgcac

SEQ ID NO: 2788 - DNA, 20 bp, Artificial Sequence
  Primer
cccttgccgaaatggaagaa

SEQ ID NO: 2789 - DNA, 20 bp, Artificial Sequence
  Primer
cgtcgcaatctaatgacgag

SEQ ID NO: 2790 - DNA, 20 bp, Artificial Sequence
  Primer
gaagcccctaaatgtaaggc

SEQ ID NO: 2791 - DNA, 20 bp, Artificial Sequence
  Primer
ggatgacaagggcaatggat

SEQ ID NO: 2792 - DNA, 20 bp, Artificial Sequence
  Primer
ccggagaaaaggaaggtaac

SEQ ID NO: 2793 - DNA, 20 bp, Artificial Sequence
  Primer
ccaaaatcgctaccgctaag

SEQ ID NO: 2794 - DNA, 20 bp, Artificial Sequence
  Primer
ggctatagttgagcccttga

SEQ ID NO: 2795 - DNA, 20 bp, Artificial Sequence
  Primer
catccggattagcatcccat

SEQ ID NO: 2796 - DNA, 20 bp, Artificial Sequence
  Primer
gactcgcgaacaaatggaag

SEQ ID NO: 2797 - DNA, 20 bp, Artificial Sequence
  Primer
cttgagtaaattgcgggcac

SEQ ID NO: 2798 - DNA, 20 bp, Artificial Sequence
  Primer
ccggttcctgtagctcttat

SEQ ID NO: 2799 - DNA, 20 bp, Artificial Sequence
  Primer
ggctatagttgagcccttga

SEQ ID NO: 2800 - DNA, 20 bp, Artificial Sequence
  Primer
ccccctagaagaagattcgt

SEQ ID NO: 2801 - DNA, 20 bp, Artificial Sequence
  Primer
gggagttcaggcaatagcaa

SEQ ID NO: 2802 - DNA, 20 bp, Artificial Sequence
  Primer
cctattttgatgacctcggc

SEQ ID NO: 2803 - DNA, 20 bp, Artificial Sequence
  Primer
gaagattttgctctccccac

SEQ ID NO: 2804 - DNA, 20 bp, Artificial Sequence
  Primer
cagagactgacctaggaaga

SEQ ID NO: 2805 - DNA, 20 bp, Artificial Sequence
  Primer
gcactttttcggtttctgcg

SEQ ID NO: 2806 - DNA, 20 bp, Artificial Sequence
  Primer
cccctctctctcctttaact

SEQ ID NO: 2807 - DNA, 20 bp, Artificial Sequence
  Primer
gtgacgaatttagactcgcc

SEQ ID NO: 2808 - DNA, 20 bp, Artificial Sequence
  Primer
caccatcggagtctggtatt

SEQ ID NO: 2809 - DNA, 20 bp, Artificial Sequence
  Primer
ggagagcagtccttaacaga

SEQ ID NO: 2810 - DNA, 20 bp, Artificial Sequence
  Primer
caggagttcgttgtgcaaac

SEQ ID NO: 2811 - DNA, 20 bp, Artificial Sequence
  Primer
caagggcatgaaagctatcg

SEQ ID NO: 2812 - DNA, 20 bp, Artificial Sequence
  Primer
gggagatttcggtaacactc

SEQ ID NO: 2813 - DNA, 20 bp, Artificial Sequence
  Primer
ccgaccacagttttacagta

SEQ ID NO: 2814 - DNA, 20 bp, Artificial Sequence
  Primer
tgcttgcgtatcaggatggt

SEQ ID NO: 2815 - DNA, 20 bp, Artificial Sequence
  Primer
ctgaagagtatcggtgcact

SEQ ID NO: 2816 - DNA, 20 bp, Artificial Sequence
  Primer
ttcggagaggtagcagcaaa

SEQ ID NO: 2817 - DNA, 20 bp, Artificial Sequence
  Primer
gttgatcttttggatcgtgg

SEQ ID NO: 2818 - DNA, 20 bp, Artificial Sequence
  Primer
acgttaggatccgcttcatc

SEQ ID NO: 2819 - DNA, 20 bp, Artificial Sequence
  Primer
gctatgcttgtatcaggagc

SEQ ID NO: 2820 - DNA, 20 bp, Artificial Sequence
  Primer
gaggcagtatacgagatggt

SEQ ID NO: 2821 - DNA, 20 bp, Artificial Sequence
  Primer
ggataccgccattgctattg

SEQ ID NO: 2822 - DNA, 20 bp, Artificial Sequence
  Primer
gctctcttcctgcctatcta

SEQ ID NO: 2823 - DNA, 20 bp, Artificial Sequence
  Primer
agaacgtgggcgtctctttt

SEQ ID NO: 2824 - DNA, 20 bp, Artificial Sequence
  Primer
gttgctccgatatcgcgccc

SEQ ID NO: 2825 - DNA, 20 bp, Artificial Sequence
  Primer
gcttacgggaccaaagtagt

SEQ ID NO: 2826 - DNA, 20 bp, Artificial Sequence
  Primer
ctatgtgatatgtggctcgc

SEQ ID NO: 2827 - DNA, 20 bp, Artificial Sequence
  Primer
ccagaactggatcaaatcgc

SEQ ID NO: 2828 - DNA, 20 bp, Artificial Sequence
  Primer
cggcacttttcttatcggta

SEQ ID NO: 2829 - DNA, 20 bp, Artificial Sequence
  Primer
tgagttagtgcgcgtcgctt

SEQ ID NO: 2830 - DNA, 20 bp, Artificial Sequence
  Primer
ggtcggttgtatgagatgtc

SEQ ID NO: 2831 - DNA, 20 bp, Artificial Sequence
  Primer
gattgccagaggttcttgat

SEQ ID NO: 2832 - DNA, 20 bp, Artificial Sequence
  Primer
ctatcagttcgttatgggtc

SEQ ID NO: 2833 - DNA, 20 bp, Artificial Sequence
  Primer
ctctcgtatcggctctattc

SEQ ID NO: 2834 - DNA, 20 bp, Artificial Sequence
  Primer
tgtggatgctggggatcaaa

SEQ ID NO: 2835 - DNA, 20 bp, Artificial Sequence
  Primer
gagacaactcagactcctac

SEQ ID NO: 2836 - DNA, 20 bp, Artificial Sequence
  Primer
ccgctttcattcaacaggtg

SEQ ID NO: 2837 - DNA, 20 bp, Artificial Sequence
  Primer
ggaatcaggaccagaatcag

SEQ ID NO: 2838 - DNA, 20 bp, Artificial Sequence
  Primer
ctgtgcgcatttggttgttg

SEQ ID NO: 2839 - DNA, 20 bp, Artificial Sequence
  Primer
tcaaggacgcagtgcagatg

SEQ ID NO: 2840 - DNA, 20 bp, Artificial Sequence
  Primer
aatcagcaggcctatgctga

SEQ ID NO: 2841 - DNA, 20 bp, Artificial Sequence
  Primer
ggaagaagaacggggagatt

SEQ ID NO: 2842 - DNA, 20 bp, Artificial Sequence
  Primer
ctgccaaagtaatgttgggc

SEQ ID NO: 2843 - DNA, 20 bp, Artificial Sequence
  Primer
tctccgctcccttctgccgt

SEQ ID NO: 2844 - DNA, 20 bp, Artificial Sequence
  Primer
gcactacgctctatttctgt

SEQ ID NO: 2845 - DNA, 20 bp, Artificial Sequence
  Primer
ccatctgttcttggactacc

SEQ ID NO: 2846 - DNA, 20 bp, Artificial Sequence
  Primer
ccagaggtacctatgactca

SEQ ID NO: 2847 - DNA, 20 bp, Artificial Sequence
  Primer
cgtttttaagcgggccgaaa

SEQ ID NO: 2848 - DNA, 20 bp, Artificial Sequence
  Primer
gctgcctgatgataacgaac

SEQ ID NO: 2849 - DNA, 20 bp, Artificial Sequence
  Primer
ctgagacgtggtcgttggag

SEQ ID NO: 2850 - DNA, 20 bp, Artificial Sequence
  Primer
caggctgtagatagctggat

SEQ ID NO: 2851 - DNA, 20 bp, Artificial Sequence
  Primer
gcattacttgattcatgcag

SEQ ID NO: 2852 - DNA, 20 bp, Artificial Sequence
  Primer
gcaagtttagaagggtatgc

SEQ ID NO: 2853 - DNA, 20 bp, Artificial Sequence
  Primer
ccagcgtttttgctagtgct

SEQ ID NO: 2854 - DNA, 20 bp, Artificial Sequence
  Primer
gtacaaacggatcagcacga

SEQ ID NO: 2855 - DNA, 20 bp, Artificial Sequence
  Primer
agatcgtgttacagctcagc

SEQ ID NO: 2856 - DNA, 20 bp, Artificial Sequence
  Primer
gccattgtggaaacctccaa

SEQ ID NO: 2857 - DNA, 20 bp, Artificial Sequence
  Primer
accaacaatgtttgccgagc

SEQ ID NO: 2858 - DNA, 20 bp, Artificial Sequence
  Primer
gtgtcggcagtaacgatgtc

SEQ ID NO: 2859 - DNA, 20 bp, Artificial Sequence
  Primer
cgtggagcagttagcagttt

SEQ ID NO: 2860 - DNA, 20 bp, Artificial Sequence
  Primer
gtcacgttagataagggtcc

SEQ ID NO: 2861 - DNA, 20 bp, Artificial Sequence
  Primer
cgggatttaactcgatcagc

SEQ ID NO: 2862 - DNA, 20 bp, Artificial Sequence
  Primer
ggaccgtgagcgttttgttt

SEQ ID NO: 2863 - DNA, 20 bp, Artificial Sequence
  Primer
gacgggatacggattagaag

SEQ ID NO: 2864 - DNA, 20 bp, Artificial Sequence
  Primer
ggacaaagtctctgatagcg

SEQ ID NO: 2865 - DNA, 20 bp, Artificial Sequence
  Primer
ctgtcactttctaggccgat

SEQ ID NO: 2866 - DNA, 20 bp, Artificial Sequence
  Primer
gtcgtttccgtttggaagga

SEQ ID NO: 2867 - DNA, 20 bp, Artificial Sequence
  Primer
gttgaatgacgagctggaga

SEQ ID NO: 2868 - DNA, 20 bp, Artificial Sequence
  Primer
tgggaagactcccgttcagt

SEQ ID NO: 2869 - DNA, 20 bp, Artificial Sequence
  Primer
tactccagatcgtgttcgag

SEQ ID NO: 2870 - DNA, 20 bp, Artificial Sequence
  Primer
gggcgatactttcttcccta

SEQ ID NO: 2871 - DNA, 20 bp, Artificial Sequence
  Primer
cgtgtgttatgcagagcttg

SEQ ID NO: 2872 - DNA, 20 bp, Artificial Sequence
  Primer
gggctgtgttggtatggatt

SEQ ID NO: 2873 - DNA, 20 bp, Artificial Sequence
  Primer
gcctcgaccgattgatattg

SEQ ID NO: 2874 - DNA, 20 bp, Artificial Sequence
  Primer
gcttctcaaagatgacgctg

SEQ ID NO: 2875 - DNA, 20 bp, Artificial Sequence
  Primer
tagtgacgatcgtgattggg

SEQ ID NO: 2876 - DNA, 20 bp, Artificial Sequence
  Primer
cgaagaaggtatgcggatag

SEQ ID NO: 2877 - DNA, 20 bp, Artificial Sequence
  Primer
cggttacgtggagtcaagaa

SEQ ID NO: 2878 - DNA, 20 bp, Artificial Sequence
  Primer
tgctggacttcaggtatgcg

SEQ ID NO: 2879 - DNA, 20 bp, Artificial Sequence
  Primer
gatggaagcaaaagcgtgtc

SEQ ID NO: 2880 - DNA, 20 bp, Artificial Sequence
  Primer
gatcgagccgggattcttct

SEQ ID NO: 2881 - DNA, 20 bp, Artificial Sequence
  Primer
gatgctgttcgctaataggg

SEQ ID NO: 2882 - DNA, 20 bp, Artificial Sequence
  Primer
gggaacgttttaccgatgct

SEQ ID NO: 2883 - DNA, 20 bp, Artificial Sequence
  Primer
gagaaaagcccttgctgttg

SEQ ID NO: 2884 - DNA, 20 bp, Artificial Sequence
  Primer
gttctttgggtgttgccact

SEQ ID NO: 2885 - DNA, 20 bp, Artificial Sequence
  Primer
ggctgccatgtcgtagttat

SEQ ID NO: 2886 - DNA, 20 bp, Artificial Sequence
  Primer
ggtagtctacaagcgagaag

SEQ ID NO: 2887 - DNA, 20 bp, Artificial Sequence
  Primer
tcgaggttcagcttgcgtaa

SEQ ID NO: 2888 - DNA, 20 bp, Artificial Sequence
  Primer
cctcgacgtaaggcaattca

SEQ ID NO: 2889 - DNA, 20 bp, Artificial Sequence
  Primer
ctctttccccgcgagtaagt

SEQ ID NO: 2890 - DNA, 20 bp, Artificial Sequence
  Primer
gtggggacgactggtctgtt

SEQ ID NO: 2891 - DNA, 20 bp, Artificial Sequence
  Primer
caggcgtccattttcttcct

SEQ ID NO: 2892 - DNA, 20 bp, Artificial Sequence
  Primer
cgctcgctttaagagctact

SEQ ID NO: 2893 - DNA, 20 bp, Artificial Sequence
  Primer
ggggcaaaaaccacagcttt

SEQ ID NO: 2894 - DNA, 20 bp, Artificial Sequence
  Primer
atagcttgcacagcaagcga

SEQ ID NO: 2895 - DNA, 20 bp, Artificial Sequence
  Primer
ccgcttgtgattgtagcaga

SEQ ID NO: 2896 - DNA, 20 bp, Artificial Sequence
  Primer
cttgtcgaggtaggttgtga

SEQ ID NO: 2897 - DNA, 20 bp, Artificial Sequence
  Primer
agagaagccttttcgtgcca

SEQ ID NO: 2898 - DNA, 20 bp, Artificial Sequence
  Primer
cgctcgttttgtacagctgc

SEQ ID NO: 2899 - DNA, 20 bp, Artificial Sequence
  Primer
ctctagcagactttcgtggt

SEQ ID NO: 2900 - DNA, 20 bp, Artificial Sequence
  Primer
tccggagaccatgttgggca

SEQ ID NO: 2901 - DNA, 20 bp, Artificial Sequence
  Primer
gtgccttctgaagagggatt

SEQ ID NO: 2902 - DNA, 20 bp, Artificial Sequence
  Primer
ggtctcctaaagccaaatcg

SEQ ID NO: 2903 - DNA, 20 bp, Artificial Sequence
  Primer
gccagtgtttttgccaaagc

SEQ ID NO: 2904 - DNA, 20 bp, Artificial Sequence
  Primer
agctggagcgttttttaccg

SEQ ID NO: 2905 - DNA, 20 bp, Artificial Sequence
  Primer
acgaggtcttgcggagtcgc

SEQ ID NO: 2906 - DNA, 20 bp, Artificial Sequence
  Primer
cacaggaaggtcattgagag

SEQ ID NO: 2907 - DNA, 20 bp, Artificial Sequence
  Primer
accatccggagaccatgttg

SEQ ID NO: 2908 - DNA, 20 bp, Artificial Sequence
  Primer
cgaaagagcgaacagcgaaa

SEQ ID NO: 2909 - DNA, 20 bp, Artificial Sequence
  Primer
agggatgcaagataggaagc

SEQ ID NO: 2910 - DNA, 20 bp, Artificial Sequence
  Primer
tagaaacgcgtccattggag

SEQ ID NO: 2911 - DNA, 20 bp, Artificial Sequence
  Primer
gtaggactcgctttgtttgg

SEQ ID NO: 2912 - DNA, 20 bp, Artificial Sequence
  Primer
ctgctaagggcgtagttact

SEQ ID NO: 2913 - DNA, 20 bp, Artificial Sequence
  Primer
ccggagagagtgttgtgttt

SEQ ID NO: 2914 - DNA, 20 bp, Artificial Sequence
  Primer
cgttcatatgaggagggaga

SEQ ID NO: 2915 - DNA, 20 bp, Artificial Sequence
  Primer
gagcctaggggaaaaattgc

SEQ ID NO: 2916 - DNA, 20 bp, Artificial Sequence
  Primer
gggaacaacaggcttcttca

SEQ ID NO: 2917 - DNA, 20 bp, Artificial Sequence
  Primer
ggcttcttgcttccgttgta

SEQ ID NO: 2918 - DNA, 20 bp, Artificial Sequence
  Primer
gacaggcaagccttggtatt

SEQ ID NO: 2919 - DNA, 20 bp, Artificial Sequence
  Primer
cttagcgcgtattgctgaga

SEQ ID NO: 2920 - DNA, 20 bp, Artificial Sequence
  Primer
cgagggtctcattacaaacc

SEQ ID NO: 2921 - DNA, 20 bp, Artificial Sequence
  Primer
ctaggatctttatggatggc

SEQ ID NO: 2922 - DNA, 20 bp, Artificial Sequence
  Primer
cccctctttctaagttccct

SEQ ID NO: 2923 - DNA, 20 bp, Artificial Sequence
  Primer
tggaaacctcgatgtgcggc

SEQ ID NO: 2924 - DNA, 20 bp, Artificial Sequence
  Primer
gctattggcaagcgcgttat

SEQ ID NO: 2925 - DNA, 20 bp, Artificial Sequence
  Primer
gtggcgttgtcgtcatgaat

SEQ ID NO: 2926 - DNA, 20 bp, Artificial Sequence
  Primer
accgtatcgccagggagaag

SEQ ID NO: 2927 - DNA, 20 bp, Artificial Sequence
  Primer
gcggtgcactattctatggg

SEQ ID NO: 2928 - DNA, 20 bp, Artificial Sequence
  Primer
gggcttaccggtattttggt

SEQ ID NO: 2929 - DNA, 20 bp, Artificial Sequence
  Primer
tcgcaggtgaggtgcaaacg

SEQ ID NO: 2930 - DNA, 20 bp, Artificial Sequence
  Primer
gccgcgaaggaaaagaaaga

SEQ ID NO: 2931 - DNA, 20 bp, Artificial Sequence
  Primer
ccaagagatggatttgtggg

SEQ ID NO: 2932 - DNA, 20 bp, Artificial Sequence
  Primer
gcggccacacagataagcca

SEQ ID NO: 2933 - DNA, 20 bp, Artificial Sequence
  Primer
caaggattcgttagggaagt

SEQ ID NO: 2934 - DNA, 20 bp, Artificial Sequence
  Primer
gggatagcctcgagaatcta

SEQ ID NO: 2935 - DNA, 20 bp, Artificial Sequence
  Primer
caaggacttcttgagagctg

SEQ ID NO: 2936 - DNA, 20 bp, Artificial Sequence
  Primer
gtgggaacattcacgttagc

SEQ ID NO: 2937 - DNA, 20 bp, Artificial Sequence
  Primer
gatgagcatgtatgaccgca

SEQ ID NO: 2938 - DNA, 20 bp, Artificial Sequence
  Primer
tagggcgatctccggtaaga

SEQ ID NO: 2939 - DNA, 20 bp, Artificial Sequence
  Primer
cgttgaaagaggcgttcttg

SEQ ID NO: 2940 - DNA, 20 bp, Artificial Sequence
  Primer
gcaacacgaatcggcatcat

SEQ ID NO: 2941 - DNA, 20 bp, Artificial Sequence
  Primer
ctgaaaggcggagcttatca

SEQ ID NO: 2942 - DNA, 20 bp, Artificial Sequence
  Primer
gttggagatcgttatgggag

SEQ ID NO: 2943 - DNA, 20 bp, Artificial Sequence
  Primer
ggcgttattcgcggatttac

SEQ ID NO: 2944 - DNA, 20 bp, Artificial Sequence
  Primer
gtagcaactaccatgggaag

SEQ ID NO: 2945 - DNA, 20 bp, Artificial Sequence
  Primer
ccttgtgcgcagttaaacac

SEQ ID NO: 2946 - DNA, 20 bp, Artificial Sequence
  Primer
ccttctggtagttcgaaagc

SEQ ID NO: 2947 - DNA, 20 bp, Artificial Sequence
  Primer
ggagtcaaggataaagagcg

SEQ ID NO: 2948 - DNA, 20 bp, Artificial Sequence
  Primer
gagtgtttgccattgtagcg

SEQ ID NO: 2949 - DNA, 20 bp, Artificial Sequence
  Primer
gcgatatcgttcaacacacg

SEQ ID NO: 2950 - DNA, 20 bp, Artificial Sequence
  Primer
ccttcctgtccttctgcaat

SEQ ID NO: 2951 - DNA, 20 bp, Artificial Sequence
  Primer
ggcattccagcagaacaagt

SEQ ID NO: 2952 - DNA, 20 bp, Artificial Sequence
  Primer
cccaaactcttcgaggcgga

SEQ ID NO: 2953 - DNA, 20 bp, Artificial Sequence
  Primer
cacggaactaagcaaaaggg

SEQ ID NO: 2954 - DNA, 20 bp, Artificial Sequence
  Primer
gcgtcttgcagtaagtcttc

SEQ ID NO: 2955 - DNA, 20 bp, Artificial Sequence
  Primer
tgcagaggctttcatcctca

SEQ ID NO: 2956 - DNA, 20 bp, Artificial Sequence
  Primer
agcgacatcgctctccatgc

SEQ ID NO: 2957 - DNA, 20 bp, Artificial Sequence
  Primer
ctgctgagcttgtaattccg

SEQ ID NO: 2958 - DNA, 20 bp, Artificial Sequence
  Primer
acatctgcgctaaaggcaag

SEQ ID NO: 2959 - DNA, 20 bp, Artificial Sequence
  Primer
gcgtcttgcagtaagtcttc

SEQ ID NO: 2960 - DNA, 20 bp, Artificial Sequence
  Primer
gtgctcatcgcgataattcc

SEQ ID NO: 2961 - DNA, 20 bp, Artificial Sequence
  Primer
tccatggtagagttggttcc

SEQ ID NO: 2962 - DNA, 20 bp, Artificial Sequence
  Primer
gtgtctagagactctgcctc

SEQ ID NO: 2963 - DNA, 20 bp, Artificial Sequence
  Primer
cggcgatgtagtaaggaggg

SEQ ID NO: 2964 - DNA, 20 bp, Artificial Sequence
  Primer
gattgttgcgctagctcaag

SEQ ID NO: 2965 - DNA, 20 bp, Artificial Sequence
  Primer
ctcttccgtaggaacaggat

SEQ ID NO: 2966 - DNA, 20 bp, Artificial Sequence
  Primer
ggatgccacgctacaattga

SEQ ID NO: 2967 - DNA, 20 bp, Artificial Sequence
  Primer
cagggacagcggctttttat

SEQ ID NO: 2968 - DNA, 20 bp, Artificial Sequence
  Primer
ctgggagagggtaacttcaa

SEQ ID NO: 2969 - DNA, 20 bp, Artificial Sequence
  Primer
ctccttacgggatagcacaa

SEQ ID NO: 2970 - DNA, 20 bp, Artificial Sequence
  Primer
aggagagcgggacgaaaaat

SEQ ID NO: 2971 - DNA, 20 bp, Artificial Sequence
  Primer
actggttcggatgcttcacg

SEQ ID NO: 2972 - DNA, 20 bp, Artificial Sequence
  Primer
ctcgtgacgggattccattt

SEQ ID NO: 2973 - DNA, 20 bp, Artificial Sequence
  Primer
gggaagtttgacggttccta

SEQ ID NO: 2974 - DNA, 20 bp, Artificial Sequence
  Primer
gaccatagaagatcctccag

SEQ ID NO: 2975 - DNA, 20 bp, Artificial Sequence
  Primer
agcgggatcctcttcgaatg

SEQ ID NO: 2976 - DNA, 20 bp, Artificial Sequence
  Primer
tagggctgtcgctcaacgac

SEQ ID NO: 2977 - DNA, 20 bp, Artificial Sequence
  Primer
agggaacgcaagccgtttcg

SEQ ID NO: 2978 - DNA, 20 bp, Artificial Sequence
  Primer
gctggctggggttctcactt

SEQ ID NO: 2979 - DNA, 20 bp, Artificial Sequence
  Primer
gggagaacgatgatttcctc

SEQ ID NO: 2980 - DNA, 20 bp, Artificial Sequence
  Primer
gtcgtgagctatctcatcgt

SEQ ID NO: 2981 - DNA, 20 bp, Artificial Sequence
  Primer
aacaccgactgcctcaagat

SEQ ID NO: 2982 - DNA, 20 bp, Artificial Sequence
  Primer
ctcgttcgtttgaggaagac

SEQ ID NO: 2983 - DNA, 20 bp, Artificial Sequence
  Primer
cgttccggatacaaaggaag

SEQ ID NO: 2984 - DNA, 20 bp, Artificial Sequence
  Primer
gcgcaacaatctgctatttc

SEQ ID NO: 2985 - DNA, 20 bp, Artificial Sequence
  Primer
ccctattttgcgtagtctgg

SEQ ID NO: 2986 - DNA, 20 bp, Artificial Sequence
  Primer
aatgctttggtatgcggggt

SEQ ID NO: 2987 - DNA, 20 bp, Artificial Sequence
  Primer
gctgcacagaggtgtttatg

SEQ ID NO: 2988 - DNA, 20 bp, Artificial Sequence
  Primer
tagcagcaatcccatccaag

SEQ ID NO: 2989 - DNA, 20 bp, Artificial Sequence
  Primer
ccggagaattatggagatcc

SEQ ID NO: 2990 - DNA, 20 bp, Artificial Sequence
  Primer
gccagcctccagtaatcatt

SEQ ID NO: 2991 - DNA, 20 bp, Artificial Sequence
  Primer
gatcccgttattcttcaagc

SEQ ID NO: 2992 - DNA, 20 bp, Artificial Sequence
  Primer
ctcctgtagggaacataacg

SEQ ID NO: 2993 - DNA, 20 bp, Artificial Sequence
  Primer
ccgggatagtcttagggttt

SEQ ID NO: 2994 - DNA, 20 bp, Artificial Sequence
  Primer
gtgttgagcttctaccgttg

SEQ ID NO: 2995 - DNA, 20 bp, Artificial Sequence
  Primer
ccctcttttttggagggagt

SEQ ID NO: 2996 - DNA, 20 bp, Artificial Sequence
  Primer
cgctcctttgctcgttactt

SEQ ID NO: 2997 - DNA, 20 bp, Artificial Sequence
  Primer
cagccagcctccagtaatca

SEQ ID NO: 2998 - DNA, 20 bp, Artificial Sequence
  Primer
cgattgcacaacgggaggga

SEQ ID NO: 2999 - DNA, 20 bp, Artificial Sequence
  Primer
gagcataaccaggaaaggag

SEQ ID NO: 3000 - DNA, 20 bp, Artificial Sequence
  Primer
cccctttactgactagaagc

SEQ ID NO: 3001 - DNA, 20 bp, Artificial Sequence
  Primer
cgctcctttgctcgttactt

SEQ ID NO: 3002 - DNA, 20 bp, Artificial Sequence
  Primer
tacaggcatcacctaaggct

SEQ ID NO: 3003 - DNA, 20 bp, Artificial Sequence
  Primer
cctgatgatgcggagaatct

SEQ ID NO: 3004 - DNA, 20 bp, Artificial Sequence
  Primer
gactccgcgttcatcacaaa

SEQ ID NO: 3005 - DNA, 20 bp, Artificial Sequence
  Primer
gaccagcccttgtttagaga

SEQ ID NO: 3006 - DNA, 20 bp, Artificial Sequence
  Primer
ctccgataactacacagtcg

SEQ ID NO: 3007 - DNA, 20 bp, Artificial Sequence
  Primer
ggagtgagtcgttctactgt

SEQ ID NO: 3008 - DNA, 20 bp, Artificial Sequence
  Primer
cacgtacgctgtagatctgc

SEQ ID NO: 3009 - DNA, 20 bp, Artificial Sequence
  Primer
cggaaatcagtgatgaggca

SEQ ID NO: 3010 - DNA, 20 bp, Artificial Sequence
  Primer
ggtagcctgatgacgaaaca

SEQ ID NO: 3011 - DNA, 20 bp, Artificial Sequence
  Primer
caccatggtgatgagggtat

SEQ ID NO: 3012 - DNA, 20 bp, Artificial Sequence
  Primer
cctgctccaaagaacatagc

SEQ ID NO: 3013 - DNA, 20 bp, Artificial Sequence
  Primer
gggaatccttgagggttttc

SEQ ID NO: 3014 - DNA, 20 bp, Artificial Sequence
  Primer
tgcggaatgctcgtgtgtgt

SEQ ID NO: 3015 - DNA, 20 bp, Artificial Sequence
  Primer
catggcggaaatcccaaagc

SEQ ID NO: 3016 - DNA, 20 bp, Artificial Sequence
  Primer
tgcggagatgggcgcagcag

SEQ ID NO: 3017 - DNA, 20 bp, Artificial Sequence
  Primer
gcgtatcgtaagacacagca

SEQ ID NO: 3018 - DNA, 20 bp, Artificial Sequence
  Primer
agaattgctccggaatctgc

SEQ ID NO: 3019 - DNA, 20 bp, Artificial Sequence
  Primer
ccctctgctaagaccaaagc

SEQ ID NO: 3020 - DNA, 20 bp, Artificial Sequence
  Primer
ccgtcgctcaattaccaatc

SEQ ID NO: 3021 - DNA, 20 bp, Artificial Sequence
  Primer
cctgttgctcggataatagg

SEQ ID NO: 3022 - DNA, 20 bp, Artificial Sequence
  Primer
ctgtgtggttggtacctaca

SEQ ID NO: 3023 - DNA, 20 bp, Artificial Sequence
  Primer
gaggtttctggaaggaaacg

SEQ ID NO: 3024 - DNA, 20 bp, Artificial Sequence
  Primer
ccatgatctgtgatccgaac

SEQ ID NO: 3025 - DNA, 20 bp, Artificial Sequence
  Primer
ctctgctaggaatgggatag

SEQ ID NO: 3026 - DNA, 20 bp, Artificial Sequence
  Primer
cagcatgcaagaagtttccc

SEQ ID NO: 3027 - DNA, 20 bp, Artificial Sequence
  Primer
cagacacctcttccttcact

SEQ ID NO: 3028 - DNA, 20 bp, Artificial Sequence
  Primer
ggttcaaaagagggcactcg

SEQ ID NO: 3029 - DNA, 20 bp, Artificial Sequence
  Primer
cccgccttcaatagatggat

SEQ ID NO: 3030 - DNA, 20 bp, Artificial Sequence
  Primer
ctgcaaatagcacagacctc

SEQ ID NO: 3031 - DNA, 20 bp, Artificial Sequence
  Primer
cataggaggtatcagggaag

SEQ ID NO: 3032 - DNA, 20 bp, Artificial Sequence
  Primer
gtatagctcacacccgatga

SEQ ID NO: 3033 - DNA, 20 bp, Artificial Sequence
  Primer
ttccatgagaggatggtcgt

SEQ ID NO: 3034 - DNA, 20 bp, Artificial Sequence
  Primer
tggatggataagcggagagt

SEQ ID NO: 3035 - DNA, 20 bp, Artificial Sequence
  Primer
tgagatggttggcaactcgg

SEQ ID NO: 3036 - DNA, 20 bp, Artificial Sequence
  Primer
gccagaagaccaggaattca

SEQ ID NO: 3037 - DNA, 20 bp, Artificial Sequence
  Primer
ggaggcaaaagacagaaacc

SEQ ID NO: 3038 - DNA, 20 bp, Artificial Sequence
  Primer
gagcaggcagatgcattttg

SEQ ID NO: 3039 - DNA, 20 bp, Artificial Sequence
  Primer
atcgtgcgcatggaggccac

SEQ ID NO: 3040 - DNA, 20 bp, Artificial Sequence
  Primer
ggagcggaaactattcgaga

SEQ ID NO: 3041 - DNA, 20 bp, Artificial Sequence
  Primer
cgacggttgcgattaattcc

SEQ ID NO: 3042 - DNA, 20 bp, Artificial Sequence
  Primer
catcgatgggaaggactttg

SEQ ID NO: 3043 - DNA, 20 bp, Artificial Sequence
  Primer
cagaggtagttacgcctatc

SEQ ID NO: 3044 - DNA, 20 bp, Artificial Sequence
  Primer
gacctatatctttggcgcag

SEQ ID NO: 3045 - DNA, 20 bp, Artificial Sequence
  Primer
gggcggagcagatatgtcta

SEQ ID NO: 3046 - DNA, 20 bp, Artificial Sequence
  Primer
gaggttaggcctgttttgct

SEQ ID NO: 3047 - DNA, 20 bp, Artificial Sequence
  Primer
gccgaacggaagatttttcg

SEQ ID NO: 3048 - DNA, 20 bp, Artificial Sequence
  Primer
ctgcagtaacagggaagttg

SEQ ID NO: 3049 - DNA, 20 bp, Artificial Sequence
  Primer
gttcggcccttaggtttttc

SEQ ID NO: 3050 - DNA, 20 bp, Artificial Sequence
  Primer
gtatcgtcttgagacgatgg

SEQ ID NO: 3051 - DNA, 20 bp, Artificial Sequence
  Primer
aaagaggatcagcgttggga

SEQ ID NO: 3052 - DNA, 20 bp, Artificial Sequence
  Primer
cgagctgtttcagcagaatc

SEQ ID NO: 3053 - DNA, 20 bp, Artificial Sequence
  Primer
ccgggcgtttgttgaaaaga

SEQ ID NO: 3054 - DNA, 20 bp, Artificial Sequence
  Primer
ctgtgggcttcaaaaatgga

SEQ ID NO: 3055 - DNA, 20 bp, Artificial Sequence
  Primer
ctttagaaggaggctggtga

SEQ ID NO: 3056 - DNA, 20 bp, Artificial Sequence
  Primer
gcgtaaaagtctgggcagaa

SEQ ID NO: 3057 - DNA, 20 bp, Artificial Sequence
  Primer
tgcttctgcagtaacaggga

SEQ ID NO: 3058 - DNA, 20 bp, Artificial Sequence
  Primer
ccggatgtaagtgttgtagc

SEQ ID NO: 3059 - DNA, 20 bp, Artificial Sequence
  Primer
gactacggctcaggaaagac

SEQ ID NO: 3060 - DNA, 20 bp, Artificial Sequence
  Primer
gctcctctgttactgattgc

SEQ ID NO: 3061 - DNA, 20 bp, Artificial Sequence
  Primer
cgaacggcattgcgaaagta

SEQ ID NO: 3062 - DNA, 20 bp, Artificial Sequence
  Primer
gctcagagaacgttaaagcg

SEQ ID NO: 3063 - DNA, 20 bp, Artificial Sequence
  Primer
ccctgtggaagttccagagt

SEQ ID NO: 3064 - DNA, 20 bp, Artificial Sequence
  Primer
gggctgtgtaggtaatgccg

SEQ ID NO: 3065 - DNA, 20 bp, Artificial Sequence
  Primer
cgacagcctatggccggcaa

SEQ ID NO: 3066 - DNA, 20 bp, Artificial Sequence
  Primer
gctggagtgttgttagggat

SEQ ID NO: 3067 - DNA, 20 bp, Artificial Sequence
  Primer
atccaagcgatagctgaacg

SEQ ID NO: 3068 - DNA, 20 bp, Artificial Sequence
  Primer
caacggcggcaggtatcttt

SEQ ID NO: 3069 - DNA, 20 bp, Artificial Sequence
  Primer
gctcagagaacgttaaagcg

SEQ ID NO: 3070 - DNA, 20 bp, Artificial Sequence
  Primer
acacggtgatccgtatggac

SEQ ID NO: 3071 - DNA, 20 bp, Artificial Sequence
  Primer
cgtgattagcttgggtaagc

SEQ ID NO: 3072 - DNA, 20 bp, Artificial Sequence
  Primer
agccagaaggaaaagcttcg

SEQ ID NO: 3073 - DNA, 20 bp, Artificial Sequence
  Primer
aagcaaaattccgtcagcct

SEQ ID NO: 3074 - DNA, 20 bp, Artificial Sequence
  Primer
gcacacattacagcttccca

SEQ ID NO: 3075 - DNA, 20 bp, Artificial Sequence
  Primer
gggcgagaagacttttgttg

SEQ ID NO: 3076 - DNA, 20 bp, Artificial Sequence
  Primer
ccaaggaagctccactagta

SEQ ID NO: 3077 - DNA, 20 bp, Artificial Sequence
  Primer
cggggtgattttaaagcagg

SEQ ID NO: 3078 - DNA, 20 bp, Artificial Sequence
  Primer
gcttccaaggggtgatgaaa

SEQ ID NO: 3079 - DNA, 20 bp, Artificial Sequence
  Primer
ggccaatcaaggttggtttc

SEQ ID NO: 3080 - DNA, 20 bp, Artificial Sequence
  Primer
aacgtagaatgccgtggggt

SEQ ID NO: 3081 - DNA, 20 bp, Artificial Sequence
  Primer
gctaaccatgcagcgtttgt

SEQ ID NO: 3082 - DNA, 20 bp, Artificial Sequence
  Primer
gggacggagaaggtaaaaag

SEQ ID NO: 3083 - DNA, 20 bp, Artificial Sequence
  Primer
gtggactttctgcaacagag

SEQ ID NO: 3084 - DNA, 20 bp, Artificial Sequence
  Primer
ggtctccaatgcagatcaca

SEQ ID NO: 3085 - DNA, 20 bp, Artificial Sequence
  Primer
ggatttcatcgtcatgcagg

SEQ ID NO: 3086 - DNA, 20 bp, Artificial Sequence
  Primer
ggggtaaagtcacgaaagga

SEQ ID NO: 3087 - DNA, 20 bp, Artificial Sequence
  Primer
gttgtgaagcgttcttgcgg

SEQ ID NO: 3088 - DNA, 20 bp, Artificial Sequence
  Primer
agaaaggctcgtttagctgc

SEQ ID NO: 3089 - DNA, 20 bp, Artificial Sequence
  Primer
gctattcggttgcttttggc

SEQ ID NO: 3090 - DNA, 20 bp, Artificial Sequence
  Primer
ctggagctgagattgctcgg

SEQ ID NO: 3091 - DNA, 20 bp, Artificial Sequence
  Primer
cgggacgagacagttaattc

SEQ ID NO: 3092 - DNA, 20 bp, Artificial Sequence
  Primer
gcagggttgctatcaacaga

SEQ ID NO: 3093 - DNA, 20 bp, Artificial Sequence
  Primer
cataacgtggagatgagacc

SEQ ID NO: 3094 - DNA, 20 bp, Artificial Sequence
  Primer
gagctgctgcaaagttagga

SEQ ID NO: 3095 - DNA, 20 bp, Artificial Sequence
  Primer
ccaacagttcgaggaacagc

SEQ ID NO: 3096 - DNA, 20 bp, Artificial Sequence
  Primer
gaggccgtagaaagaccaaa

SEQ ID NO: 3097 - DNA, 20 bp, Artificial Sequence
  Primer
acgtggtctcgtcgttctat

SEQ ID NO: 3098 - DNA, 20 bp, Artificial Sequence
  Primer
cgtaaagaagggggatgttg

SEQ ID NO: 3099 - DNA, 20 bp, Artificial Sequence
  Primer
gcgctattgcaaatgcagag

SEQ ID NO: 3100 - DNA, 20 bp, Artificial Sequence
  Primer
cgacaaaggtaagcaaggga

SEQ ID NO: 3101 - DNA, 20 bp, Artificial Sequence
  Primer
gcgggattcgttgttaaacg

SEQ ID NO: 3102 - DNA, 20 bp, Artificial Sequence
  Primer
cgtgttaaacgatctcaggg

SEQ ID NO: 3103 - DNA, 20 bp, Artificial Sequence
  Primer
gcagggttgctatcaacaga

SEQ ID NO: 3104 - DNA, 20 bp, Artificial Sequence
  Primer
ggaagatcgtagacctgtga

SEQ ID NO: 3105 - DNA, 20 bp, Artificial Sequence
  Primer
cggagcttagagagaagagt

SEQ ID NO: 3106 - DNA, 20 bp, Artificial Sequence
  Primer
ggggtttctcaccctacaaa

SEQ ID NO: 3107 - DNA, 20 bp, Artificial Sequence
  Primer
ccgtaaagaagggggatgtt

SEQ ID NO: 3108 - DNA, 20 bp, Artificial Sequence
  Primer
gcagctgattgatgatgttg

SEQ ID NO: 3109 - DNA, 20 bp, Artificial Sequence
  Primer
gaatcctaaagggaagcgca

SEQ ID NO: 3110 - DNA, 20 bp, Artificial Sequence
  Primer
gagggaggatctattcctca

SEQ ID NO: 3111 - DNA, 20 bp, Artificial Sequence
  Primer
ctctacgtggaatccgtatg

SEQ ID NO: 3112 - DNA, 20 bp, Artificial Sequence
  Primer
gaagagttcctacacgagga

SEQ ID NO: 3113 - DNA, 20 bp, Artificial Sequence
  Primer
ggaagatcgtagacctgtga

SEQ ID NO: 3114 - DNA, 20 bp, Artificial Sequence
  Primer
ggtaactttgctaggagctg

SEQ ID NO: 3115 - DNA, 20 bp, Artificial Sequence
  Primer
ggggatgctgctcgaaaaaa

SEQ ID NO: 3116 - DNA, 20 bp, Artificial Sequence
  Primer
gaggttggtcgactaaacgc

SEQ ID NO: 3117 - DNA, 20 bp, Artificial Sequence
  Primer
gacgtttcggatatgaaggg

SEQ ID NO: 3118 - DNA, 20 bp, Artificial Sequence
  Primer
cttctgctgggaaagttggt

SEQ ID NO: 3119 - DNA, 20 bp, Artificial Sequence
  Primer
cgatttccgaactgcgacaa

SEQ ID NO: 3120 - DNA, 20 bp, Artificial Sequence
  Primer
ggtagaggggatcattgaag

SEQ ID NO: 3121 - DNA, 20 bp, Artificial Sequence
  Primer
cttatgtgggttggagagca

SEQ ID NO: 3122 - DNA, 20 bp, Artificial Sequence
  Primer
gggcgtcttatggtcagata

SEQ ID NO: 3123 - DNA, 20 bp, Artificial Sequence
  Primer
ccgtcgtgtgcaatctgata

SEQ ID NO: 3124 - DNA, 20 bp, Artificial Sequence
  Primer
aggctatctgtgaagctgtg

SEQ ID NO: 3125 - DNA, 20 bp, Artificial Sequence
  Primer
ttacggtcacgcgtccaatg

SEQ ID NO: 3126 - DNA, 20 bp, Artificial Sequence
  Primer
ccgtttaggagggactagtt

SEQ ID NO: 3127 - DNA, 20 bp, Artificial Sequence
  Primer
ggacgagaagagaatcgttt

SEQ ID NO: 3128 - DNA, 20 bp, Artificial Sequence
  Primer
gaaactcctgttcatgacag

SEQ ID NO: 3129 - DNA, 20 bp, Artificial Sequence
  Primer
ctgactacctgggatttagc

SEQ ID NO: 3130 - DNA, 20 bp, Artificial Sequence
  Primer
cgagtcttgttctgagcaca

SEQ ID NO: 3131 - DNA, 20 bp, Artificial Sequence
  Primer
ctttcgctcctcaagcaaca

SEQ ID NO: 3132 - DNA, 20 bp, Artificial Sequence
  Primer
gatcgatgagttgaaacgtg

SEQ ID NO: 3133 - DNA, 20 bp, Artificial Sequence
  Primer
atggcctttagagtgcctgt

SEQ ID NO: 3134 - DNA, 20 bp, Artificial Sequence
  Primer
gcatctttacaggatgtccc

SEQ ID NO: 3135 - DNA, 20 bp, Artificial Sequence
  Primer
ccgggatgctaaaatcaacc

SEQ ID NO: 3136 - DNA, 20 bp, Artificial Sequence
  Primer
cctcgacagcgaattcttct

SEQ ID NO: 3137 - DNA, 20 bp, Artificial Sequence
  Primer
gaaactcctgttcatgacag

SEQ ID NO: 3138 - DNA, 20 bp, Artificial Sequence
  Primer
aagagatgactcgcttgtgc

SEQ ID NO: 3139 - DNA, 20 bp, Artificial Sequence
  Primer
gggtatctctttgatgtggc

SEQ ID NO: 3140 - DNA, 20 bp, Artificial Sequence
  Primer
gggagcaacgaatcctaaag

SEQ ID NO: 3141 - DNA, 20 bp, Artificial Sequence
  Primer
ggtctgtgagctgaaatctc

SEQ ID NO: 3142 - DNA, 20 bp, Artificial Sequence
  Primer
cctccgccgctatagcgacg

SEQ ID NO: 3143 - DNA, 20 bp, Artificial Sequence
  Primer
gtgggtaaaggcaatgcttc

SEQ ID NO: 3144 - DNA, 20 bp, Artificial Sequence
  Primer
cgcttatgcttggcgatctt

SEQ ID NO: 3145 - DNA, 20 bp, Artificial Sequence
  Primer
cagcccttcgcaatgaacaa

SEQ ID NO: 3146 - DNA, 20 bp, Artificial Sequence
  Primer
ggccggttgtttcattggaa

SEQ ID NO: 3147 - DNA, 20 bp, Artificial Sequence
  Primer
ccgatctcttcgacgtcttt

SEQ ID NO: 3148 - DNA, 20 bp, Artificial Sequence
  Primer
agaaaagaggaggcggagtg

SEQ ID NO: 3149 - DNA, 20 bp, Artificial Sequence
  Primer
ccagaaatatctcccacgct

SEQ ID NO: 3150 - DNA, 20 bp, Artificial Sequence
  Primer
tcgcttggttaggtagagag

SEQ ID NO: 3151 - DNA, 20 bp, Artificial Sequence
  Primer
gggttctatctatcctgggt

SEQ ID NO: 3152 - DNA, 20 bp, Artificial Sequence
  Primer
aggttttgggagcccgtgta

SEQ ID NO: 3153 - DNA, 20 bp, Artificial Sequence
  Primer
ctggagaggtttctttgtgg

SEQ ID NO: 3154 - DNA, 20 bp, Artificial Sequence
  Primer
acacagacgatagagcaagc

SEQ ID NO: 3155 - DNA, 20 bp, Artificial Sequence
  Primer
gaggctgatgatgtgattgc

SEQ ID NO: 3156 - DNA, 20 bp, Artificial Sequence
  Primer
gcacgtggttcaggaacaaa

SEQ ID NO: 3157 - DNA, 20 bp, Artificial Sequence
  Primer
ggggccaaccaggtatttta

SEQ ID NO: 3158 - DNA, 20 bp, Artificial Sequence
  Primer
gacggatatgattcgtcagg

SEQ ID NO: 3159 - DNA, 20 bp, Artificial Sequence
  Primer
gcgttatcaggctaaagcag

SEQ ID NO: 3160 - DNA, 20 bp, Artificial Sequence
  Primer
gaggaggttcaaggtgaaga

SEQ ID NO: 3161 - DNA, 20 bp, Artificial Sequence
  Primer
cgcacgtggttcaggaacaa

SEQ ID NO: 3162 - DNA, 20 bp, Artificial Sequence
  Primer
ctttccctttagggattggg

SEQ ID NO: 3163 - DNA, 20 bp, Artificial Sequence
  Primer
ggacgaagtgatctttgagg

SEQ ID NO: 3164 - DNA, 20 bp, Artificial Sequence
  Primer
gaaagagttgcccgcttctg

SEQ ID NO: 3165 - DNA, 20 bp, Artificial Sequence
  Primer
tggtagacggacgaaagaag

SEQ ID NO: 3166 - DNA, 20 bp, Artificial Sequence
  Primer
cagcgttctacgcttaggta

SEQ ID NO: 3167 - DNA, 20 bp, Artificial Sequence
  Primer
cggagtgttgaaagtagacg

SEQ ID NO: 3168 - DNA, 20 bp, Artificial Sequence
  Primer
gatgcgttattggtgcctgt

SEQ ID NO: 3169 - DNA, 20 bp, Artificial Sequence
  Primer
gcccttgcagatctacatct

SEQ ID NO: 3170 - DNA, 20 bp, Artificial Sequence
  Primer
ccacattacaccttcgcagt

SEQ ID NO: 3171 - DNA, 20 bp, Artificial Sequence
  Primer
ctctcgttgtttgtttgggc

SEQ ID NO: 3172 - DNA, 20 bp, Artificial Sequence
  Primer
agatgggtatcctctctagc

SEQ ID NO: 3173 - DNA, 20 bp, Artificial Sequence
  Primer
gaacgcgtttcttcaagagg

SEQ ID NO: 3174 - DNA, 20 bp, Artificial Sequence
  Primer
ggatctagggtggtttcttg

SEQ ID NO: 3175 - DNA, 20 bp, Artificial Sequence
  Primer
cgctacattgtgattgtccc

SEQ ID NO: 3176 - DNA, 20 bp, Artificial Sequence
  Primer
ggctttgccaggatttgaag

SEQ ID NO: 3177 - DNA, 20 bp, Artificial Sequence
  Primer
ccgagagatgcttttgcaga

SEQ ID NO: 3178 - DNA, 20 bp, Artificial Sequence
  Primer
gggaagaaggtggagaagaa

SEQ ID NO: 3179 - DNA, 20 bp, Artificial Sequence
  Primer
gcgtaagaccatgttcgaga

SEQ ID NO: 3180 - DNA, 20 bp, Artificial Sequence
  Primer
cgaacagctcagttacgagt

SEQ ID NO: 3181 - DNA, 20 bp, Artificial Sequence
  Primer
agagtattctagacctgtct

SEQ ID NO: 3182 - DNA, 20 bp, Artificial Sequence
  Primer
ggaaaaactctgcagctacg

SEQ ID NO: 3183 - DNA, 20 bp, Artificial Sequence
  Primer
ctctctgctctccatcatac

SEQ ID NO: 3184 - DNA, 20 bp, Artificial Sequence
  Primer
cgttctcgatgatggctatg

SEQ ID NO: 3185 - DNA, 20 bp, Artificial Sequence
  Primer
gcttttgctgcacagtcacg

SEQ ID NO: 3186 - DNA, 20 bp, Artificial Sequence
  Primer
ccaggcgcttctctttgaaa

SEQ ID NO: 3187 - DNA, 20 bp, Artificial Sequence
  Primer
cgggcacttccctctatagc

SEQ ID NO: 3188 - DNA, 20 bp, Artificial Sequence
  Primer
agccttatgtgctcctggtc

SEQ ID NO: 3189 - DNA, 20 bp, Artificial Sequence
  Primer
gttggcacggggagtggtat

SEQ ID NO: 3190 - DNA, 20 bp, Artificial Sequence
  Primer
cccatgtaaagcaccttgcg

SEQ ID NO: 3191 - DNA, 20 bp, Artificial Sequence
  Primer
cgcttctctgatctttggga

SEQ ID NO: 3192 - DNA, 20 bp, Artificial Sequence
  Primer
ccgtcaaaaacgatggcaac

SEQ ID NO: 3193 - DNA, 20 bp, Artificial Sequence
  Primer
gctggatagattggataggg

SEQ ID NO: 3194 - DNA, 20 bp, Artificial Sequence
  Primer
cgatacctcctatgcaccaa

SEQ ID NO: 3195 - DNA, 20 bp, Artificial Sequence
  Primer
ggagagacttttgctccacc

SEQ ID NO: 3196 - DNA, 20 bp, Artificial Sequence
  Primer
gtccaatcagagtaagctgg

SEQ ID NO: 3197 - DNA, 20 bp, Artificial Sequence
  Primer
caaggggtgagcatccaaaa

SEQ ID NO: 3198 - DNA, 20 bp, Artificial Sequence
  Primer
gggagtggaaaaagaatgcg

SEQ ID NO: 3199 - DNA, 20 bp, Artificial Sequence
  Primer
ggggtaggggaactgagata

SEQ ID NO: 3200 - DNA, 20 bp, Artificial Sequence
  Primer
gaggggtgctcataggatta

SEQ ID NO: 3201 - DNA, 20 bp, Artificial Sequence
  Primer
ccctctttcgcaagatttcc

SEQ ID NO: 3202 - DNA, 20 bp, Artificial Sequence
  Primer
ggcgcatgattttatgagcc

SEQ ID NO: 3203 - DNA, 20 bp, Artificial Sequence
  Primer
gagctgagagtttgcgctaa

SEQ ID NO: 3204 - DNA, 20 bp, Artificial Sequence
  Primer
ttaatgccggcgattggact

SEQ ID NO: 3205 - DNA, 20 bp, Artificial Sequence
  Primer
tgagatggaggatccttgtg

SEQ ID NO: 3206 - DNA, 20 bp, Artificial Sequence
  Primer
catccgtaagaacatccggt

SEQ ID NO: 3207 - DNA, 20 bp, Artificial Sequence
  Primer
gcttggggattgcaaatcag

SEQ ID NO: 3208 - DNA, 20 bp, Artificial Sequence
  Primer
ggtctgggcaatggaaatga

SEQ ID NO: 3209 - DNA, 20 bp, Artificial Sequence
  Primer
ccagcacaggtttacccttt

SEQ ID NO: 3210 - DNA, 20 bp, Artificial Sequence
  Primer
aaagtcccgggagacgcaaa

SEQ ID NO: 3211 - DNA, 20 bp, Artificial Sequence
  Primer
ccgctgaatggaaaaaggct

SEQ ID NO: 3212 - DNA, 20 bp, Artificial Sequence
  Primer
gcgaagcccatgaagatgag

SEQ ID NO: 3213 - DNA, 20 bp, Artificial Sequence
  Primer
gcatacgcgctatgttgagt

SEQ ID NO: 3214 - DNA, 20 bp, Artificial Sequence
  Primer
gatcttgaagactattctcc

SEQ ID NO: 3215 - DNA, 20 bp, Artificial Sequence
  Primer
cagaaatgcgaaagcctgct

SEQ ID NO: 3216 - DNA, 20 bp, Artificial Sequence
  Primer
cctcggactattacgcaaga

SEQ ID NO: 3217 - DNA, 20 bp, Artificial Sequence
  Primer
ccttctctcaggacttctgt

SEQ ID NO: 3218 - DNA, 20 bp, Artificial Sequence
  Primer
ctcctttcgatagcaatgcg

SEQ ID NO: 3219 - DNA, 20 bp, Artificial Sequence
  Primer
caggtaacgtgggattatag

SEQ ID NO: 3220 - DNA, 20 bp, Artificial Sequence
  Primer
gcgctaggatttaccagaag

SEQ ID NO: 3221 - DNA, 20 bp, Artificial Sequence
  Primer
cgggatacgtaggtggcgta

SEQ ID NO: 3222 - DNA, 20 bp, Artificial Sequence
  Primer
gatgagttggggtatttagc

SEQ ID NO: 3223 - DNA, 20 bp, Artificial Sequence
  Primer
gctgcatgaaagcagagttc

SEQ ID NO: 3224 - DNA, 20 bp, Artificial Sequence
  Primer
gagcagatcacaagaaaggg

SEQ ID NO: 3225 - DNA, 20 bp, Artificial Sequence
  Primer
ctggcaaggaaaatagctct

SEQ ID NO: 3226 - DNA, 20 bp, Artificial Sequence
  Primer
gttctctgtgaacctacaga

SEQ ID NO: 3227 - DNA, 20 bp, Artificial Sequence
  Primer
tgcgcatgtatatgcgatgg

SEQ ID NO: 3228 - DNA, 20 bp, Artificial Sequence
  Primer
gtcgtcattgactagggatg

SEQ ID NO: 3229 - DNA, 20 bp, Artificial Sequence
  Primer
taacagattcagcggtacgg

SEQ ID NO: 3230 - DNA, 20 bp, Artificial Sequence
  Primer
ggtcccaatttccgttagga

SEQ ID NO: 3231 - DNA, 20 bp, Artificial Sequence
  Primer
ggggcatgttatgtgcctaa

SEQ ID NO: 3232 - DNA, 20 bp, Artificial Sequence
  Primer
gccgaagtggttgatgatgt

SEQ ID NO: 3233 - DNA, 20 bp, Artificial Sequence
  Primer
gacagaggcattcttgtctg

SEQ ID NO: 3234 - DNA, 20 bp, Artificial Sequence
  Primer
cgagacgcagtatctgtgta

SEQ ID NO: 3235 - DNA, 20 bp, Artificial Sequence
  Primer
gctagggatatgatcgcttg

SEQ ID NO: 3236 - DNA, 20 bp, Artificial Sequence
  Primer
ggccttgatatgccagttct

SEQ ID NO: 3237 - DNA, 20 bp, Artificial Sequence
  Primer
acagcattaccgggtaacgt

SEQ ID NO: 3238 - DNA, 20 bp, Artificial Sequence
  Primer
tatgcgcaacgatcgattcg

SEQ ID NO: 3239 - DNA, 20 bp, Artificial Sequence
  Primer
gtcagaaggttgttcggtga

SEQ ID NO: 3240 - DNA, 20 bp, Artificial Sequence
  Primer
cacggaaaagcctgttagtg

SEQ ID NO: 3241 - DNA, 20 bp, Artificial Sequence
  Primer
ctgagggtgaggtccaaaat

SEQ ID NO: 3242 - DNA, 20 bp, Artificial Sequence
  Primer
aggcgatctccatagaaagc

SEQ ID NO: 3243 - DNA, 20 bp, Artificial Sequence
  Primer
catcagaaagcgtgacaagg

SEQ ID NO: 3244 - DNA, 20 bp, Artificial Sequence
  Primer
ctgtaagacaggtcagagca

SEQ ID NO: 3245 - DNA, 20 bp, Artificial Sequence
  Primer
gcggtcagttgctaattggt

SEQ ID NO: 3246 - DNA, 20 bp, Artificial Sequence
  Primer
ggccataacacgtctgttac

SEQ ID NO: 3247 - DNA, 20 bp, Artificial Sequence
  Primer
cacggaaaagcctgttagtg

SEQ ID NO: 3248 - DNA, 20 bp, Artificial Sequence
  Primer
cctctgaatgtagaaaccag

SEQ ID NO: 3249 - DNA, 20 bp, Artificial Sequence
  Primer
cggcccatctatagtgatga

SEQ ID NO: 3250 - DNA, 20 bp, Artificial Sequence
  Primer
ctcttgtcattgagagggct

SEQ ID NO: 3251 - DNA, 20 bp, Artificial Sequence
  Primer
cgctgacacaaatcgctttg

SEQ ID NO: 3252 - DNA, 20 bp, Artificial Sequence
  Primer
gctggatcagaacagaaagg

SEQ ID NO: 3253 - DNA, 20 bp, Artificial Sequence
  Primer
tctcgaggcgagcatgtttt

SEQ ID NO: 3254 - DNA, 20 bp, Artificial Sequence
  Primer
ccggaagttctactacttct

SEQ ID NO: 3255 - DNA, 20 bp, Artificial Sequence
  Primer
cgagcatgttttgcggtttg

SEQ ID NO: 3256 - DNA, 20 bp, Artificial Sequence
  Primer
cgttgggggaggttctattt

SEQ ID NO: 3257 - DNA, 20 bp, Artificial Sequence
  Primer
cgtgtagcagtcgagaagtt

SEQ ID NO: 3258 - DNA, 20 bp, Artificial Sequence
  Primer
tgcgattgctcaagtgctca

SEQ ID NO: 3259 - DNA, 20 bp, Artificial Sequence
  Primer
agatggctacgtgatcagcg

SEQ ID NO: 3260 - DNA, 20 bp, Artificial Sequence
  Primer
gagaggacaaaatctctcct

SEQ ID NO: 3261 - DNA, 20 bp, Artificial Sequence
  Primer
ggtagtttatcctcccttgg

SEQ ID NO: 3262 - DNA, 20 bp, Artificial Sequence
  Primer
ctccggaattccggaggggg

SEQ ID NO: 3263 - DNA, 20 bp, Artificial Sequence
  Primer
gtatcgtcgaccaatctagg

SEQ ID NO: 3264 - DNA, 20 bp, Artificial Sequence
  Primer
gggcagcagtagctacaata

SEQ ID NO: 3265 - DNA, 20 bp, Artificial Sequence
  Primer
ctctctggtatcgtttagga

SEQ ID NO: 3266 - DNA, 20 bp, Artificial Sequence
  Primer
aggggatacgcaccaagatg

SEQ ID NO: 3267 - DNA, 20 bp, Artificial Sequence
  Primer
cagtactctggggtacagag

SEQ ID NO: 3268 - DNA, 20 bp, Artificial Sequence
  Primer
ggaagcgattctttcttccg

SEQ ID NO: 3269 - DNA, 20 bp, Artificial Sequence
  Primer
aagacgtagacggtggttgc

SEQ ID NO: 3270 - DNA, 20 bp, Artificial Sequence
  Primer
gtgtagactccctgctcaca

SEQ ID NO: 3271 - DNA, 20 bp, Artificial Sequence
  Primer
cctacccacaacagatgtag

SEQ ID NO: 3272 - DNA, 20 bp, Artificial Sequence
  Primer
tgccatagatggggtagtgg

SEQ ID NO: 3273 - DNA, 20 bp, Artificial Sequence
  Primer
caggattcttgctttggcag

SEQ ID NO: 3274 - DNA, 20 bp, Artificial Sequence
  Primer
ggcaataccggagttgaaat

SEQ ID NO: 3275 - DNA, 20 bp, Artificial Sequence
  Primer
cctggagtgtttgtgcaaca

SEQ ID NO: 3276 - DNA, 20 bp, Artificial Sequence
  Primer
acatcgtccgaggtgcttta

SEQ ID NO: 3277 - DNA, 20 bp, Artificial Sequence
  Primer
acacgaaggctacccgtttt

SEQ ID NO: 3278 - DNA, 20 bp, Artificial Sequence
  Primer
agttcctgttgaagtggctc

SEQ ID NO: 3279 - DNA, 20 bp, Artificial Sequence
  Primer
cgtaggaaagaagaagatcg

SEQ ID NO: 3280 - DNA, 20 bp, Artificial Sequence
  Primer
cggatcgatggctgtaaaag

SEQ ID NO: 3281 - DNA, 20 bp, Artificial Sequence
  Primer
ggaagtcggtcttgctaatg

SEQ ID NO: 3282 - DNA, 20 bp, Artificial Sequence
  Primer
caactcgatcagtctacagc

SEQ ID NO: 3283 - DNA, 20 bp, Artificial Sequence
  Primer
ctgggcacgttgactttact

SEQ ID NO: 3284 - DNA, 20 bp, Artificial Sequence
  Primer
gctgattgcacagaagagac

SEQ ID NO: 3285 - DNA, 20 bp, Artificial Sequence
  Primer
gtcagtaagatcgtcggagg

SEQ ID NO: 3286 - DNA, 20 bp, Artificial Sequence
  Primer
gatgagggagatctcttgtg

SEQ ID NO: 3287 - DNA, 20 bp, Artificial Sequence
  Primer
cgctgtgttagtttccaagg

SEQ ID NO: 3288 - DNA, 20 bp, Artificial Sequence
  Primer
cctggacgtattgcagaaga

SEQ ID NO: 3289 - DNA, 20 bp, Artificial Sequence
  Primer
agagtgaggatagagtaggg

SEQ ID NO: 3290 - DNA, 20 bp, Artificial Sequence
  Primer
ggtattcgattagggactcc

SEQ ID NO: 3291 - DNA, 20 bp, Artificial Sequence
  Primer
ttggctttggggagaaaggc

SEQ ID NO: 3292 - DNA, 20 bp, Artificial Sequence
  Primer
gttccaggaagacgttttgc

SEQ ID NO: 3293 - DNA, 20 bp, Artificial Sequence
  Primer
gtcttggaagcatcgtttct

SEQ ID NO: 3294 - DNA, 20 bp, Artificial Sequence
  Primer
cgagatatgtggatgagtgc

SEQ ID NO: 3295 - DNA, 20 bp, Artificial Sequence
  Primer
gcatcagtggcctatttagc

SEQ ID NO: 3296 - DNA, 20 bp, Artificial Sequence
  Primer
gggacagggatgttggcaag

SEQ ID NO: 3297 - DNA, 20 bp, Artificial Sequence
  Primer
ggctcatttcgcaggcttgg

SEQ ID NO: 3298 - DNA, 20 bp, Artificial Sequence
  Primer
gcggatcggtattgcttgat

SEQ ID NO: 3299 - DNA, 20 bp, Artificial Sequence
  Primer
cagtgccgaaatggaagaag

SEQ ID NO: 3300 - DNA, 20 bp, Artificial Sequence
  Primer
cgtctggaagaccagttgaa

SEQ ID NO: 3301 - DNA, 20 bp, Artificial Sequence
  Primer
cctcatgcgcgcattatgat

SEQ ID NO: 3302 - DNA, 20 bp, Artificial Sequence
  Primer
ggagctgaggggtggcgttt

SEQ ID NO: 3303 - DNA, 20 bp, Artificial Sequence
  Primer
ctggtatgccggaacaagta

SEQ ID NO: 3304 - DNA, 20 bp, Artificial Sequence
  Primer
cgctatatgaggagcttcct

SEQ ID NO: 3305 - DNA, 20 bp, Artificial Sequence
  Primer
atgcgcgagagcagtttcag

SEQ ID NO: 3306 - DNA, 20 bp, Artificial Sequence
  Primer
cgagctggaagagtcgtcat

SEQ ID NO: 3307 - DNA, 20 bp, Artificial Sequence
  Primer
ccaagctatatgcaagccta

SEQ ID NO: 3308 - DNA, 20 bp, Artificial Sequence
  Primer
ggagtattgctgttgatcgg

SEQ ID NO: 3309 - DNA, 20 bp, Artificial Sequence
  Primer
ctgctacagaggttaacgca

SEQ ID NO: 3310 - DNA, 20 bp, Artificial Sequence
  Primer
gcgctgatgtaaagacctct

SEQ ID NO: 3311 - DNA, 20 bp, Artificial Sequence
  Primer
ctcggacttcatcgactaag

SEQ ID NO: 3312 - DNA, 20 bp, Artificial Sequence
  Primer
cctgtttggccttgttcttc

SEQ ID NO: 3313 - DNA, 20 bp, Artificial Sequence
  Primer
ggagtattgctgttgatcgg

SEQ ID NO: 3314 - DNA, 20 bp, Artificial Sequence
  Primer
gctacggtcagagcaagata

SEQ ID NO: 3315 - DNA, 20 bp, Artificial Sequence
  Primer
gctgggggattgagattaac

SEQ ID NO: 3316 - DNA, 20 bp, Artificial Sequence
  Primer
ccgtatgctgaaatagaggc

SEQ ID NO: 3317 - DNA, 20 bp, Artificial Sequence
  Primer
atctcccagtctatagggcg

SEQ ID NO: 3318 - DNA, 20 bp, Artificial Sequence
  Primer
ctacggcgagcttgtttact

SEQ ID NO: 3319 - DNA, 20 bp, Artificial Sequence
  Primer
gccaccaagagtatcgtaac

SEQ ID NO: 3320 - DNA, 20 bp, Artificial Sequence
  Primer
cgctaatggcgtttagagag

SEQ ID NO: 3321 - DNA, 20 bp, Artificial Sequence
  Primer
atgcagtaaggagtggacga

SEQ ID NO: 3322 - DNA, 20 bp, Artificial Sequence
  Primer
cgtcgaactgttggatggaa

SEQ ID NO: 3323 - DNA, 20 bp, Artificial Sequence
  Primer
tacaggagtcttaagaagcc

SEQ ID NO: 3324 - DNA, 20 bp, Artificial Sequence
  Primer
cgaatcaaagcgtcttgggt

SEQ ID NO: 3325 - DNA, 20 bp, Artificial Sequence
  Primer
gggcttgcgtttttttggac

SEQ ID NO: 3326 - DNA, 20 bp, Artificial Sequence
  Primer
tcgcttggttgaactggaac

SEQ ID NO: 3327 - DNA, 20 bp, Artificial Sequence
  Primer
caagtctaaggaaagctcgg

SEQ ID NO: 3328 - DNA, 20 bp, Artificial Sequence
  Primer
ggcatattgaacgtacgcga

SEQ ID NO: 3329 - DNA, 20 bp, Artificial Sequence
  Primer
gaacggtctatagaagaggg

SEQ ID NO: 3330 - DNA, 20 bp, Artificial Sequence
  Primer
agccccgtgtagtggggata

SEQ ID NO: 3331 - DNA, 20 bp, Artificial Sequence
  Primer
agggagcaagccgtaacggt

SEQ ID NO: 3332 - DNA, 20 bp, Artificial Sequence
  Primer
gatagagggcgatgatcttg

SEQ ID NO: 3333 - DNA, 20 bp, Artificial Sequence
  Primer
gaggaggtaaggggaatgtt

SEQ ID NO: 3334 - DNA, 20 bp, Artificial Sequence
  Primer
acgcttggaaagcgtgtgtg

SEQ ID NO: 3335 - DNA, 20 bp, Artificial Sequence
  Primer
gcgggaacaaagaacagaga

SEQ ID NO: 3336 - DNA, 20 bp, Artificial Sequence
  Primer
gtagtaggagccagactcta

SEQ ID NO: 3337 - DNA, 20 bp, Artificial Sequence
  Primer
agagctgtcagccatcctaa

SEQ ID NO: 3338 - DNA, 20 bp, Artificial Sequence
  Primer
gtgggataagagcgatccaa

SEQ ID NO: 3339 - DNA, 20 bp, Artificial Sequence
  Primer
gaagctcggtatttggcttc

SEQ ID NO: 3340 - DNA, 20 bp, Artificial Sequence
  Primer
gcagcaaatacagcagtagc

SEQ ID NO: 3341 - DNA, 20 bp, Artificial Sequence
  Primer
ccttctactggaggaatctc

SEQ ID NO: 3342 - DNA, 20 bp, Artificial Sequence
  Primer
gcagaactagcttgtgtagc

SEQ ID NO: 3343 - DNA, 20 bp, Artificial Sequence
  Primer
ggttctagttggcactccgc

SEQ ID NO: 3344 - DNA, 20 bp, Artificial Sequence
  Primer
gtggagacactgttccccga

SEQ ID NO: 3345 - DNA, 20 bp, Artificial Sequence
  Primer
ctccatagacagaagcttgg

SEQ ID NO: 3346 - DNA, 20 bp, Artificial Sequence
  Primer
ggctgttctgcagtatccgc

SEQ ID NO: 3347 - DNA, 20 bp, Artificial Sequence
  Primer
gagtccccatactggaaaga

SEQ ID NO: 3348 - DNA, 20 bp, Artificial Sequence
  Primer
tatcactgctgcaccgtgct

SEQ ID NO: 3349 - DNA, 20 bp, Artificial Sequence
  Primer
ctaggggatgcagttgttac

SEQ ID NO: 3350 - DNA, 20 bp, Artificial Sequence
  Primer
gcaaacgctgcctgtaacaa

SEQ ID NO: 3351 - DNA, 20 bp, Artificial Sequence
  Primer
ggatcggaaatgaaggtgct

SEQ ID NO: 3352 - DNA, 20 bp, Artificial Sequence
  Primer
ggaggaacagcaatttctcc

SEQ ID NO: 3353 - DNA, 20 bp, Artificial Sequence
  Primer
gttgccctggtctccttcta

SEQ ID NO: 3354 - DNA, 20 bp, Artificial Sequence
  Primer
gctaatgtagtcttcggaag

SEQ ID NO: 3355 - DNA, 20 bp, Artificial Sequence
  Primer
ggagctctcttttgtgctca

SEQ ID NO: 3356 - DNA, 20 bp, Artificial Sequence
  Primer
ggagaagattgtgatgacgc

SEQ ID NO: 3357 - DNA, 20 bp, Artificial Sequence
  Primer
ggggatctaatggaaggatg

SEQ ID NO: 3358 - DNA, 20 bp, Artificial Sequence
  Primer
ccacaatccgtgcgattttc

SEQ ID NO: 3359 - DNA, 20 bp, Artificial Sequence
  Primer
ggttggacaaactagtttgg

SEQ ID NO: 3360 - DNA, 20 bp, Artificial Sequence
  Primer
gtcgtattgtagcgtgcaga

SEQ ID NO: 3361 - DNA, 20 bp, Artificial Sequence
  Primer
gctctctagaggctgttttc

SEQ ID NO: 3362 - DNA, 20 bp, Artificial Sequence
  Primer
cttgcttgcaaggtaagagg

SEQ ID NO: 3363 - DNA, 20 bp, Artificial Sequence
  Primer
gagtggcaatagtatgacgg

SEQ ID NO: 3364 - DNA, 20 bp, Artificial Sequence
  Primer
tccctggctcagtgaaatca

SEQ ID NO: 3365 - DNA, 20 bp, Artificial Sequence
  Primer
aggttctctgagccttacag

SEQ ID NO: 3366 - DNA, 20 bp, Artificial Sequence
  Primer
gtagcagagagagcttacag

SEQ ID NO: 3367 - DNA, 20 bp, Artificial Sequence
  Primer
gagctgctgtgagacactcc

SEQ ID NO: 3368 - DNA, 20 bp, Artificial Sequence
  Primer
acgcctgaagagattagagc

SEQ ID NO: 3369 - DNA, 20 bp, Artificial Sequence
  Primer
tggggagagagctttcagtt

SEQ ID NO: 3370 - DNA, 20 bp, Artificial Sequence
  Primer
gcggctgaggggttgagaaa

SEQ ID NO: 3371 - DNA, 20 bp, Artificial Sequence
  Primer
acgcctgaagagattagagc

SEQ ID NO: 3372 - DNA, 20 bp, Artificial Sequence
  Primer
ctgaagaaaaagctcgcggt

SEQ ID NO: 3373 - DNA, 20 bp, Artificial Sequence
  Primer
gcggtttgtaagaggtcgta

SEQ ID NO: 3374 - DNA, 20 bp, Artificial Sequence
  Primer
gccctgtggctttagaagaa

SEQ ID NO: 3375 - DNA, 20 bp, Artificial Sequence
  Primer
cattcggaagaatggggagt

SEQ ID NO: 3376 - DNA, 20 bp, Artificial Sequence
  Primer
ccagggcaagaaagtgagta

SEQ ID NO: 3377 - DNA, 20 bp, Artificial Sequence
  Primer
ctggtcacgctgactatgtt

SEQ ID NO: 3378 - DNA, 20 bp, Artificial Sequence
  Primer
tcggacttggagcgtgtaat

SEQ ID NO: 3379 - DNA, 20 bp, Artificial Sequence
  Primer
cgattatcatctccgagagg

SEQ ID NO: 3380 - DNA, 20 bp, Artificial Sequence
  Primer
gcagcctgttgaaagaaagc

SEQ ID NO: 3381 - DNA, 20 bp, Artificial Sequence
  Primer
cagagaaggtcgcgaataag

SEQ ID NO: 3382 - DNA, 20 bp, Artificial Sequence
  Primer
cgggttgtacttacttctcc

SEQ ID NO: 3383 - DNA, 20 bp, Artificial Sequence
  Primer
ctgaggactgctactgtcca

SEQ ID NO: 3384 - DNA, 20 bp, Artificial Sequence
  Primer
cacctagagcacaagcgtta

SEQ ID NO: 3385 - DNA, 20 bp, Artificial Sequence
  Primer
ctgccgaaggttgtgtgatt

SEQ ID NO: 3386 - DNA, 20 bp, Artificial Sequence
  Primer
cgagtagtggttcaaacgac

SEQ ID NO: 3387 - DNA, 20 bp, Artificial Sequence
  Primer
cctactgggatttctgtgga

SEQ ID NO: 3388 - DNA, 20 bp, Artificial Sequence
  Primer
ggatgccaatctcccttttc

SEQ ID NO: 3389 - DNA, 20 bp, Artificial Sequence
  Primer
tgaggaacatcggagtaagc

SEQ ID NO: 3390 - DNA, 20 bp, Artificial Sequence
  Primer
aatgcctccatgattcgtgg

SEQ ID NO: 3391 - DNA, 20 bp, Artificial Sequence
  Primer
gggttagcgatatttgctcc

SEQ ID NO: 3392 - DNA, 20 bp, Artificial Sequence
  Primer
ctcctggagaaaaaccgcaa

SEQ ID NO: 3393 - DNA, 20 bp, Artificial Sequence
  Primer
catatccttgagggccaaca

SEQ ID NO: 3394 - DNA, 20 bp, Artificial Sequence
  Primer
tgctttccgttggttacgtc

SEQ ID NO: 3395 - DNA, 20 bp, Artificial Sequence
  Primer
ggcatcgtctgcaatgatag

SEQ ID NO: 3396 - DNA, 20 bp, Artificial Sequence
  Primer
cccagcctatgacgtattga

SEQ ID NO: 3397 - DNA, 20 bp, Artificial Sequence
  Primer
gagaaacaaccatgctgcgg

SEQ ID NO: 3398 - DNA, 20 bp, Artificial Sequence
  Primer
ctgggctcgtataaaacagc

SEQ ID NO: 3399 - DNA, 20 bp, Artificial Sequence
  Primer
cacgcgattgaatgatacgc

SEQ ID NO: 3400 - DNA, 20 bp, Artificial Sequence
  Primer
gatatgccgtaccttctcgt

SEQ ID NO: 3401 - DNA, 20 bp, Artificial Sequence
  Primer
gtgcctgcagcaataacaac

SEQ ID NO: 3402 - DNA, 20 bp, Artificial Sequence
  Primer
ttggttgtgcagctttgctg

SEQ ID NO: 3403 - DNA, 20 bp, Artificial Sequence
  Primer
gcttctatgtgcgtgatagc

SEQ ID NO: 3404 - DNA, 20 bp, Artificial Sequence
  Primer
gggtcactgtaaatcctcag

SEQ ID NO: 3405 - DNA, 20 bp, Artificial Sequence
  Primer
ctctgatttgcttgctgcgt

SEQ ID NO: 3406 - DNA, 20 bp, Artificial Sequence
  Primer
gcagacagcttggatttgac

SEQ ID NO: 3407 - DNA, 20 bp, Artificial Sequence
  Primer
cactgtcctttcgagcctat

SEQ ID NO: 3408 - DNA, 20 bp, Artificial Sequence
  Primer
gggcgaactcgtgacgacaa

SEQ ID NO: 3409 - DNA, 20 bp, Artificial Sequence
  Primer
cccacctttatgcgaagaca

SEQ ID NO: 3410 - DNA, 20 bp, Artificial Sequence
  Primer
gttcgctacttcagatccag

SEQ ID NO: 3411 - DNA, 20 bp, Artificial Sequence
  Primer
ccaacatcttggagggcgtt

SEQ ID NO: 3412 - DNA, 20 bp, Artificial Sequence
  Primer
ccaaaaggaaacgccttgct

SEQ ID NO: 3413 - DNA, 20 bp, Artificial Sequence
  Primer
ccgcttagtttaatagggcg

SEQ ID NO: 3414 - DNA, 20 bp, Artificial Sequence
  Primer
gcgagaagctaattcaggga

SEQ ID NO: 3415 - DNA, 20 bp, Artificial Sequence
  Primer
gctcagtcagagcttcttct

SEQ ID NO: 3416 - DNA, 20 bp, Artificial Sequence
  Primer
ctaacgtagctgaggaaacc

SEQ ID NO: 3417 - DNA, 20 bp, Artificial Sequence
  Primer
gctgcgaatgcacaggataa

SEQ ID NO: 3418 - DNA, 20 bp, Artificial Sequence
  Primer
ctctctaccacagaggaatc

SEQ ID NO: 3419 - DNA, 20 bp, Artificial Sequence
  Primer
aagtggagcttcagaacggc

SEQ ID NO: 3420 - DNA, 20 bp, Artificial Sequence
  Primer
ggcaactcctgaagtacttg

SEQ ID NO: 3421 - DNA, 20 bp, Artificial Sequence
  Primer
cgctttttcccatattcgag

SEQ ID NO: 3422 - DNA, 20 bp, Artificial Sequence
  Primer
gtgatgcatagagtttcagc

SEQ ID NO: 3423 - DNA, 20 bp, Artificial Sequence
  Primer
gagccatgtcttctttgcta

SEQ ID NO: 3424 - DNA, 20 bp, Artificial Sequence
  Primer
gaccgcaaatgtcattgtgg

SEQ ID NO: 3425 - DNA, 20 bp, Artificial Sequence
  Primer
cgggataaggtaaaggtcct

SEQ ID NO: 3426 - DNA, 20 bp, Artificial Sequence
  Primer
cctgaataccgtaagcgaag

SEQ ID NO: 3427 - DNA, 20 bp, Artificial Sequence
  Primer
ggcacttttcatctagacgc

SEQ ID NO: 3428 - DNA, 20 bp, Artificial Sequence
  Primer
ctagctcttccatcaactgc

SEQ ID NO: 3429 - DNA, 20 bp, Artificial Sequence
  Primer
ctcttaccaagaggtaagcc

SEQ ID NO: 3430 - DNA, 20 bp, Artificial Sequence
  Primer
tccacaaatccatgtccgag

SEQ ID NO: 3431 - DNA, 20 bp, Artificial Sequence
  Primer
cattccggatgctgaacttc

SEQ ID NO: 3432 - DNA, 20 bp, Artificial Sequence
  Primer
cggtagtcttcttctgtagg

SEQ ID NO: 3433 - DNA, 20 bp, Artificial Sequence
  Primer
gtactcataggctgaggtgt

SEQ ID NO: 3434 - DNA, 20 bp, Artificial Sequence
  Primer
ccacaaggacaaggatcgtt

SEQ ID NO: 3435 - DNA, 20 bp, Artificial Sequence
  Primer
ccgtcctacctcctttaaca

SEQ ID NO: 3436 - DNA, 20 bp, Artificial Sequence
  Primer
ggatactagcaggttcgtgt

SEQ ID NO: 3437 - DNA, 20 bp, Artificial Sequence
  Primer
cccgttccttcttctgtact

SEQ ID NO: 3438 - DNA, 20 bp, Artificial Sequence
  Primer
cgttgtgcatcctggagaaa

SEQ ID NO: 3439 - DNA, 20 bp, Artificial Sequence
  Primer
cccgcataccaaagaaatgc

SEQ ID NO: 3440 - DNA, 20 bp, Artificial Sequence
  Primer
aaggcttgccaatcacatcg

SEQ ID NO: 3441 - DNA, 20 bp, Artificial Sequence
  Primer
gcaagctcagttttccctac

SEQ ID NO: 3442 - DNA, 20 bp, Artificial Sequence
  Primer
cccctccaaatatccctaac

SEQ ID NO: 3443 - DNA, 20 bp, Artificial Sequence
  Primer
tcccatggatgccagtttcg

SEQ ID NO: 3444 - DNA, 20 bp, Artificial Sequence
  Primer
gctgataccttccaaacgct

SEQ ID NO: 3445 - DNA, 20 bp, Artificial Sequence
  Primer
gtagaaagagaaggaccagc

SEQ ID NO: 3446 - DNA, 20 bp, Artificial Sequence
  Primer
acgcccaatcacttgagcta

SEQ ID NO: 3447 - DNA, 20 bp, Artificial Sequence
  Primer
ggtatctctcccaaactctc

SEQ ID NO: 3448 - DNA, 20 bp, Artificial Sequence
  Primer
gcaccacaaaacaaacccct

SEQ ID NO: 3449 - DNA, 20 bp, Artificial Sequence
  Primer
ctagcttgcgactgcttctt

SEQ ID NO: 3450 - DNA, 20 bp, Artificial Sequence
  Primer
tgctgctcaaccagaagcta

SEQ ID NO: 3451 - DNA, 20 bp, Artificial Sequence
  Primer
gtgctctcaccattcgttgt

SEQ ID NO: 3452 - DNA, 20 bp, Artificial Sequence
  Primer
ctcctaacaacacccaactc

SEQ ID NO: 3453 - DNA, 20 bp, Artificial Sequence
  Primer
ggactcgctcactcctaaaa

SEQ ID NO: 3454 - DNA, 20 bp, Artificial Sequence
  Primer
cctagcaaagtctgaatcca

SEQ ID NO: 3455 - DNA, 20 bp, Artificial Sequence
  Primer
cttgactcggagacaagtga

SEQ ID NO: 3456 - DNA, 20 bp, Artificial Sequence
  Primer
tccatccatagcagatgacg

SEQ ID NO: 3457 - DNA, 20 bp, Artificial Sequence
  Primer
cgcgccagaagaacttcttt

SEQ ID NO: 3458 - DNA, 20 bp, Artificial Sequence
  Primer
agacaacagcaacacaccga

SEQ ID NO: 3459 - DNA, 20 bp, Artificial Sequence
  Primer
gcacagctctaaattctgct

SEQ ID NO: 3460 - DNA, 20 bp, Artificial Sequence
  Primer
gccagacaatccgcaaagaa

SEQ ID NO: 3461 - DNA, 20 bp, Artificial Sequence
  Primer
agatagcacccctgctgcca

SEQ ID NO: 3462 - DNA, 20 bp, Artificial Sequence
  Primer
cgcacgttgtggattgattg

SEQ ID NO: 3463 - DNA, 20 bp, Artificial Sequence
  Primer
gcctccatacaaagcatgcg

SEQ ID NO: 3464 - DNA, 20 bp, Artificial Sequence
  Primer
actgcaccgcgaaatagcgt

SEQ ID NO: 3465 - DNA, 20 bp, Artificial Sequence
  Primer
cgggacctgaatccaaggta

SEQ ID NO: 3466 - DNA, 20 bp, Artificial Sequence
  Primer
ggcctccggctccagaagaa

SEQ ID NO: 3467 - DNA, 20 bp, Artificial Sequence
  Primer
cttgtcccatcgctaagttc

SEQ ID NO: 3468 - DNA, 20 bp, Artificial Sequence
  Primer
gcttcttgcttcctgtgaag

SEQ ID NO: 3469 - DNA, 20 bp, Artificial Sequence
  Primer
gcacatctgcaggaaaagag

SEQ ID NO: 3470 - DNA, 20 bp, Artificial Sequence
  Primer
caaggcgctttaaacactct

SEQ ID NO: 3471 - DNA, 20 bp, Artificial Sequence
  Primer
cggaaaagccagaaacctcc

SEQ ID NO: 3472 - DNA, 20 bp, Artificial Sequence
  Primer
gcttcctttaaggaaggaac

SEQ ID NO: 3473 - DNA, 20 bp, Artificial Sequence
  Primer
cccgccccggagactatgcc

SEQ ID NO: 3474 - DNA, 20 bp, Artificial Sequence
  Primer
cacgaactgccattcctttc

SEQ ID NO: 3475 - DNA, 20 bp, Artificial Sequence
  Primer
gaggaatcctcttccgattc

SEQ ID NO: 3476 - DNA, 20 bp, Artificial Sequence
  Primer
cccgatgctcataacaaacc

SEQ ID NO: 3477 - DNA, 20 bp, Artificial Sequence
  Primer
ggtataatcttgaagagggc

SEQ ID NO: 3478 - DNA, 20 bp, Artificial Sequence
  Primer
ctcctcttcaaccttctgta

SEQ ID NO: 3479 - DNA, 20 bp, Artificial Sequence
  Primer
ctcctgtagttaccctagtg

SEQ ID NO: 3480 - DNA, 20 bp, Artificial Sequence
  Primer
tgcgctgacgttactcctgt

SEQ ID NO: 3481 - DNA, 20 bp, Artificial Sequence
  Primer
ctggtgtatcctcgtctaca

SEQ ID NO: 3482 - DNA, 20 bp, Artificial Sequence
  Primer
cgaacgagaagacctatctc

SEQ ID NO: 3483 - DNA, 20 bp, Artificial Sequence
  Primer
actgcacctttcatcagagc

SEQ ID NO: 3484 - DNA, 20 bp, Artificial Sequence
  Primer
cctgcgtttagcatctaagc

SEQ ID NO: 3485 - DNA, 20 bp, Artificial Sequence
  Primer
cctctaacatgtctagcagc

SEQ ID NO: 3486 - DNA, 20 bp, Artificial Sequence
  Primer
ttggccaaaactcaggaacc

SEQ ID NO: 3487 - DNA, 20 bp, Artificial Sequence
  Primer
cttcctgtctgccaaacctt

SEQ ID NO: 3488 - DNA, 20 bp, Artificial Sequence
  Primer
gcagagccgctactctaaat

SEQ ID NO: 3489 - DNA, 20 bp, Artificial Sequence
  Primer
gggatctgctcttgttcaca

SEQ ID NO: 3490 - DNA, 20 bp, Artificial Sequence
  Primer
cgatacttcccgtagtccat

SEQ ID NO: 3491 - DNA, 20 bp, Artificial Sequence
  Primer
gccgtaaaaaccgcaaatcg

SEQ ID NO: 3492 - DNA, 20 bp, Artificial Sequence
  Primer
gcctgttgcattctgctttc

SEQ ID NO: 3493 - DNA, 20 bp, Artificial Sequence
  Primer
gacctatagctgcctgagaa

SEQ ID NO: 3494 - DNA, 20 bp, Artificial Sequence
  Primer
cctccccaataaggaagtct

SEQ ID NO: 3495 - DNA, 20 bp, Artificial Sequence
  Primer
gccgctccagacaaagaagc

SEQ ID NO: 3496 - DNA, 20 bp, Artificial Sequence
  Primer
cgcgatcatcaaaacctctg

SEQ ID NO: 3497 - DNA, 20 bp, Artificial Sequence
  Primer
tccacaggggaacacatacc

SEQ ID NO: 3498 - DNA, 20 bp, Artificial Sequence
  Primer
ccctataagagctggtctca

SEQ ID NO: 3499 - DNA, 20 bp, Artificial Sequence
  Primer
cgagatgaaaaccctttgac

SEQ ID NO: 3500 - DNA, 20 bp, Artificial Sequence
  Primer
cagaaatccaactcctcgtc

SEQ ID NO: 3501 - DNA, 20 bp, Artificial Sequence
  Primer
gaaccttctccacaactagc

SEQ ID NO: 3502 - DNA, 20 bp, Artificial Sequence
  Primer
ggactgaacatccaactcca

SEQ ID NO: 3503 - DNA, 20 bp, Artificial Sequence
  Primer
cttctgcgctttggagttct

SEQ ID NO: 3504 - DNA, 20 bp, Artificial Sequence
  Primer
gggtctctatatcgcgacta

SEQ ID NO: 3505 - DNA, 20 bp, Artificial Sequence
  Primer
tgctgaagcctgctatgccc

SEQ ID NO: 3506 - DNA, 20 bp, Artificial Sequence
  Primer
ccggtctctgcaaccctatt

SEQ ID NO: 3507 - DNA, 20 bp, Artificial Sequence
  Primer
gcagcgtctgtcaacatcat

SEQ ID NO: 3508 - DNA, 20 bp, Artificial Sequence
  Primer
tctgtactgctgagaagagc

SEQ ID NO: 3509 - DNA, 20 bp, Artificial Sequence
  Primer
aggatgtcctctcactacag

SEQ ID NO: 3510 - DNA, 20 bp, Artificial Sequence
  Primer
cctaggggactttatgaagc

SEQ ID NO: 3511 - DNA, 20 bp, Artificial Sequence
  Primer
cggttttctttagccccttg

SEQ ID NO: 3512 - DNA, 20 bp, Artificial Sequence
  Primer
gccagagcaagattaggact

SEQ ID NO: 3513 - DNA, 20 bp, Artificial Sequence
  Primer
gtacttctatccggagtacc

SEQ ID NO: 3514 - DNA, 20 bp, Artificial Sequence
  Primer
aacgtagctactcggctatg

SEQ ID NO: 3515 - DNA, 20 bp, Artificial Sequence
  Primer
tagcgaatattccgcccaag

SEQ ID NO: 3516 - DNA, 20 bp, Artificial Sequence
  Primer
cgttcgacttgcatgcctca

SEQ ID NO: 3517 - DNA, 20 bp, Artificial Sequence
  Primer
ggtgtcgctttgcataccta

SEQ ID NO: 3518 - DNA, 20 bp, Artificial Sequence
  Primer
caagagaacaagctcctttc

SEQ ID NO: 3519 - DNA, 20 bp, Artificial Sequence
  Primer
gaggctcctgaagaaaaagc

SEQ ID NO: 3520 - DNA, 20 bp, Artificial Sequence
  Primer
gaatcgttggcaccattgcg

SEQ ID NO: 3521 - DNA, 20 bp, Artificial Sequence
  Primer
gaccgcgaaggtatatcgta

SEQ ID NO: 3522 - DNA, 20 bp, Artificial Sequence
  Primer
cgaacgtagctactcggcta

SEQ ID NO: 3523 - DNA, 20 bp, Artificial Sequence
  Primer
gtaagcaatgcaaagtccgc

SEQ ID NO: 3524 - DNA, 20 bp, Artificial Sequence
  Primer
catcttcgccttctgttgct

SEQ ID NO: 3525 - DNA, 20 bp, Artificial Sequence
  Primer
cgcggcgtcgcttcgtcaga

SEQ ID NO: 3526 - DNA, 20 bp, Artificial Sequence
  Primer
ggcttctgtccctatacgaa

SEQ ID NO: 3527 - DNA, 20 bp, Artificial Sequence
  Primer
tttggctcaggctactgtag

SEQ ID NO: 3528 - DNA, 20 bp, Artificial Sequence
  Primer
cgctctcaatgaacgcatgt

SEQ ID NO: 3529 - DNA, 20 bp, Artificial Sequence
  Primer
ccgtgaagagtcgtataggt

SEQ ID NO: 3530 - DNA, 20 bp, Artificial Sequence
  Primer
caccctcttcataagcacga

SEQ ID NO: 3531 - DNA, 20 bp, Artificial Sequence
  Primer
gacatctccaaagctgcgat

SEQ ID NO: 3532 - DNA, 20 bp, Artificial Sequence
  Primer
cttcggattgcggtagatca

SEQ ID NO: 3533 - DNA, 20 bp, Artificial Sequence
  Primer
aaagccaagagaaccggaga

SEQ ID NO: 3534 - DNA, 20 bp, Artificial Sequence
  Primer
ccgatatctcccttagcaac

SEQ ID NO: 3535 - DNA, 20 bp, Artificial Sequence
  Primer
ggcttaggagaaatttctcc

SEQ ID NO: 3536 - DNA, 20 bp, Artificial Sequence
  Primer
caaacctcctgagtcatagg

SEQ ID NO: 3537 - DNA, 20 bp, Artificial Sequence
  Primer
ggagctggcatgcttagaaa

SEQ ID NO: 3538 - DNA, 20 bp, Artificial Sequence
  Primer
gcgatctgccagctttttag

SEQ ID NO: 3539 - DNA, 20 bp, Artificial Sequence
  Primer
cgcaaacaacgtttctgctc

SEQ ID NO: 3540 - DNA, 20 bp, Artificial Sequence
  Primer
tttcgcaacgacacagagac

SEQ ID NO: 3541 - DNA, 20 bp, Artificial Sequence
  Primer
cagcgtccacccatccgcac

SEQ ID NO: 3542 - DNA, 20 bp, Artificial Sequence
  Primer
gagcgcaacaatggcattgt

SEQ ID NO: 3543 - DNA, 20 bp, Artificial Sequence
  Primer
gcagatgccggaagattagc

SEQ ID NO: 3544 - DNA, 20 bp, Artificial Sequence
  Primer
ggtgccataatctctcccaa

SEQ ID NO: 3545 - DNA, 20 bp, Artificial Sequence
  Primer
gccgaggtttttggagaagc

SEQ ID NO: 3546 - DNA, 20 bp, Artificial Sequence
  Primer
cctccagtaaggcaaacaag

SEQ ID NO: 3547 - DNA, 20 bp, Artificial Sequence
  Primer
ccagtgatgatgaggatggt

SEQ ID NO: 3548 - DNA, 20 bp, Artificial Sequence
  Primer
ggatgccacgctacaattga

SEQ ID NO: 3549 - DNA, 20 bp, Artificial Sequence
  Primer
cagggacagcggctttttat

SEQ ID NO: 3550 - DNA, 20 bp, Artificial Sequence
  Primer
tgaccccatcactcaggaaa

SEQ ID NO: 3551 - DNA, 20 bp, Artificial Sequence
  Primer
gttctggagagagtattggg

SEQ ID NO: 3552 - DNA, 20 bp, Artificial Sequence
  Primer
gttgcaagacaaaacgcagg

SEQ ID NO: 3553 - DNA, 20 bp, Artificial Sequence
  Primer
cgtggtgcaaggaaatcaag

SEQ ID NO: 3554 - DNA, 20 bp, Artificial Sequence
  Primer
ctggtcagcatggcgtattt

SEQ ID NO: 3555 - DNA, 20 bp, Artificial Sequence
  Primer
ggacgaagatactggcctat

SEQ ID NO: 3556 - DNA, 20 bp, Artificial Sequence
  Primer
ttctaacaaacggcggtgac

SEQ ID NO: 3557 - DNA, 20 bp, Artificial Sequence
  Primer
acgggcagcacagaaggcaa

SEQ ID NO: 3558 - DNA, 20 bp, Artificial Sequence
  Primer
ccaaggcgtttagaagtagc

SEQ ID NO: 3559 - DNA, 20 bp, Artificial Sequence
  Primer
gtgagaagggcggcaagcca

SEQ ID NO: 3560 - DNA, 20 bp, Artificial Sequence
  Primer
gctgtagaagatacgcactc

SEQ ID NO: 3561 - DNA, 20 bp, Artificial Sequence
  Primer
ccaaggcgtttagaagtagc

SEQ ID NO: 3562 - DNA, 20 bp, Artificial Sequence
  Primer
catgagaggccagtatagag

SEQ ID NO: 3563 - DNA, 20 bp, Artificial Sequence
  Primer
gcatgtgataagggtggatg

SEQ ID NO: 3564 - DNA, 20 bp, Artificial Sequence
  Primer
tgggaatcgagaacttgccc

SEQ ID NO: 3565 - DNA, 20 bp, Artificial Sequence
  Primer
ccagctgtataaccgatcac

SEQ ID NO: 3566 - DNA, 20 bp, Artificial Sequence
  Primer
cggaacaaatggaggacggc

SEQ ID NO: 3567 - DNA, 20 bp, Artificial Sequence
  Primer
gggatcctttcgcaggtatt

SEQ ID NO: 3568 - DNA, 20 bp, Artificial Sequence
  Primer
gatcgcagaatctatccggc

SEQ ID NO: 3569 - DNA, 20 bp, Artificial Sequence
  Primer
ccctgcagaagaattggaag

SEQ ID NO: 3570 - DNA, 20 bp, Artificial Sequence
  Primer
gtgcatacacagttggccta

SEQ ID NO: 3571 - DNA, 20 bp, Artificial Sequence
  Primer
atcccggcttccttagaaca

SEQ ID NO: 3572 - DNA, 20 bp, Artificial Sequence
  Primer
ggaggggaggacttattctt

SEQ ID NO: 3573 - DNA, 20 bp, Artificial Sequence
  Primer
aggagagatttgagcatccg

SEQ ID NO: 3574 - DNA, 20 bp, Artificial Sequence
  Primer
ctgcgctttgcaaaagtgga

SEQ ID NO: 3575 - DNA, 20 bp, Artificial Sequence
  Primer
gactgagctaatccaaagga

SEQ ID NO: 3576 - DNA, 20 bp, Artificial Sequence
  Primer
caatcctgaaccatcaggca

SEQ ID NO: 3577 - DNA, 20 bp, Artificial Sequence
  Primer
gggaggagattgttgaatcg

SEQ ID NO: 3578 - DNA, 20 bp, Artificial Sequence
  Primer
gcacttcttgaggaagtgct

SEQ ID NO: 3579 - DNA, 20 bp, Artificial Sequence
  Primer
cgtgcccgaaaaactcagat

SEQ ID NO: 3580 - DNA, 20 bp, Artificial Sequence
  Primer
tcacggggtaaaggatcagt

SEQ ID NO: 3581 - DNA, 20 bp, Artificial Sequence
  Primer
cgatgcttcgacggcatttt

SEQ ID NO: 3582 - DNA, 20 bp, Artificial Sequence
  Primer
agcagaggcttttcaagtgc

SEQ ID NO: 3583 - DNA, 20 bp, Artificial Sequence
  Primer
cgaagactactcgttgggaa

SEQ ID NO: 3584 - DNA, 20 bp, Artificial Sequence
  Primer
gctgaaaacgcaagttgtgg

SEQ ID NO: 3585 - DNA, 20 bp, Artificial Sequence
  Primer
gagtcctcctcccagatttt

SEQ ID NO: 3586 - DNA, 20 bp, Artificial Sequence
  Primer
tatgcagggcttgggatctt

SEQ ID NO: 3587 - DNA, 20 bp, Artificial Sequence
  Primer
acttctggtcgagctacgtc

SEQ ID NO: 3588 - DNA, 20 bp, Artificial Sequence
  Primer
gcgctgagatcgttccattt

SEQ ID NO: 3589 - DNA, 20 bp, Artificial Sequence
  Primer
cagcaggccccatttgtaat

SEQ ID NO: 3590 - DNA, 20 bp, Artificial Sequence
  Primer
ggtccgcatatgctccaaaa

SEQ ID NO: 3591 - DNA, 20 bp, Artificial Sequence
  Primer
ctgcgaaagaggacatctct

SEQ ID NO: 3592 - DNA, 20 bp, Artificial Sequence
  Primer
gctccgacctttggatactt

SEQ ID NO: 3593 - DNA, 20 bp, Artificial Sequence
  Primer
ccaacgatgactatccaaag

SEQ ID NO: 3594 - DNA, 20 bp, Artificial Sequence
  Primer
ccccattgtctgctatgaag

SEQ ID NO: 3595 - DNA, 20 bp, Artificial Sequence
  Primer
gcttccactattcgtcaagg

SEQ ID NO: 3596 - DNA, 20 bp, Artificial Sequence
  Primer
ctgtttcgggagctctattg

SEQ ID NO: 3597 - DNA, 20 bp, Artificial Sequence
  Primer
cttacgctacgatgactgtg

SEQ ID NO: 3598 - DNA, 20 bp, Artificial Sequence
  Primer
ggtgatatcttactccacgg

SEQ ID NO: 3599 - DNA, 20 bp, Artificial Sequence
  Primer
cagacatgcccagagacaaa

SEQ ID NO: 3600 - DNA, 20 bp, Artificial Sequence
  Primer
cccctaacggacgaagaaat

SEQ ID NO: 3601 - DNA, 20 bp, Artificial Sequence
  Primer
tgttgctccttgttgagcac

SEQ ID NO: 3602 - DNA, 20 bp, Artificial Sequence
  Primer
gcgagacggtcgttatgaaa

SEQ ID NO: 3603 - DNA, 20 bp, Artificial Sequence
  Primer
ggaagcgctcttctagctaa

SEQ ID NO: 3604 - DNA, 20 bp, Artificial Sequence
  Primer
gcccgtagagaaaacctttc

SEQ ID NO: 3605 - DNA, 20 bp, Artificial Sequence
  Primer
gcctgattctttcgctgcaa

SEQ ID NO: 3606 - DNA, 20 bp, Artificial Sequence
  Primer
gaccaaaaggagtcagcttc

SEQ ID NO: 3607 - DNA, 20 bp, Artificial Sequence
  Primer
gtgaagcgctggattcacaa

SEQ ID NO: 3608 - DNA, 20 bp, Artificial Sequence
  Primer
cgggattctctttaaacgac

SEQ ID NO: 3609 - DNA, 20 bp, Artificial Sequence
  Primer
ccggaaacaaccccgataat

SEQ ID NO: 3610 - DNA, 20 bp, Artificial Sequence
  Primer
cctctttacccaagtagcct

SEQ ID NO: 3611 - DNA, 20 bp, Artificial Sequence
  Primer
cctgcaccctaatcgaacta

SEQ ID NO: 3612 - DNA, 20 bp, Artificial Sequence
  Primer
cggaagttgtcgctagatac

SEQ ID NO: 3613 - DNA, 20 bp, Artificial Sequence
  Primer
cactccatgagcagcagtaa

SEQ ID NO: 3614 - DNA, 20 bp, Artificial Sequence
  Primer
cggttaagcactccctatgt

SEQ ID NO: 3615 - DNA, 20 bp, Artificial Sequence
  Primer
ccgacaacgtaacagtgtca

SEQ ID NO: 3616 - DNA, 20 bp, Artificial Sequence
  Primer
ctcttgtcggaaagatagcg

SEQ ID NO: 3617 - DNA, 20 bp, Artificial Sequence
  Primer
ccccatctgaagcaagagaa

SEQ ID NO: 3618 - DNA, 20 bp, Artificial Sequence
  Primer
cttacgggcgatgcaaccac

SEQ ID NO: 3619 - DNA, 20 bp, Artificial Sequence
  Primer
catcagaacgagctcgctaa

SEQ ID NO: 3620 - DNA, 20 bp, Artificial Sequence
  Primer
cctccgtattcagacaatcc

SEQ ID NO: 3621 - DNA, 20 bp, Artificial Sequence
  Primer
tggcttctgtcaccttgctc

SEQ ID NO: 3622 - DNA, 20 bp, Artificial Sequence
  Primer
gacacacccatatccatacg

SEQ ID NO: 3623 - DNA, 20 bp, Artificial Sequence
  Primer
gtggacgttggttgaagcca

SEQ ID NO: 3624 - DNA, 20 bp, Artificial Sequence
  Primer
gaagaagggcagtgggaaaa

SEQ ID NO: 3625 - DNA, 20 bp, Artificial Sequence
  Primer
cttttctcttcgtggaggag

SEQ ID NO: 3626 - DNA, 20 bp, Artificial Sequence
  Primer
ggggctcttgcagctttttt

SEQ ID NO: 3627 - DNA, 20 bp, Artificial Sequence
  Primer
gtggcgaaactcttgttgga

SEQ ID NO: 3628 - DNA, 20 bp, Artificial Sequence
  Primer
cgctcagatcctcatgaaga

SEQ ID NO: 3629 - DNA, 20 bp, Artificial Sequence
  Primer
cccacagatctagcttttcg

SEQ ID NO: 3630 - DNA, 20 bp, Artificial Sequence
  Primer
cgcgtagccaaagtgaaagt

SEQ ID NO: 3631 - DNA, 20 bp, Artificial Sequence
  Primer
cgaatcacgctcaggagaaa

SEQ ID NO: 3632 - DNA, 20 bp, Artificial Sequence
  Primer
cgaagagaaaggtgtggttg

SEQ ID NO: 3633 - DNA, 20 bp, Artificial Sequence
  Primer
gagaagccaccgccttacaa

SEQ ID NO: 3634 - DNA, 20 bp, Artificial Sequence
  Primer
gttgactcggagctcttcta

SEQ ID NO: 3635 - DNA, 20 bp, Artificial Sequence
  Primer
cttcatctgcgcaaacaacc

SEQ ID NO: 3636 - DNA, 20 bp, Artificial Sequence
  Primer
ctcctttaggtgctttcggt

SEQ ID NO: 3637 - DNA, 20 bp, Artificial Sequence
  Primer
cgccaaaaagactcggagaa

SEQ ID NO: 3638 - DNA, 20 bp, Artificial Sequence
  Primer
gcgatttactaggtatcccg

SEQ ID NO: 3639 - DNA, 20 bp, Artificial Sequence
  Primer
ccctacagcagggaaagaaa

SEQ ID NO: 3640 - DNA, 20 bp, Artificial Sequence
  Primer
ggagaagaacccgatgttcc

SEQ ID NO: 3641 - DNA, 20 bp, Artificial Sequence
  Primer
gaacatgcccactatctctc

SEQ ID NO: 3642 - DNA, 20 bp, Artificial Sequence
  Primer
gtgcagcatgtagcgttgat

SEQ ID NO: 3643 - DNA, 20 bp, Artificial Sequence
  Primer
gagagtcgcccaatttcgtt

SEQ ID NO: 3644 - DNA, 20 bp, Artificial Sequence
  Primer
ctcagaaaagcgctattggc

SEQ ID NO: 3645 - DNA, 20 bp, Artificial Sequence
  Primer
gccaagcatcctatcaaacc

SEQ ID NO: 3646 - DNA, 20 bp, Artificial Sequence
  Primer
ccaacccgtctttgctatgc

SEQ ID NO: 3647 - DNA, 20 bp, Artificial Sequence
  Primer
ccgcctacctcaacttatag

SEQ ID NO: 3648 - DNA, 20 bp, Artificial Sequence
  Primer
cgcaacgccattatcaacct

SEQ ID NO: 3649 - DNA, 20 bp, Artificial Sequence
  Primer
tccgcagctgcctatcaata

SEQ ID NO: 3650 - DNA, 20 bp, Artificial Sequence
  Primer
gaccctaacctctaaaaccc

SEQ ID NO: 3651 - DNA, 20 bp, Artificial Sequence
  Primer
ccttgtcgtctcccttcctt

SEQ ID NO: 3652 - DNA, 20 bp, Artificial Sequence
  Primer
caccgactcccattttccta

SEQ ID NO: 3653 - DNA, 20 bp, Artificial Sequence
  Primer
ctggttcttcacacacgagg

SEQ ID NO: 3654 - DNA, 20 bp, Artificial Sequence
  Primer
ttctccaaccaggagatcgt

SEQ ID NO: 3655 - DNA, 20 bp, Artificial Sequence
  Primer
gcgagcttctagtaaggaac

SEQ ID NO: 3656 - DNA, 20 bp, Artificial Sequence
  Primer
aaacaaacctcggccggtag

SEQ ID NO: 3657 - DNA, 20 bp, Artificial Sequence
  Primer
cctttaacatctcacaggtc

SEQ ID NO: 3658 - DNA, 20 bp, Artificial Sequence
  Primer
cccgaaatttcgagccatca

SEQ ID NO: 3659 - DNA, 20 bp, Artificial Sequence
  Primer
cggaattccctccaacttgt

SEQ ID NO: 3660 - DNA, 20 bp, Artificial Sequence
  Primer
gcttccaatgaaggaaagcg

SEQ ID NO: 3661 - DNA, 20 bp, Artificial Sequence
  Primer
cccctttttatcccctctgt

SEQ ID NO: 3662 - DNA, 20 bp, Artificial Sequence
  Primer
cctcctctcagaatgatctg

SEQ ID NO: 3663 - DNA, 20 bp, Artificial Sequence
  Primer
gcgcctcatcagcatattca

SEQ ID NO: 3664 - DNA, 20 bp, Artificial Sequence
  Primer
tcttcccacaacgtccctgt

SEQ ID NO: 3665 - DNA, 20 bp, Artificial Sequence
  Primer
gggactatacccagcatgat

SEQ ID NO: 3666 - DNA, 20 bp, Artificial Sequence
  Primer
gcgcctcatcagcatattca

SEQ ID NO: 3667 - DNA, 20 bp, Artificial Sequence
  Primer
ccgaacaagatgtttcttcc

SEQ ID NO: 3668 - DNA, 20 bp, Artificial Sequence
  Primer
cctctcctcgcttatcaaca

SEQ ID NO: 3669 - DNA, 20 bp, Artificial Sequence
  Primer
gcttcagcagtgagagctcg

SEQ ID NO: 3670 - DNA, 20 bp, Artificial Sequence
  Primer
cggtatcgcaatagctgtgt

SEQ ID NO: 3671 - DNA, 20 bp, Artificial Sequence
  Primer
cggtagaaaggccttaacta

SEQ ID NO: 3672 - DNA, 20 bp, Artificial Sequence
  Primer
gccatgtacaagtctcaagc

SEQ ID NO: 3673 - DNA, 20 bp, Artificial Sequence
  Primer
gcctgtctgaacagttcttc

SEQ ID NO: 3674 - DNA, 20 bp, Artificial Sequence
  Primer
gccatctcttgcaaagcaac

SEQ ID NO: 3675 - DNA, 20 bp, Artificial Sequence
  Primer
ggtcccaacatacgtttgga

SEQ ID NO: 3676 - DNA, 20 bp, Artificial Sequence
  Primer
gccccaaataatgggtgaag

SEQ ID NO: 3677 - DNA, 20 bp, Artificial Sequence
  Primer
ctaactctcccctctcttct

SEQ ID NO: 3678 - DNA, 20 bp, Artificial Sequence
  Primer
cccatatacttgatcccgac

SEQ ID NO: 3679 - DNA, 20 bp, Artificial Sequence
  Primer
gactcggagccctttacatt

SEQ ID NO: 3680 - DNA, 20 bp, Artificial Sequence
  Primer
cccacccatttacccatgat

SEQ ID NO: 3681 - DNA, 20 bp, Artificial Sequence
  Primer
ctccgcaacatacactagga

SEQ ID NO: 3682 - DNA, 20 bp, Artificial Sequence
  Primer
gggatacgcaggattatctg

SEQ ID NO: 3683 - DNA, 20 bp, Artificial Sequence
  Primer
ggcagcagaatacgtagagt

SEQ ID NO: 3684 - DNA, 20 bp, Artificial Sequence
  Primer
ggctcttgcggctctactcg

SEQ ID NO: 3685 - DNA, 20 bp, Artificial Sequence
  Primer
cgcctcaacctttcgaaaca

SEQ ID NO: 3686 - DNA, 20 bp, Artificial Sequence
  Primer
attctggtagggaaatgggg

SEQ ID NO: 3687 - DNA, 20 bp, Artificial Sequence
  Primer
ccagtactccgtgcttcttt

SEQ ID NO: 3688 - DNA, 20 bp, Artificial Sequence
  Primer
ggcagcagaatacgtagagt

SEQ ID NO: 3689 - DNA, 20 bp, Artificial Sequence
  Primer
ctcgtcacaggctagataag

SEQ ID NO: 3690 - DNA, 20 bp, Artificial Sequence
  Primer
ctctctgcttctccaaatgc

SEQ ID NO: 3691 - DNA, 20 bp, Artificial Sequence
  Primer
ctgtcagccattcagcttgt

SEQ ID NO: 3692 - DNA, 20 bp, Artificial Sequence
  Primer
ccaaccctctttaccagaga

SEQ ID NO: 3693 - DNA, 20 bp, Artificial Sequence
  Primer
gctcctatttccattcttgc

SEQ ID NO: 3694 - DNA, 20 bp, Artificial Sequence
  Primer
gctgctgtcttagcttctct

SEQ ID NO: 3695 - DNA, 20 bp, Artificial Sequence
  Primer
ctacctctgcttcaagatcc

SEQ ID NO: 3696 - DNA, 20 bp, Artificial Sequence
  Primer
gctatctctatccttgggag

SEQ ID NO: 3697 - DNA, 20 bp, Artificial Sequence
  Primer
cctctgaagctgtgaatgag

SEQ ID NO: 3698 - DNA, 20 bp, Artificial Sequence
  Primer
gtggggtgtctcttcaaagt

SEQ ID NO: 3699 - DNA, 20 bp, Artificial Sequence
  Primer
ggagactatagttctgctgc

SEQ ID NO: 3700 - DNA, 20 bp, Artificial Sequence
  Primer
ggggagaaacaatgctctct

SEQ ID NO: 3701 - DNA, 20 bp, Artificial Sequence
  Primer
ctgcaatgagctctgtcgaa

SEQ ID NO: 3702 - DNA, 20 bp, Artificial Sequence
  Primer
gcattgaagccattgcccat

SEQ ID NO: 3703 - DNA, 20 bp, Artificial Sequence
  Primer
ccagttacagcaagagttcc

SEQ ID NO: 3704 - DNA, 20 bp, Artificial Sequence
  Primer
ctgcaatgagctctgtcgaa

SEQ ID NO: 3705 - DNA, 20 bp, Artificial Sequence
  Primer
cgaggtctgagatcttcttg

SEQ ID NO: 3706 - DNA, 20 bp, Artificial Sequence
  Primer
ccctcaattccttacggaga

SEQ ID NO: 3707 - DNA, 20 bp, Artificial Sequence
  Primer
ccccatcgacctcaaaagat

SEQ ID NO: 3708 - DNA, 20 bp, Artificial Sequence
  Primer
ccgacaaggcctatgctttt

SEQ ID NO: 3709 - DNA, 20 bp, Artificial Sequence
  Primer
ggaagccgacaaaactcttc

SEQ ID NO: 3710 - DNA, 20 bp, Artificial Sequence
  Primer
ctcttcaacggagcgaatag

SEQ ID NO: 3711 - DNA, 20 bp, Artificial Sequence
  Primer
gcccctcacaacttactgta

SEQ ID NO: 3712 - DNA, 20 bp, Artificial Sequence
  Primer
gctagagaaacctctatacc

SEQ ID NO: 3713 - DNA, 20 bp, Artificial Sequence
  Primer
gccctacaagctagaatgtc

SEQ ID NO: 3714 - DNA, 20 bp, Artificial Sequence
  Primer
gttgccgtcactcctacaaa

SEQ ID NO: 3715 - DNA, 20 bp, Artificial Sequence
  Primer
ctactgtcgtaacagccatc

SEQ ID NO: 3716 - DNA, 20 bp, Artificial Sequence
  Primer
ccgctactttccagtgtaac

SEQ ID NO: 3717 - DNA, 20 bp, Artificial Sequence
  Primer
taaacagggaagaccttggc

SEQ ID NO: 3718 - DNA, 20 bp, Artificial Sequence
  Primer
ggtatccggcctttaaacca

SEQ ID NO: 3719 - DNA, 20 bp, Artificial Sequence
  Primer
ccaaaatcccttttcccttc

SEQ ID NO: 3720 - DNA, 20 bp, Artificial Sequence
  Primer
aggtgtcgaagacgcccttc

SEQ ID NO: 3721 - DNA, 20 bp, Artificial Sequence
  Primer
cttgatactctgctcctacc

SEQ ID NO: 3722 - DNA, 20 bp, Artificial Sequence
  Primer
ctggagcctcttgtatcaag

SEQ ID NO: 3723 - DNA, 20 bp, Artificial Sequence
  Primer
ggttctcctagaagaatccc

SEQ ID NO: 3724 - DNA, 20 bp, Artificial Sequence
  Primer
cctgtttctccttctacgac

SEQ ID NO: 3725 - DNA, 20 bp, Artificial Sequence
  Primer
catctctctgccaccacaaa

SEQ ID NO: 3726 - DNA, 20 bp, Artificial Sequence
  Primer
ggtcgaatgcatctgattcg

SEQ ID NO: 3727 - DNA, 20 bp, Artificial Sequence
  Primer
gatatagcgtccccatctac

SEQ ID NO: 3728 - DNA, 20 bp, Artificial Sequence
  Primer
gcgtttagctgagttgagac

SEQ ID NO: 3729 - DNA, 20 bp, Artificial Sequence
  Primer
gttaacgagccgtagtcctt

SEQ ID NO: 3730 - DNA, 20 bp, Artificial Sequence
  Primer
gccccttgagaaagtagaac

SEQ ID NO: 3731 - DNA, 20 bp, Artificial Sequence
  Primer
cgaagcctctttctactaga

SEQ ID NO: 3732 - DNA, 20 bp, Artificial Sequence
  Primer
gcacacttggcttgggataa

SEQ ID NO: 3733 - DNA, 20 bp, Artificial Sequence
  Primer
tagcctctcctctttccgat

SEQ ID NO: 3734 - DNA, 20 bp, Artificial Sequence
  Primer
gccgttccgataaacctatg

SEQ ID NO: 3735 - DNA, 20 bp, Artificial Sequence
  Primer
ccaaatgcagcccattgtca

SEQ ID NO: 3736 - DNA, 20 bp, Artificial Sequence
  Primer
caaccaccctatcctcctaa

SEQ ID NO: 3737 - DNA, 20 bp, Artificial Sequence
  Primer
ggaggatttctgggatccta

SEQ ID NO: 3738 - DNA, 20 bp, Artificial Sequence
  Primer
gtccagactctccatcctat

SEQ ID NO: 3739 - DNA, 20 bp, Artificial Sequence
  Primer
ccgtcagaaggtctttctca

SEQ ID NO: 3740 - DNA, 20 bp, Artificial Sequence
  Primer
gctgtgctataccgatatgc

SEQ ID NO: 3741 - DNA, 20 bp, Artificial Sequence
  Primer
ccagattttgacgaacgcag

SEQ ID NO: 3742 - DNA, 20 bp, Artificial Sequence
  Primer
gaaaaagtgctgtcggcatc

SEQ ID NO: 3743 - DNA, 20 bp, Artificial Sequence
  Primer
cgtattcaacccagggaatc

SEQ ID NO: 3744 - DNA, 20 bp, Artificial Sequence
  Primer
gccggaatgatgctagagaa

SEQ ID NO: 3745 - DNA, 20 bp, Artificial Sequence
  Primer
caggtctaagaatcagcgag

SEQ ID NO: 3746 - DNA, 20 bp, Artificial Sequence
  Primer
gcctctgtagaacaggatca

SEQ ID NO: 3747 - DNA, 20 bp, Artificial Sequence
  Primer
cgacgagcttcttttcactc

SEQ ID NO: 3748 - DNA, 20 bp, Artificial Sequence
  Primer
ccgagggaaagggaaaaaag

SEQ ID NO: 3749 - DNA, 20 bp, Artificial Sequence
  Primer
gccttggaaaagcagctcat

SEQ ID NO: 3750 - DNA, 20 bp, Artificial Sequence
  Primer
atgactgccaaacaagctgc

SEQ ID NO: 3751 - DNA, 20 bp, Artificial Sequence
  Primer
gctccaggacaaccattctt

SEQ ID NO: 3752 - DNA, 20 bp, Artificial Sequence
  Primer
cgacgagcttcttttcactc

SEQ ID NO: 3753 - DNA, 20 bp, Artificial Sequence
  Primer
gcaaacggtatgaagggaag

SEQ ID NO: 3754 - DNA, 20 bp, Artificial Sequence
  Primer
ctccctttgaataagcgtcc

SEQ ID NO: 3755 - DNA, 20 bp, Artificial Sequence
  Primer
ggacagcgtaatatgcacct

SEQ ID NO: 3756 - DNA, 20 bp, Artificial Sequence
  Primer
ctctgactttaacactgggc

SEQ ID NO: 3757 - DNA, 20 bp, Artificial Sequence
  Primer
gggagttgatgcagagatgc

SEQ ID NO: 3758 - DNA, 20 bp, Artificial Sequence
  Primer
cccggaatcaagctttttgc

SEQ ID NO: 3759 - DNA, 20 bp, Artificial Sequence
  Primer
cctgtttatcactaggagcg

SEQ ID NO: 3760 - DNA, 20 bp, Artificial Sequence
  Primer
ctccaaacgtccttatctcg

SEQ ID NO: 3761 - DNA, 20 bp, Artificial Sequence
  Primer
ccgctatatcgtactgagca

SEQ ID NO: 3762 - DNA, 20 bp, Artificial Sequence
  Primer
gacgatacgtctcatctcct

SEQ ID NO: 3763 - DNA, 20 bp, Artificial Sequence
  Primer
ggacactctttatcctctcc

SEQ ID NO: 3764 - DNA, 20 bp, Artificial Sequence
  Primer
cacttagaaggctgcgtatc

SEQ ID NO: 3765 - DNA, 20 bp, Artificial Sequence
  Primer
gcagctagatctgaacgaga

SEQ ID NO: 3766 - DNA, 20 bp, Artificial Sequence
  Primer
gcgcttgagccaaataacga

SEQ ID NO: 3767 - DNA, 20 bp, Artificial Sequence
  Primer
cctgcaactgctccttcaat

SEQ ID NO: 3768 - DNA, 20 bp, Artificial Sequence
  Primer
aaaactgctgagagttcccc

SEQ ID NO: 3769 - DNA, 20 bp, Artificial Sequence
  Primer
gagagcactcccttgagttc

SEQ ID NO: 3770 - DNA, 20 bp, Artificial Sequence
  Primer
cctgctttccctttgcttct

SEQ ID NO: 3771 - DNA, 20 bp, Artificial Sequence
  Primer
cccccttctctcgataagat

SEQ ID NO: 3772 - DNA, 20 bp, Artificial Sequence
  Primer
gcctctcttgaacagaaacg

SEQ ID NO: 3773 - DNA, 20 bp, Artificial Sequence
  Primer
ctagatgagatagctacctc

SEQ ID NO: 3774 - DNA, 20 bp, Artificial Sequence
  Primer
ctagaatcttgcccaccaca

SEQ ID NO: 3775 - DNA, 20 bp, Artificial Sequence
  Primer
ggggactaggatatcaatgg

SEQ ID NO: 3776 - DNA, 20 bp, Artificial Sequence
  Primer
gtcgctgtcagaaaatgctc

SEQ ID NO: 3777 - DNA, 20 bp, Artificial Sequence
  Primer
cggagagcattataggcttc

SEQ ID NO: 3778 - DNA, 20 bp, Artificial Sequence
  Primer
gcaggacctaatcccaatct

SEQ ID NO: 3779 - DNA, 20 bp, Artificial Sequence
  Primer
gccttctcttttggcttctc

SEQ ID NO: 3780 - DNA, 20 bp, Artificial Sequence
  Primer
gtcctgaacctggtcctaac

SEQ ID NO: 3781 - DNA, 20 bp, Artificial Sequence
  Primer
ggctccagttaaacacccta

SEQ ID NO: 3782 - DNA, 20 bp, Artificial Sequence
  Primer
ggaacacaacaacatctggg

SEQ ID NO: 3783 - DNA, 20 bp, Artificial Sequence
  Primer
cagggattctgttccactct

SEQ ID NO: 3784 - DNA, 20 bp, Artificial Sequence
  Primer
tagactccttaccagatccc

SEQ ID NO: 3785 - DNA, 20 bp, Artificial Sequence
  Primer
cctcggagtaccagatatgt

SEQ ID NO: 3786 - DNA, 20 bp, Artificial Sequence
  Primer
cgtttagctgtagaatgggg

SEQ ID NO: 3787 - DNA, 20 bp, Artificial Sequence
  Primer
cgcccttgttcttgaaagac

SEQ ID NO: 3788 - DNA, 20 bp, Artificial Sequence
  Primer
agatgttctctccctcggag

SEQ ID NO: 3789 - DNA, 20 bp, Artificial Sequence
  Primer
cgtggaagctatcttggcta

SEQ ID NO: 3790 - DNA, 20 bp, Artificial Sequence
  Primer
cccagtggatatatcctcaa

SEQ ID NO: 3791 - DNA, 20 bp, Artificial Sequence
  Primer
ctctgcagcagcagaaattg

SEQ ID NO: 3792 - DNA, 20 bp, Artificial Sequence
  Primer
aagcaagtcatctggacacc

SEQ ID NO: 3793 - DNA, 20 bp, Artificial Sequence
  Primer
ctcgctcactttccctctgc

SEQ ID NO: 3794 - DNA, 20 bp, Artificial Sequence
  Primer
cggtgaagcagttgtatcag

SEQ ID NO: 3795 - DNA, 20 bp, Artificial Sequence
  Primer
ctgcagctatccatagtgga

SEQ ID NO: 3796 - DNA, 20 bp, Artificial Sequence
  Primer
cctgagcaagcctctttcat

SEQ ID NO: 3797 - DNA, 20 bp, Artificial Sequence
  Primer
cgtctctaagaagtaggcac

SEQ ID NO: 3798 - DNA, 20 bp, Artificial Sequence
  Primer
tcggctcccgctttggcagc

SEQ ID NO: 3799 - DNA, 20 bp, Artificial Sequence
  Primer
actccagaacgcctattcgc

SEQ ID NO: 3800 - DNA, 20 bp, Artificial Sequence
  Primer
caaagaaaaggcgcaacgat

SEQ ID NO: 3801 - DNA, 20 bp, Artificial Sequence
  Primer
gattcgctgctcgcacagaa

SEQ ID NO: 3802 - DNA, 20 bp, Artificial Sequence
  Primer
cttctcgacatatctctggc

SEQ ID NO: 3803 - DNA, 20 bp, Artificial Sequence
  Primer
ctctcttgagtttttgcggg

SEQ ID NO: 3804 - DNA, 20 bp, Artificial Sequence
  Primer
gttgctgtactgttctcgga

SEQ ID NO: 3805 - DNA, 20 bp, Artificial Sequence
  Primer
catagtaacttcagacgcgg

SEQ ID NO: 3806 - DNA, 20 bp, Artificial Sequence
  Primer
tttgcaacgccgcctagata

SEQ ID NO: 3807 - DNA, 20 bp, Artificial Sequence
  Primer
tgagcgtagtgacgattagc

SEQ ID NO: 3808 - DNA, 20 bp, Artificial Sequence
  Primer
ctctcttgagtttttgcggg

SEQ ID NO: 3809 - DNA, 20 bp, Artificial Sequence
  Primer
gtacgaccaccttcacgaat

SEQ ID NO: 3810 - DNA, 20 bp, Artificial Sequence
  Primer
gctacccgcaaaagctgctt

SEQ ID NO: 3811 - DNA, 20 bp, Artificial Sequence
  Primer
ccatggtcgaggaaatagtg

SEQ ID NO: 3812 - DNA, 20 bp, Artificial Sequence
  Primer
cccatgatattcacgcctgc

SEQ ID NO: 3813 - DNA, 20 bp, Artificial Sequence
  Primer
caccggcttcttgtaacttc

SEQ ID NO: 3814 - DNA, 20 bp, Artificial Sequence
  Primer
ggtaaagaaaccgaaccacg

SEQ ID NO: 3815 - DNA, 20 bp, Artificial Sequence
  Primer
gcaagcttcccgatttgaag

SEQ ID NO: 3816 - DNA, 20 bp, Artificial Sequence
  Primer
cgtagcagtaaaacccaggt

SEQ ID NO: 3817 - DNA, 20 bp, Artificial Sequence
  Primer
cgcgacaaaatccttctctg

SEQ ID NO: 3818 - DNA, 20 bp, Artificial Sequence
  Primer
cagcaaactctgtaggctct

SEQ ID NO: 3819 - DNA, 20 bp, Artificial Sequence
  Primer
caggacactgactaaccctt

SEQ ID NO: 3820 - DNA, 20 bp, Artificial Sequence
  Primer
cctatacacttgtccatccg

SEQ ID NO: 3821 - DNA, 20 bp, Artificial Sequence
  Primer
ctctcctttgtatctagccc

SEQ ID NO: 3822 - DNA, 20 bp, Artificial Sequence
  Primer
cagtccttagtaggcccaaa

SEQ ID NO: 3823 - DNA, 20 bp, Artificial Sequence
  Primer
ggtctgagacttcagtccaa

SEQ ID NO: 3824 - DNA, 20 bp, Artificial Sequence
  Primer
ggatttgtcgtagcatcctg

SEQ ID NO: 3825 - DNA, 20 bp, Artificial Sequence
  Primer
gagctgctcaattacgagag

SEQ ID NO: 3826 - DNA, 20 bp, Artificial Sequence
  Primer
gctacgttcccatcacaaca

SEQ ID NO: 3827 - DNA, 20 bp, Artificial Sequence
  Primer
ctctagaaagtcctccagag

SEQ ID NO: 3828 - DNA, 20 bp, Artificial Sequence
  Primer
ggagggccttagcttcataa

SEQ ID NO: 3829 - DNA, 20 bp, Artificial Sequence
  Primer
gaccgccaatccttatctgt

SEQ ID NO: 3830 - DNA, 20 bp, Artificial Sequence
  Primer
ggcctcctcaacaatacgtt

SEQ ID NO: 3831 - DNA, 20 bp, Artificial Sequence
  Primer
cgaccttcttttaccgttcc

SEQ ID NO: 3832 - DNA, 20 bp, Artificial Sequence
  Primer
tcataacgcgctcttacacc

SEQ ID NO: 3833 - DNA, 20 bp, Artificial Sequence
  Primer
gacgctaaataggctgggaa

SEQ ID NO: 3834 - DNA, 20 bp, Artificial Sequence
  Primer
cacccgcaataaattcccgt

SEQ ID NO: 3835 - DNA, 20 bp, Artificial Sequence
  Primer
caatccagaagtaccaccga

SEQ ID NO: 3836 - DNA, 20 bp, Artificial Sequence
  Primer
ctccatgggtcttcctaaga

SEQ ID NO: 3837 - DNA, 20 bp, Artificial Sequence
  Primer
gaagcaactgctctgttacc

SEQ ID NO: 3838 - DNA, 20 bp, Artificial Sequence
  Primer
gctctactgcatccgtatag

SEQ ID NO: 3839 - DNA, 20 bp, Artificial Sequence
  Primer
cctaccaaccctcctaattc

SEQ ID NO: 3840 - DNA, 20 bp, Artificial Sequence
  Primer
gaagcaactgctctgttacc

SEQ ID NO: 3841 - DNA, 20 bp, Artificial Sequence
  Primer
actgcgtgagaagcgactcc

SEQ ID NO: 3842 - DNA, 20 bp, Artificial Sequence
  Primer
ccatcacagtattcccaacc

SEQ ID NO: 3843 - DNA, 20 bp, Artificial Sequence
  Primer
ggtcgtgttgtagcaacagt

SEQ ID NO: 3844 - DNA, 20 bp, Artificial Sequence
  Primer
gggcatagcagacagaccaa

SEQ ID NO: 3845 - DNA, 20 bp, Artificial Sequence
  Primer
tcaatgatcgcccctgaacg

SEQ ID NO: 3846 - DNA, 20 bp, Artificial Sequence
  Primer
cctacagactccgtaacaca

SEQ ID NO: 3847 - DNA, 20 bp, Artificial Sequence
  Primer
cgcgtaacccagaaaaagag

SEQ ID NO: 3848 - DNA, 20 bp, Artificial Sequence
  Primer
gctacaaacataccagagcg

SEQ ID NO: 3849 - DNA, 20 bp, Artificial Sequence
  Primer
gcccatctataagatccagc

SEQ ID NO: 3850 - DNA, 20 bp, Artificial Sequence
  Primer
caccatcgctgcatatcgaa

SEQ ID NO: 3851 - DNA, 20 bp, Artificial Sequence
  Primer
ccctgaaactcctgcaacat

SEQ ID NO: 3852 - DNA, 20 bp, Artificial Sequence
  Primer
ggtaacgcagcaatcgcaac

SEQ ID NO: 3853 - DNA, 20 bp, Artificial Sequence
  Primer
ctgttaagaatcgtttcggc

SEQ ID NO: 3854 - DNA, 20 bp, Artificial Sequence
  Primer
tgggcgactgctgagagacc

SEQ ID NO: 3855 - DNA, 20 bp, Artificial Sequence
  Primer
cctggcataggaaagtctac

SEQ ID NO: 3856 - DNA, 20 bp, Artificial Sequence
  Primer
gtgttatcggtggtgtcttc

SEQ ID NO: 3857 - DNA, 20 bp, Artificial Sequence
  Primer
ctaggtgtaaaactgccctc

SEQ ID NO: 3858 - DNA, 20 bp, Artificial Sequence
  Primer
ctcttgattggtcgcggaga

SEQ ID NO: 3859 - DNA, 20 bp, Artificial Sequence
  Primer
cccaataccaaagcttctgg

SEQ ID NO: 3860 - DNA, 20 bp, Artificial Sequence
  Primer
cacggcaacctcctttagaa

SEQ ID NO: 3861 - DNA, 20 bp, Artificial Sequence
  Primer
gctgaggttgatcgatagga

SEQ ID NO: 3862 - DNA, 20 bp, Artificial Sequence
  Primer
caacatcctcaagccaagac

SEQ ID NO: 3863 - DNA, 20 bp, Artificial Sequence
  Primer
ggctctaaagcatcgtaatc

SEQ ID NO: 3864 - DNA, 20 bp, Artificial Sequence
  Primer
cagttgcataatctcagcac

SEQ ID NO: 3865 - DNA, 20 bp, Artificial Sequence
  Primer
tgtgctatacgcattccggg

SEQ ID NO: 3866 - DNA, 20 bp, Artificial Sequence
  Primer
gtacgaacatttgggacagc

SEQ ID NO: 3867 - DNA, 20 bp, Artificial Sequence
  Primer
ctcccctttttcctctcgtt

SEQ ID NO: 3868 - DNA, 20 bp, Artificial Sequence
  Primer
cgaacttgaatctcgtaccc

SEQ ID NO: 3869 - DNA, 20 bp, Artificial Sequence
  Primer
caggctttttcttgagaagc

SEQ ID NO: 3870 - DNA, 20 bp, Artificial Sequence
  Primer
tactcccataccgatacctg

SEQ ID NO: 3871 - DNA, 20 bp, Artificial Sequence
  Primer
gaagctgtagctgcgaagta

SEQ ID NO: 3872 - DNA, 20 bp, Artificial Sequence
  Primer
gcgccttccttactatctac

SEQ ID NO: 3873 - DNA, 20 bp, Artificial Sequence
  Primer
gcggcacaaaaatcattccc

SEQ ID NO: 3874 - DNA, 20 bp, Artificial Sequence
  Primer
cgtcaagcgctccatattca

SEQ ID NO: 3875 - DNA, 20 bp, Artificial Sequence
  Primer
cgcagcttctagactcagaa

SEQ ID NO: 3876 - DNA, 20 bp, Artificial Sequence
  Primer
cttccgcttgtgcttccata

SEQ ID NO: 3877 - DNA, 20 bp, Artificial Sequence
  Primer
ctttccttatgattcggggc

SEQ ID NO: 3878 - DNA, 20 bp, Artificial Sequence
  Primer
gcggcacaaaaatcattccc

SEQ ID NO: 3879 - DNA, 20 bp, Artificial Sequence
  Primer
cctgctctccccaatttttc

SEQ ID NO: 3880 - DNA, 20 bp, Artificial Sequence
  Primer
cttaactattcaagctcccg

SEQ ID NO: 3881 - DNA, 20 bp, Artificial Sequence
  Primer
tggagcagtatctggaggat

SEQ ID NO: 3882 - DNA, 20 bp, Artificial Sequence
  Primer
gcacattacaaagggccatc

SEQ ID NO: 3883 - DNA, 20 bp, Artificial Sequence
  Primer
cgcagcaaatcgcaattgag

SEQ ID NO: 3884 - DNA, 20 bp, Artificial Sequence
  Primer
ccgactacctgttgtgtatc

SEQ ID NO: 3885 - DNA, 20 bp, Artificial Sequence
  Primer
gctttagaacgtcggttcca

SEQ ID NO: 3886 - DNA, 20 bp, Artificial Sequence
  Primer
gtaactaaagggcattcgcc

SEQ ID NO: 3887 - DNA, 20 bp, Artificial Sequence
  Primer
gtggatcctaaagaaatccg

SEQ ID NO: 3888 - DNA, 20 bp, Artificial Sequence
  Primer
cgaccctagatgaataccgt

SEQ ID NO: 3889 - DNA, 20 bp, Artificial Sequence
  Primer
atccacaaggtctggaagca

SEQ ID NO: 3890 - DNA, 20 bp, Artificial Sequence
  Primer
gacacgcgttctcattattc

SEQ ID NO: 3891 - DNA, 20 bp, Artificial Sequence
  Primer
gatcatctacaagcatgcac

SEQ ID NO: 3892 - DNA, 20 bp, Artificial Sequence
  Primer
tctcctcctgctaaacaagg

SEQ ID NO: 3893 - DNA, 20 bp, Artificial Sequence
  Primer
cgaacagcaaacccttctgg

SEQ ID NO: 3894 - DNA, 20 bp, Artificial Sequence
  Primer
ccagcgataactagtccgat

SEQ ID NO: 3895 - DNA, 20 bp, Artificial Sequence
  Primer
gggcctttatccaaatcgaa

SEQ ID NO: 3896 - DNA, 20 bp, Artificial Sequence
  Primer
ggtaggtctcaaaagcttct

SEQ ID NO: 3897 - DNA, 20 bp, Artificial Sequence
  Primer
ggcttggttatcacctgcat

SEQ ID NO: 3898 - DNA, 20 bp, Artificial Sequence
  Primer
ggagaaagcacctcaatagc

SEQ ID NO: 3899 - DNA, 20 bp, Artificial Sequence
  Primer
gacgggaatactgttcttgg

SEQ ID NO: 3900 - DNA, 20 bp, Artificial Sequence
  Primer
ctccgatgttcctcaacact

SEQ ID NO: 3901 - DNA, 20 bp, Artificial Sequence
  Primer
agattggcatccagccctat

SEQ ID NO: 3902 - DNA, 20 bp, Artificial Sequence
  Primer
gattaggatctggcctcggc

SEQ ID NO: 3903 - DNA, 20 bp, Artificial Sequence
  Primer
gaggtttagggcttcttcct

SEQ ID NO: 3904 - DNA, 20 bp, Artificial Sequence
  Primer
cgctaaccctcaatggcaaa

SEQ ID NO: 3905 - DNA, 20 bp, Artificial Sequence
  Primer
ccacgaatcatggaggcatt

SEQ ID NO: 3906 - DNA, 20 bp, Artificial Sequence
  Primer
gcttagcattcgggctagta

SEQ ID NO: 3907 - DNA, 20 bp, Artificial Sequence
  Primer
gttgtcgggtacttggctaa

SEQ ID NO: 3908 - DNA, 20 bp, Artificial Sequence
  Primer
ccctaaacatgcgcaacgat

SEQ ID NO: 3909 - DNA, 20 bp, Artificial Sequence
  Primer
ctcgtccaggaagatcgtat

SEQ ID NO: 3910 - DNA, 20 bp, Artificial Sequence
  Primer
tcctttggctcgacaagttg

SEQ ID NO: 3911 - DNA, 20 bp, Artificial Sequence
  Primer
ggcacagtattgcttagagc

SEQ ID NO: 3912 - DNA, 20 bp, Artificial Sequence
  Primer
cgtcgtgtccagatcctatc

SEQ ID NO: 3913 - DNA, 20 bp, Artificial Sequence
  Primer
gctaaacgcccaccaggacg

SEQ ID NO: 3914 - DNA, 20 bp, Artificial Sequence
  Primer
ggttgcagtgtatcgcatgt

SEQ ID NO: 3915 - DNA, 20 bp, Artificial Sequence
  Primer
aacctcctgtagggaatgct

SEQ ID NO: 3916 - DNA, 20 bp, Artificial Sequence
  Primer
ctgcaacaaatgttcagggc

SEQ ID NO: 3917 - DNA, 20 bp, Artificial Sequence
  Primer
ccgtcctcccatatagttct

SEQ ID NO: 3918 - DNA, 20 bp, Artificial Sequence
  Primer
taacacgcctagggctatct

SEQ ID NO: 3919 - DNA, 20 bp, Artificial Sequence
  Primer
cgcatcaggagtggtaaagc

SEQ ID NO: 3920 - DNA, 20 bp, Artificial Sequence
  Primer
agcagcacaccgtcctccca

SEQ ID NO: 3921 - DNA, 20 bp, Artificial Sequence
  Primer
acaaagggctgccaaggctt

SEQ ID NO: 3922 - DNA, 20 bp, Artificial Sequence
  Primer
gggcttcaaaaagcgttctc

SEQ ID NO: 3923 - DNA, 20 bp, Artificial Sequence
  Primer
gcagatgtattagacgagtg

SEQ ID NO: 3924 - DNA, 20 bp, Artificial Sequence
  Primer
catgcgacgcaaacatcctt

SEQ ID NO: 3925 - DNA, 20 bp, Artificial Sequence
  Primer
ctgtgacaaagctcctgcaa

SEQ ID NO: 3926 - DNA, 20 bp, Artificial Sequence
  Primer
ctccctcccccagattattt

SEQ ID NO: 3927 - DNA, 20 bp, Artificial Sequence
  Primer
gtagcacgctcccttcttat

SEQ ID NO: 3928 - DNA, 20 bp, Artificial Sequence
  Primer
cgcagcttcttatcctggaa

SEQ ID NO: 3929 - DNA, 20 bp, Artificial Sequence
  Primer
agcacacccttcaggagaaa

SEQ ID NO: 3930 - DNA, 20 bp, Artificial Sequence
  Primer
ctgaagaagaaagcaggctg

SEQ ID NO: 3931 - DNA, 20 bp, Artificial Sequence
  Primer
ccccgcatgatattcgcatt

SEQ ID NO: 3932 - DNA, 20 bp, Artificial Sequence
  Primer
gtgtctccctcaccaacaat

SEQ ID NO: 3933 - DNA, 20 bp, Artificial Sequence
  Primer
cagctagtcgatatggaagg

SEQ ID NO: 3934 - DNA, 20 bp, Artificial Sequence
  Primer
gatctccgtatagagatggg

SEQ ID NO: 3935 - DNA, 20 bp, Artificial Sequence
  Primer
gacaggaaacatggatctgg

SEQ ID NO: 3936 - DNA, 20 bp, Artificial Sequence
  Primer
gaagaacgcttctctttccc

SEQ ID NO: 3937 - DNA, 20 bp, Artificial Sequence
  Primer
cgcttaagattctcggaggt

SEQ ID NO: 3938 - DNA, 20 bp, Artificial Sequence
  Primer
gcaccgagcattagatgacg

SEQ ID NO: 3939 - DNA, 20 bp, Artificial Sequence
  Primer
cagagtagtcgtctgcgtta

SEQ ID NO: 3940 - DNA, 20 bp, Artificial Sequence
  Primer
cgcttaagattctcggaggt

SEQ ID NO: 3941 - DNA, 20 bp, Artificial Sequence
  Primer
cctctgtgctgctgtaagaa

SEQ ID NO: 3942 - DNA, 20 bp, Artificial Sequence
  Primer
ccagaagtataaatcacccg

SEQ ID NO: 3943 - DNA, 20 bp, Artificial Sequence
  Primer
ggtctgagtcatcacgaact

SEQ ID NO: 3944 - DNA, 20 bp, Artificial Sequence
  Primer
ctttctctgggaacacacct

SEQ ID NO: 3945 - DNA, 20 bp, Artificial Sequence
  Primer
gcaatcccttacaatgcacg

SEQ ID NO: 3946 - DNA, 20 bp, Artificial Sequence
  Primer
cgctcactcagacaagaatg

SEQ ID NO: 3947 - DNA, 20 bp, Artificial Sequence
  Primer
ggtagcttcatctttgtgcc

SEQ ID NO: 3948 - DNA, 20 bp, Artificial Sequence
  Primer
cctaccccaatcatttgctc

SEQ ID NO: 3949 - DNA, 20 bp, Artificial Sequence
  Primer
gttcgtgtgcgagtgtttga

SEQ ID NO: 3950 - DNA, 20 bp, Artificial Sequence
  Primer
actccctgtaaagccattgc

SEQ ID NO: 3951 - DNA, 20 bp, Artificial Sequence
  Primer
gcttctttcggccttttgtc

SEQ ID NO: 3952 - DNA, 20 bp, Artificial Sequence
  Primer
ccaactagcgttactgtcct

SEQ ID NO: 3953 - DNA, 20 bp, Artificial Sequence
  Primer
aacgtaagcaagcctagctc

SEQ ID NO: 3954 - DNA, 20 bp, Artificial Sequence
  Primer
actggtcccaatgtatcacg

SEQ ID NO: 3955 - DNA, 20 bp, Artificial Sequence
  Primer
gaggcttctgaaggagagtt

SEQ ID NO: 3956 - DNA, 20 bp, Artificial Sequence
  Primer
cccccctctctacatcaaaa

SEQ ID NO: 3957 - DNA, 20 bp, Artificial Sequence
  Primer
cccaagagcctgtgaggaat

SEQ ID NO: 3958 - DNA, 20 bp, Artificial Sequence
  Primer
cctctccaattcttgtcgag

SEQ ID NO: 3959 - DNA, 20 bp, Artificial Sequence
  Primer
tcgcttaggctcacgcttat

SEQ ID NO: 3960 - DNA, 20 bp, Artificial Sequence
  Primer
ctggaacaaaagcgttggac

SEQ ID NO: 3961 - DNA, 20 bp, Artificial Sequence
  Primer
cctgagagcacttctatgtc

SEQ ID NO: 3962 - DNA, 20 bp, Artificial Sequence
  Primer
tgagctcgcttaggctcacg

SEQ ID NO: 3963 - DNA, 20 bp, Artificial Sequence
  Primer
cctcctacctctagtcttct

SEQ ID NO: 3964 - DNA, 20 bp, Artificial Sequence
  Primer
gctcttcgaaccaagttact

SEQ ID NO: 3965 - DNA, 20 bp, Artificial Sequence
  Primer
ccctttagccatccattcca

SEQ ID NO: 3966 - DNA, 20 bp, Artificial Sequence
  Primer
ggattcctctttggactagg

SEQ ID NO: 3967 - DNA, 20 bp, Artificial Sequence
  Primer
tattacgccactcttccctg

SEQ ID NO: 3968 - DNA, 20 bp, Artificial Sequence
  Primer
gactaccccacaatataccc

SEQ ID NO: 3969 - DNA, 20 bp, Artificial Sequence
  Primer
gtcccagaagcctccattcc

SEQ ID NO: 3970 - DNA, 20 bp, Artificial Sequence
  Primer
ctttcccgatatgttcagcc

SEQ ID NO: 3971 - DNA, 20 bp, Artificial Sequence
  Primer
cttgtcgttgaagaagggca

SEQ ID NO: 3972 - DNA, 20 bp, Artificial Sequence
  Primer
ccacaagctgctattctagc

SEQ ID NO: 3973 - DNA, 20 bp, Artificial Sequence
  Primer
gctgctttctctggaattgg

SEQ ID NO: 3974 - DNA, 20 bp, Artificial Sequence
  Primer
ctggaggacggatcataaag

SEQ ID NO: 3975 - DNA, 20 bp, Artificial Sequence
  Primer
gcagaatcccaagcgatttc

SEQ ID NO: 3976 - DNA, 20 bp, Artificial Sequence
  Primer
cactctcctcacttctgtca

SEQ ID NO: 3977 - DNA, 20 bp, Artificial Sequence
  Primer
gcgaaggccggacctttccg

SEQ ID NO: 3978 - DNA, 20 bp, Artificial Sequence
  Primer
gaggcgctatgttctcgatt

SEQ ID NO: 3979 - DNA, 20 bp, Artificial Sequence
  Primer
ctgctatggtccccataaga

SEQ ID NO: 3980 - DNA, 20 bp, Artificial Sequence
  Primer
caaattcctctggctgcagg

SEQ ID NO: 3981 - DNA, 20 bp, Artificial Sequence
  Primer
gactcgaagaacgtatcgca

SEQ ID NO: 3982 - DNA, 20 bp, Artificial Sequence
  Primer
ctgaggaaactacagaagcc

SEQ ID NO: 3983 - DNA, 20 bp, Artificial Sequence
  Primer
agacgacgtagagatcggcg

SEQ ID NO: 3984 - DNA, 20 bp, Artificial Sequence
  Primer
ccccttataaggccttctga

SEQ ID NO: 3985 - DNA, 20 bp, Artificial Sequence
  Primer
gacagccgttatccatccaa

SEQ ID NO: 3986 - DNA, 20 bp, Artificial Sequence
  Primer
ccggcataaccggacatatt

SEQ ID NO: 3987 - DNA, 20 bp, Artificial Sequence
  Primer
ggtttaggcggaacttacca

SEQ ID NO: 3988 - DNA, 20 bp, Artificial Sequence
  Primer
cgcagctgccgaattaagaa

SEQ ID NO: 3989 - DNA, 20 bp, Artificial Sequence
  Primer
ggtcacgtacatatagaagg

SEQ ID NO: 3990 - DNA, 20 bp, Artificial Sequence
  Primer
agacctttgcagtagcgctg

SEQ ID NO: 3991 - DNA, 20 bp, Artificial Sequence
  Primer
ctctctgattctgacggcaa

SEQ ID NO: 3992 - DNA, 20 bp, Artificial Sequence
  Primer
gggttgcttttcgggctttt

SEQ ID NO: 3993 - DNA, 20 bp, Artificial Sequence
  Primer
acaataagcccacacgatcc

SEQ ID NO: 3994 - DNA, 20 bp, Artificial Sequence
  Primer
cgctccttgattccagttct

SEQ ID NO: 3995 - DNA, 20 bp, Artificial Sequence
  Primer
gctcagcgaataacttcgct

SEQ ID NO: 3996 - DNA, 20 bp, Artificial Sequence
  Primer
ctcgaaaggacagtgtgtag

SEQ ID NO: 3997 - DNA, 20 bp, Artificial Sequence
  Primer
atcctcaggacttactccga

SEQ ID NO: 3998 - DNA, 20 bp, Artificial Sequence
  Primer
ctgaacttgtgcggaaacca

SEQ ID NO: 3999 - DNA, 20 bp, Artificial Sequence
  Primer
cgagaaccacttgtttactc

SEQ ID NO: 4000 - DNA, 20 bp, Artificial Sequence
  Primer
gggtttctcgcagagtctat

SEQ ID NO: 4001 - DNA, 20 bp, Artificial Sequence
  Primer
ccaagctcttgccgaaaaac

SEQ ID NO: 4002 - DNA, 20 bp, Artificial Sequence
  Primer
actgctttggggaagaaagc

SEQ ID NO: 4003 - DNA, 20 bp, Artificial Sequence
  Primer
gatgttcatctgcgcactac

SEQ ID NO: 4004 - DNA, 20 bp, Artificial Sequence
  Primer
cgataagcatacttccgacg

SEQ ID NO: 4005 - DNA, 20 bp, Artificial Sequence
  Primer
ctcttccttgatactggcta

SEQ ID NO: 4006 - DNA, 20 bp, Artificial Sequence
  Primer
cctcctggatttccttagga

SEQ ID NO: 4007 - DNA, 20 bp, Artificial Sequence
  Primer
gctccagaaggttttagcca

SEQ ID NO: 4008 - DNA, 20 bp, Artificial Sequence
  Primer
ccttgcagtagctgttatcg

SEQ ID NO: 4009 - DNA, 20 bp, Artificial Sequence
  Primer
gcctctaagttgccactgtt

SEQ ID NO: 4010 - DNA, 20 bp, Artificial Sequence
  Primer
cgtaactattggtgcatgcg

SEQ ID NO: 4011 - DNA, 20 bp, Artificial Sequence
  Primer
gagccttgagatacaggtct

SEQ ID NO: 4012 - DNA, 20 bp, Artificial Sequence
  Primer
gagcaatgcttcctcaagca

SEQ ID NO: 4013 - DNA, 20 bp, Artificial Sequence
  Primer
cccgttttgttttccctctg

SEQ ID NO: 4014 - DNA, 20 bp, Artificial Sequence
  Primer
aacagaagatctcccgccct

SEQ ID NO: 4015 - DNA, 20 bp, Artificial Sequence
  Primer
gttgcggcatgacgcttaca

SEQ ID NO: 4016 - DNA, 20 bp, Artificial Sequence
  Primer
tgcgctcacccctgaaactt

SEQ ID NO: 4017 - DNA, 20 bp, Artificial Sequence
  Primer
agacattgtcgactccggac

SEQ ID NO: 4018 - DNA, 20 bp, Artificial Sequence
  Primer
tctcgctttccctgccagaa

SEQ ID NO: 4019 - DNA, 20 bp, Artificial Sequence
  Primer
tccgtaagacctcgcagaaa

SEQ ID NO: 4020 - DNA, 20 bp, Artificial Sequence
  Primer
ctctgctgttatctgactgc

SEQ ID NO: 4021 - DNA, 20 bp, Artificial Sequence
  Primer
tcctatacaggcagaaccca

SEQ ID NO: 4022 - DNA, 20 bp, Artificial Sequence
  Primer
tttgtctctacgcaggaagc

SEQ ID NO: 4023 - DNA, 20 bp, Artificial Sequence
  Primer
aattggtaggacgccaaacg

SEQ ID NO: 4024 - DNA, 20 bp, Artificial Sequence
  Primer
gcgataatacgcgagatggt

SEQ ID NO: 4025 - DNA, 20 bp, Artificial Sequence
  Primer
ccagggtaaccactacgtta

SEQ ID NO: 4026 - DNA, 20 bp, Artificial Sequence
  Primer
ctgagcaccgatagtttcag

SEQ ID NO: 4027 - DNA, 20 bp, Artificial Sequence
  Primer
ggtgctggcgatagatcatt

SEQ ID NO: 4028 - DNA, 20 bp, Artificial Sequence
  Primer
gaagaatagactcccccgag

SEQ ID NO: 4029 - DNA, 20 bp, Artificial Sequence
  Primer
tttctccgagacaaacgtcg

SEQ ID NO: 4030 - DNA, 20 bp, Artificial Sequence
  Primer
cacagcaatacgttcgctac

SEQ ID NO: 4031 - DNA, 20 bp, Artificial Sequence
  Primer
gcgcctaaggcagataaaac

SEQ ID NO: 4032 - DNA, 20 bp, Artificial Sequence
  Primer
cagagagcattgagaagctg

SEQ ID NO: 4033 - DNA, 20 bp, Artificial Sequence
  Primer
ggcggtgctctaaccagttg

SEQ ID NO: 4034 - DNA, 20 bp, Artificial Sequence
  Primer
ccgctgaaactacctgatct

SEQ ID NO: 4035 - DNA, 20 bp, Artificial Sequence
  Primer
cgctgatgttgctctgaaag

SEQ ID NO: 4036 - DNA, 20 bp, Artificial Sequence
  Primer
ctagacgaggactctatcag

SEQ ID NO: 4037 - DNA, 20 bp, Artificial Sequence
  Primer
cctgctcgatttggaacgaa

SEQ ID NO: 4038 - DNA, 20 bp, Artificial Sequence
  Primer
cgctgatgttgctctgaaag

SEQ ID NO: 4039 - DNA, 20 bp, Artificial Sequence
  Primer
attccggacgctgcctttat

SEQ ID NO: 4040 - DNA, 20 bp, Artificial Sequence
  Primer
cctgctcgatttggaacgaa

SEQ ID NO: 4041 - DNA, 20 bp, Artificial Sequence
  Primer
gccccgttatttccttacga

SEQ ID NO: 4042 - DNA, 20 bp, Artificial Sequence
  Primer
ctttccctaggtatcgcgtt

SEQ ID NO: 4043 - DNA, 20 bp, Artificial Sequence
  Primer
ctaatagctcattgcgcagg

SEQ ID NO: 4044 - DNA, 20 bp, Artificial Sequence
  Primer
ccgaagagttctctgaagag

SEQ ID NO: 4045 - DNA, 20 bp, Artificial Sequence
  Primer
cggtcctgtactccgaataa

SEQ ID NO: 4046 - DNA, 20 bp, Artificial Sequence
  Primer
gctgacttcgccgatcttta

SEQ ID NO: 4047 - DNA, 20 bp, Artificial Sequence
  Primer
ctcttctccttcctcgtttg

SEQ ID NO: 4048 - DNA, 20 bp, Artificial Sequence
  Primer
gccccgttatttccttacga

SEQ ID NO: 4049 - DNA, 20 bp, Artificial Sequence
  Primer
gagatgccttaggaaaacgc

SEQ ID NO: 4050 - DNA, 20 bp, Artificial Sequence
  Primer
gctacacagctcttctgctt

SEQ ID NO: 4051 - DNA, 20 bp, Artificial Sequence
  Primer
ctgtcggagcaacgatttac

SEQ ID NO: 4052 - DNA, 20 bp, Artificial Sequence
  Primer
ctgtcggtaccaggtactta

SEQ ID NO: 4053 - DNA, 20 bp, Artificial Sequence
  Primer
cccttggtgagtcttctcaa

SEQ ID NO: 4054 - DNA, 20 bp, Artificial Sequence
  Primer
ctgatctttagaacggggaa

SEQ ID NO: 4055 - DNA, 20 bp, Artificial Sequence
  Primer
gctccaccaaagctactgcc

SEQ ID NO: 4056 - DNA, 20 bp, Artificial Sequence
  Primer
cgagccgctccctaacccca

SEQ ID NO: 4057 - DNA, 20 bp, Artificial Sequence
  Primer
cacatgattcgaactacagg

SEQ ID NO: 4058 - DNA, 20 bp, Artificial Sequence
  Primer
cacgacagatagatcaaagc

SEQ ID NO: 4059 - DNA, 20 bp, Artificial Sequence
  Primer
gggatctcttatccatggac

SEQ ID NO: 4060 - DNA, 20 bp, Artificial Sequence
  Primer
ctcccatacaaaagcgaacc

SEQ ID NO: 4061 - DNA, 20 bp, Artificial Sequence
  Primer
gtttcatcctcctcagcctt

SEQ ID NO: 4062 - DNA, 20 bp, Artificial Sequence
  Primer
gtgcgatatggaagcctctt

SEQ ID NO: 4063 - DNA, 20 bp, Artificial Sequence
  Primer
cctgaagacttcccaatcca

SEQ ID NO: 4064 - DNA, 20 bp, Artificial Sequence
  Primer
ctatcccaacccataggatg

SEQ ID NO: 4065 - DNA, 20 bp, Artificial Sequence
  Primer
cagcgagcttcacaaagtca

SEQ ID NO: 4066 - DNA, 20 bp, Artificial Sequence
  Primer
cagcgagcttcacaaagtca

SEQ ID NO: 4067 - DNA, 20 bp, Artificial Sequence
  Primer
gttgatcagcgtccactaac

SEQ ID NO: 4068 - DNA, 20 bp, Artificial Sequence
  Primer
aggggagccaacagactgac

SEQ ID NO: 4069 - DNA, 20 bp, Artificial Sequence
  Primer
ccccaatggctatcgaaact

SEQ ID NO: 4070 - DNA, 20 bp, Artificial Sequence
  Primer
ctgtcggtgaaagctagaag

SEQ ID NO: 4071 - DNA, 20 bp, Artificial Sequence
  Primer
taccgtagatgcgctttcca

SEQ ID NO: 4072 - DNA, 20 bp, Artificial Sequence
  Primer
tccaactcccccctgataat

SEQ ID NO: 4073 - DNA, 20 bp, Artificial Sequence
  Primer
gctccatccggatagtcagc

SEQ ID NO: 4074 - DNA, 20 bp, Artificial Sequence
  Primer
tgttgacgaccaagcagggg

SEQ ID NO: 4075 - DNA, 20 bp, Artificial Sequence
  Primer
gcatctcagcaacaaccaca

SEQ ID NO: 4076 - DNA, 20 bp, Artificial Sequence
  Primer
tccttaggcgcgaatcctat

SEQ ID NO: 4077 - DNA, 20 bp, Artificial Sequence
  Primer
aagctgcgatcgtcaagcat

SEQ ID NO: 4078 - DNA, 20 bp, Artificial Sequence
  Primer
gttgcttccatttgcgctct

SEQ ID NO: 4079 - DNA, 20 bp, Artificial Sequence
  Primer
ctatatcccaggctcaggta

SEQ ID NO: 4080 - DNA, 20 bp, Artificial Sequence
  Primer
gctgttatggaccgtggata

SEQ ID NO: 4081 - DNA, 20 bp, Artificial Sequence
  Primer
cacggaatccttccccttat

SEQ ID NO: 4082 - DNA, 20 bp, Artificial Sequence
  Primer
ggtattgcgtgtactgacac

SEQ ID NO: 4083 - DNA, 20 bp, Artificial Sequence
  Primer
ctcacaccttattgccctca

SEQ ID NO: 4084 - DNA, 20 bp, Artificial Sequence
  Primer
cccaattctctagggccaat

SEQ ID NO: 4085 - DNA, 20 bp, Artificial Sequence
  Primer
ccctcaaaaacgctcagctt

SEQ ID NO: 4086 - DNA, 20 bp, Artificial Sequence
  Primer
cctgtgatttcgtactcagc

SEQ ID NO: 4087 - DNA, 20 bp, Artificial Sequence
  Primer
gtgcattcgcagcatcagat

SEQ ID NO: 4088 - DNA, 20 bp, Artificial Sequence
  Primer
ctctatcacgacgtgttcca

SEQ ID NO: 4089 - DNA, 20 bp, Artificial Sequence
  Primer
ccttacccaggaggacaaaa

SEQ ID NO: 4090 - DNA, 20 bp, Artificial Sequence
  Primer
gtagctgtacaggagatctg

SEQ ID NO: 4091 - DNA, 20 bp, Artificial Sequence
  Primer
acgactataccctctattgc

SEQ ID NO: 4092 - DNA, 20 bp, Artificial Sequence
  Primer
gcaccttttcctgaagtctc

SEQ ID NO: 4093 - DNA, 20 bp, Artificial Sequence
  Primer
gcaaataacggtccgagcgt

SEQ ID NO: 4094 - DNA, 20 bp, Artificial Sequence
  Primer
gtgattacgactataccctc

SEQ ID NO: 4095 - DNA, 20 bp, Artificial Sequence
  Primer
ggaagttagcgcaacatcca

SEQ ID NO: 4096 - DNA, 20 bp, Artificial Sequence
  Primer
ccggatgcactatcagatga

SEQ ID NO: 4097 - DNA, 20 bp, Artificial Sequence
  Primer
caacgctccttcgatatgcg

SEQ ID NO: 4098 - DNA, 20 bp, Artificial Sequence
  Primer
ctgggtattcgcggtcgaat

SEQ ID NO: 4099 - DNA, 20 bp, Artificial Sequence
  Primer
caggtctcgatccctgaata

SEQ ID NO: 4100 - DNA, 20 bp, Artificial Sequence
  Primer
gagacaaatggtctcggaga

SEQ ID NO: 4101 - DNA, 20 bp, Artificial Sequence
  Primer
ggttgcgcaatatagacgca

SEQ ID NO: 4102 - DNA, 20 bp, Artificial Sequence
  Primer
cctcgaccgttatccgaaat

SEQ ID NO: 4103 - DNA, 20 bp, Artificial Sequence
  Primer
cggatcttctgtagaaactg

SEQ ID NO: 4104 - DNA, 20 bp, Artificial Sequence
  Primer
ccggaagtatcaccgcaaat

SEQ ID NO: 4105 - DNA, 20 bp, Artificial Sequence
  Primer
caacttgacagctgactaca

SEQ ID NO: 4106 - DNA, 20 bp, Artificial Sequence
  Primer
gttgtgcacgagctgctaaa

SEQ ID NO: 4107 - DNA, 20 bp, Artificial Sequence
  Primer
gtcgctctttctggaggaaa

SEQ ID NO: 4108 - DNA, 20 bp, Artificial Sequence
  Primer
gaggagagtactcgtgtatg

SEQ ID NO: 4109 - DNA, 20 bp, Artificial Sequence
  Primer
gcagggaaacgtcttcctaa

SEQ ID NO: 4110 - DNA, 20 bp, Artificial Sequence
  Primer
ttccgattgttcgacaagcg

SEQ ID NO: 4111 - DNA, 20 bp, Artificial Sequence
  Primer
cgaagaaatgaagcttgccg

SEQ ID NO: 4112 - DNA, 20 bp, Artificial Sequence
  Primer
cccgaagcttatgaacggtt

SEQ ID NO: 4113 - DNA, 20 bp, Artificial Sequence
  Primer
gcgctgctaaagcctattct

SEQ ID NO: 4114 - DNA, 20 bp, Artificial Sequence
  Primer
gcacaagcagaacgcatgtt

SEQ ID NO: 4115 - DNA, 20 bp, Artificial Sequence
  Primer
ctggaggcgtagtttcttct

SEQ ID NO: 4116 - DNA, 20 bp, Artificial Sequence
  Primer
gcacaagcagaacgcatgtt

SEQ ID NO: 4117 - DNA, 20 bp, Artificial Sequence
  Primer
ctggaggcgtagtttcttct

SEQ ID NO: 4118 - DNA, 20 bp, Artificial Sequence
  Primer
gcgctgctaaagcctattct

SEQ ID NO: 4119 - DNA, 20 bp, Artificial Sequence
  Primer
ccccgaagcgatattgacag

SEQ ID NO: 4120 - DNA, 20 bp, Artificial Sequence
  Primer
ctctgctgcttataagacgg

SEQ ID NO: 4121 - DNA, 20 bp, Artificial Sequence
  Primer
gtggcaacagatgatcaacg

SEQ ID NO: 4122 - DNA, 20 bp, Artificial Sequence
  Primer
cccgaagcgatattgacaga

SEQ ID NO: 4123 - DNA, 20 bp, Artificial Sequence
  Primer
cagagtgcgatgcatgagaa

SEQ ID NO: 4124 - DNA, 20 bp, Artificial Sequence
  Primer
cctcgcatgaggttttttgt

SEQ ID NO: 4125 - DNA, 20 bp, Artificial Sequence
  Primer
gagtgcgaatttcaccctgt

SEQ ID NO: 4126 - DNA, 20 bp, Artificial Sequence
  Primer
tggggaacgtcccttataca

SEQ ID NO: 4127 - DNA, 20 bp, Artificial Sequence
  Primer
gtcatctccgttggttgagt

SEQ ID NO: 4128 - DNA, 20 bp, Artificial Sequence
  Primer
cctggaagaatgaatggaag

SEQ ID NO: 4129 - DNA, 20 bp, Artificial Sequence
  Primer
ggtggcataatcgaacgctt

SEQ ID NO: 4130 - DNA, 20 bp, Artificial Sequence
  Primer
gacacatgccgcttctttgt

SEQ ID NO: 4131 - DNA, 20 bp, Artificial Sequence
  Primer
caagaaaacagccaagcaag

SEQ ID NO: 4132 - DNA, 20 bp, Artificial Sequence
  Primer
ggtggcataatcgaacgctt

SEQ ID NO: 4133 - DNA, 20 bp, Artificial Sequence
  Primer
gccaagcacgatgttctgtt

SEQ ID NO: 4134 - DNA, 20 bp, Artificial Sequence
  Primer
acaagagccaatggaagcgt

SEQ ID NO: 4135 - DNA, 20 bp, Artificial Sequence
  Primer
ccagcatcctatagagaggt

SEQ ID NO: 4136 - DNA, 20 bp, Artificial Sequence
  Primer
gtagcgcacctgattgtgat

SEQ ID NO: 4137 - DNA, 20 bp, Artificial Sequence
  Primer
gctccttctctaccaaagga

SEQ ID NO: 4138 - DNA, 20 bp, Artificial Sequence
  Primer
gactgcacttgcacaaacag

SEQ ID NO: 4139 - DNA, 20 bp, Artificial Sequence
  Primer
caggattattctgtcgccag

SEQ ID NO: 4140 - DNA, 20 bp, Artificial Sequence
  Primer
cctggagtattccacggatt

SEQ ID NO: 4141 - DNA, 20 bp, Artificial Sequence
  Primer
gggtagagcattgggtgaaa

SEQ ID NO: 4142 - DNA, 20 bp, Artificial Sequence
  Primer
caggattattctgtcgccag

SEQ ID NO: 4143 - DNA, 20 bp, Artificial Sequence
  Primer
ggcgcttgcttctctatgtt

SEQ ID NO: 4144 - DNA, 20 bp, Artificial Sequence
  Primer
caagctcctggagatatgct

SEQ ID NO: 4145 - DNA, 20 bp, Artificial Sequence
  Primer
ctgtagattcaatgtgtctc

SEQ ID NO: 4146 - DNA, 20 bp, Artificial Sequence
  Primer
ggtaagagtaatgtggacgg

SEQ ID NO: 4147 - DNA, 20 bp, Artificial Sequence
  Primer
gtggcaagagggatcaatgt

SEQ ID NO: 4148 - DNA, 20 bp, Artificial Sequence
  Primer
ccggcgccaagtatttatca

SEQ ID NO: 4149 - DNA, 20 bp, Artificial Sequence
  Primer
aggagtttcgttctctccgt

SEQ ID NO: 4150 - DNA, 20 bp, Artificial Sequence
  Primer
gaatacactgattcgcctgt

SEQ ID NO: 4151 - DNA, 20 bp, Artificial Sequence
  Primer
gggttgcaaaagagttcgtg

SEQ ID NO: 4152 - DNA, 20 bp, Artificial Sequence
  Primer
gaggatgtggttccagagat

SEQ ID NO: 4153 - DNA, 20 bp, Artificial Sequence
  Primer
aaagctggctaggtgtcggt

SEQ ID NO: 4154 - DNA, 20 bp, Artificial Sequence
  Primer
ctccgtagggaggaaaatta

SEQ ID NO: 4155 - DNA, 20 bp, Artificial Sequence
  Primer
ggatctgctttgctgatcac

SEQ ID NO: 4156 - DNA, 20 bp, Artificial Sequence
  Primer
gggttgcaaaagagttcgtg

SEQ ID NO: 4157 - DNA, 20 bp, Artificial Sequence
  Primer
gaggaaagggaagtgggtaa

SEQ ID NO: 4158 - DNA, 20 bp, Artificial Sequence
  Primer
cgtcctcgagaatgagagat

SEQ ID NO: 4159 - DNA, 20 bp, Artificial Sequence
  Primer
gctctattagaagcctcagc

SEQ ID NO: 4160 - DNA, 20 bp, Artificial Sequence
  Primer
cttggtgaagaggggtttcg

SEQ ID NO: 4161 - DNA, 20 bp, Artificial Sequence
  Primer
gaacatggtgcgaagtctga

SEQ ID NO: 4162 - DNA, 20 bp, Artificial Sequence
  Primer
gaccgagctgtaggagatga

SEQ ID NO: 4163 - DNA, 20 bp, Artificial Sequence
  Primer
ggattctctggtgatgcgat

SEQ ID NO: 4164 - DNA, 20 bp, Artificial Sequence
  Primer
cttgggcaagagctaagaag

SEQ ID NO: 4165 - DNA, 20 bp, Artificial Sequence
  Primer
gaaaaggcggctgcttcaga

SEQ ID NO: 4166 - DNA, 20 bp, Artificial Sequence
  Primer
gagaaacgtcctaatcgtgg

SEQ ID NO: 4167 - DNA, 20 bp, Artificial Sequence
  Primer
ggcagcttctaaggtaaacc

SEQ ID NO: 4168 - DNA, 20 bp, Artificial Sequence
  Primer
cgccataacattccaaaggc

SEQ ID NO: 4169 - DNA, 20 bp, Artificial Sequence
  Primer
gcagacgaaccttctggaaa

SEQ ID NO: 4170 - DNA, 20 bp, Artificial Sequence
  Primer
ggaactagctgaaaagtgcc

SEQ ID NO: 4171 - DNA, 20 bp, Artificial Sequence
  Primer
ggagacctcgctagtttaca

SEQ ID NO: 4172 - DNA, 20 bp, Artificial Sequence
  Primer
ggggtcgattttagctgcat

SEQ ID NO: 4173 - DNA, 20 bp, Artificial Sequence
  Primer
gctgcaaaaccacttccaga

SEQ ID NO: 4174 - DNA, 20 bp, Artificial Sequence
  Primer
gctggttggcggattttctt

SEQ ID NO: 4175 - DNA, 20 bp, Artificial Sequence
  Primer
gcttgaggggaagttgtttg

SEQ ID NO: 4176 - DNA, 20 bp, Artificial Sequence
  Primer
gcgagagcagattttgatta

SEQ ID NO: 4177 - DNA, 20 bp, Artificial Sequence
  Primer
ggagtaaagatctctcgtcc

SEQ ID NO: 4178 - DNA, 20 bp, Artificial Sequence
  Primer
gggattggctcccatgatta

SEQ ID NO: 4179 - DNA, 20 bp, Artificial Sequence
  Primer
agttctgccaaaaagccgga

SEQ ID NO: 4180 - DNA, 20 bp, Artificial Sequence
  Primer
gaagagcagtttgcgaagac

SEQ ID NO: 4181 - DNA, 20 bp, Artificial Sequence
  Primer
ggattgactgatgagcttgc

SEQ ID NO: 4182 - DNA, 20 bp, Artificial Sequence
  Primer
cacagctgatcaaaggccta

SEQ ID NO: 4183 - DNA, 20 bp, Artificial Sequence
  Primer
caacgctaccaggtggatgc

SEQ ID NO: 4184 - DNA, 20 bp, Artificial Sequence
  Primer
atccgctccctaggggggaa

SEQ ID NO: 4185 - DNA, 20 bp, Artificial Sequence
  Primer
catcgaaataatcctggggc

SEQ ID NO: 4186 - DNA, 20 bp, Artificial Sequence
  Primer
aatcctcgtaatgcagctgg

SEQ ID NO: 4187 - DNA, 20 bp, Artificial Sequence
  Primer
gcgcgagagagtattacacg

SEQ ID NO: 4188 - DNA, 20 bp, Artificial Sequence
  Primer
ccccatgttgtctatagcga

SEQ ID NO: 4189 - DNA, 20 bp, Artificial Sequence
  Primer
cgtcatgcaagcttggtggc

SEQ ID NO: 4190 - DNA, 20 bp, Artificial Sequence
  Primer
caatgtgtatgaatggtgcc

SEQ ID NO: 4191 - DNA, 20 bp, Artificial Sequence
  Primer
tgcgcagcaacatactatgc

SEQ ID NO: 4192 - DNA, 20 bp, Artificial Sequence
  Primer
ctgttgttccttaacggagc

SEQ ID NO: 4193 - DNA, 20 bp, Artificial Sequence
  Primer
ctactgctgtaggaacagca

SEQ ID NO: 4194 - DNA, 20 bp, Artificial Sequence
  Primer
caggtaatgaggatccaacg

SEQ ID NO: 4195 - DNA, 20 bp, Artificial Sequence
  Primer
gactaccgtgtgcagaaaga

SEQ ID NO: 4196 - DNA, 20 bp, Artificial Sequence
  Primer
cggtccctttaggaaaggaa

SEQ ID NO: 4197 - DNA, 20 bp, Artificial Sequence
  Primer
cagcatcagtgatcacaacg

SEQ ID NO: 4198 - DNA, 20 bp, Artificial Sequence
  Primer
cggactgtaaatccgactcc

SEQ ID NO: 4199 - DNA, 20 bp, Artificial Sequence
  Primer
gcccgtcttccgaaatttga

SEQ ID NO: 4200 - DNA, 20 bp, Artificial Sequence
  Primer
gttagcttctccttgtgtgg

SEQ ID NO: 4201 - DNA, 20 bp, Artificial Sequence
  Primer
gcaaggggatggaaagctat

SEQ ID NO: 4202 - DNA, 20 bp, Artificial Sequence
  Primer
gcaaggggatggaaagctat

SEQ ID NO: 4203 - DNA, 20 bp, Artificial Sequence
  Primer
gagcattaaggcggggcaag

SEQ ID NO: 4204 - DNA, 20 bp, Artificial Sequence
  Primer
catgcccaagagttagggat

SEQ ID NO: 4205 - DNA, 20 bp, Artificial Sequence
  Primer
ggaaagagatcgatcggaag

SEQ ID NO: 4206 - DNA, 20 bp, Artificial Sequence
  Primer
gctttacgctctcctacaca

SEQ ID NO: 4207 - DNA, 20 bp, Artificial Sequence
  Primer
agctgtcggagttttggtcg

SEQ ID NO: 4208 - DNA, 20 bp, Artificial Sequence
  Primer
cgttccgaatcaatcttggg

SEQ ID NO: 4209 - DNA, 20 bp, Artificial Sequence
  Primer
agggccaatggtagttgcag

SEQ ID NO: 4210 - DNA, 20 bp, Artificial Sequence
  Primer
gagaaaatgcagcgattccc

SEQ ID NO: 4211 - DNA, 20 bp, Artificial Sequence
  Primer
atcttgggcaatgacttccc

SEQ ID NO: 4212 - DNA, 20 bp, Artificial Sequence
  Primer
agagaggggccatcgaaaat

SEQ ID NO: 4213 - DNA, 20 bp, Artificial Sequence
  Primer
gcgatagcttgttctggaga

SEQ ID NO: 4214 - DNA, 20 bp, Artificial Sequence
  Primer
ctcctgctagtgagagagta

SEQ ID NO: 4215 - DNA, 20 bp, Artificial Sequence
  Primer
gagtgattcctgaacagaag

SEQ ID NO: 4216 - DNA, 20 bp, Artificial Sequence
  Primer
tcgcccgtttgagagggaat

SEQ ID NO: 4217 - DNA, 20 bp, Artificial Sequence
  Primer
ggggagatccattcttccat

SEQ ID NO: 4218 - DNA, 20 bp, Artificial Sequence
  Primer
gacagtcttcgacttaggag

SEQ ID NO: 4219 - DNA, 20 bp, Artificial Sequence
  Primer
aataagaaggttaaggctcc

SEQ ID NO: 4220 - DNA, 20 bp, Artificial Sequence
  Primer
gcctgaggaagaagaccaat

SEQ ID NO: 4221 - DNA, 20 bp, Artificial Sequence
  Primer
gtaaccacgaagttttgccg

SEQ ID NO: 4222 - DNA, 20 bp, Artificial Sequence
  Primer
tcgattcctcggatgcgaat

SEQ ID NO: 4223 - DNA, 20 bp, Artificial Sequence
  Primer
cgttctggggaaatttccca

SEQ ID NO: 4224 - DNA, 20 bp, Artificial Sequence
  Primer
gtctaaggaaggagaggcta

SEQ ID NO: 4225 - DNA, 20 bp, Artificial Sequence
  Primer
ctccaggagagataggaaag

SEQ ID NO: 4226 - DNA, 20 bp, Artificial Sequence
  Primer
catgaccgtaagatgatcgg

SEQ ID NO: 4227 - DNA, 20 bp, Artificial Sequence
  Primer
gctgttcagcttctacatcc

SEQ ID NO: 4228 - DNA, 20 bp, Artificial Sequence
  Primer
cccggatgcttgcacagaga

SEQ ID NO: 4229 - DNA, 20 bp, Artificial Sequence
  Primer
ctcatcagttatctggaggg

SEQ ID NO: 4230 - DNA, 20 bp, Artificial Sequence
  Primer
cgacttctgctttggatcct

SEQ ID NO: 4231 - DNA, 20 bp, Artificial Sequence
  Primer
ccagaacaggttgagtttcc

SEQ ID NO: 4232 - DNA, 20 bp, Artificial Sequence
  Primer
aggaccacagatcttcttgc

SEQ ID NO: 4233 - DNA, 20 bp, Artificial Sequence
  Primer
cccaaacgtacggagtatct

SEQ ID NO: 4234 - DNA, 20 bp, Artificial Sequence
  Primer
ggggcgcccataataataag

SEQ ID NO: 4235 - DNA, 20 bp, Artificial Sequence
  Primer
gaggaggggttcaaggtcag

SEQ ID NO: 4236 - DNA, 20 bp, Artificial Sequence
  Primer
gccagggtatggcttccata

SEQ ID NO: 4237 - DNA, 20 bp, Artificial Sequence
  Primer
gcgtctggtagcaccttttt

SEQ ID NO: 4238 - DNA, 20 bp, Artificial Sequence
  Primer
ggtcaggttattgctactcg

SEQ ID NO: 4239 - DNA, 20 bp, Artificial Sequence
  Primer
ggatctgaaggtgtggtgaa

SEQ ID NO: 4240 - DNA, 20 bp, Artificial Sequence
  Primer
ggcgcaaaaagagctcagaa

SEQ ID NO: 4241 - DNA, 20 bp, Artificial Sequence
  Primer
gtctggtcgcgtagaagaaa

SEQ ID NO: 4242 - DNA, 20 bp, Artificial Sequence
  Primer
gcgtctggtagcaccttttt

SEQ ID NO: 4243 - DNA, 20 bp, Artificial Sequence
  Primer
cgatacgcgtacttgtgagt

SEQ ID NO: 4244 - DNA, 20 bp, Artificial Sequence
  Primer
ttagctcggagtgccgggta

SEQ ID NO: 4245 - DNA, 20 bp, Artificial Sequence
  Primer
ggcgcagatattttggttgc

SEQ ID NO: 4246 - DNA, 20 bp, Artificial Sequence
  Primer
gctggtcggcactttttatg

SEQ ID NO: 4247 - DNA, 20 bp, Artificial Sequence
  Primer
gaaaccagatcctagggctt

SEQ ID NO: 4248 - DNA, 20 bp, Artificial Sequence
  Primer
gctttagtgcatgaaggcac

SEQ ID NO: 4249 - DNA, 20 bp, Artificial Sequence
  Primer
gaggcaacagagcctttaag

SEQ ID NO: 4250 - DNA, 20 bp, Artificial Sequence
  Primer
cttatgtctgtgcatcctgg

SEQ ID NO: 4251 - DNA, 20 bp, Artificial Sequence
  Primer
tagtgtttctggggcattcg

SEQ ID NO: 4252 - DNA, 20 bp, Artificial Sequence
  Primer
gaacatgttgcattggcgat

SEQ ID NO: 4253 - DNA, 20 bp, Artificial Sequence
  Primer
ggggctttgtgtgttctttc

SEQ ID NO: 4254 - DNA, 20 bp, Artificial Sequence
  Primer
gaggcaacagagcctttaag

SEQ ID NO: 4255 - DNA, 20 bp, Artificial Sequence
  Primer
ggcttcattgagaggctgtt

SEQ ID NO: 4256 - DNA, 20 bp, Artificial Sequence
  Primer
gacatgtgattcgcgtagga

SEQ ID NO: 4257 - DNA, 20 bp, Artificial Sequence
  Primer
tccggtagtttttgcgtccg

SEQ ID NO: 4258 - DNA, 20 bp, Artificial Sequence
  Primer
gaatggggctttgtgtgttc

SEQ ID NO: 4259 - DNA, 20 bp, Artificial Sequence
  Primer
gcagatggagcttatagggt

SEQ ID NO: 4260 - DNA, 20 bp, Artificial Sequence
  Primer
gctcttgttttgaatggggc

SEQ ID NO: 4261 - DNA, 20 bp, Artificial Sequence
  Primer
gcagatggagcttatagggt

SEQ ID NO: 4262 - DNA, 20 bp, Artificial Sequence
  Primer
gctgactacagaagctgtga

SEQ ID NO: 4263 - DNA, 20 bp, Artificial Sequence
  Primer
acggatgagaaaggagccta

SEQ ID NO: 4264 - DNA, 20 bp, Artificial Sequence
  Primer
gttaaacggagccttctagc

SEQ ID NO: 4265 - DNA, 20 bp, Artificial Sequence
  Primer
tatctgttgttgcccctgcg

SEQ ID NO: 4266 - DNA, 20 bp, Artificial Sequence
  Primer
gaggggttgttttccgaaaa

SEQ ID NO: 4267 - DNA, 20 bp, Artificial Sequence
  Primer
ggatagcaagaagcgtaagg

SEQ ID NO: 4268 - DNA, 20 bp, Artificial Sequence
  Primer
ggcatcttcctactgaaagg

SEQ ID NO: 4269 - DNA, 20 bp, Artificial Sequence
  Primer
gggtagcagaactacgctat

SEQ ID NO: 4270 - DNA, 20 bp, Artificial Sequence
  Primer
cgttcctttgactacggaag

SEQ ID NO: 4271 - DNA, 20 bp, Artificial Sequence
  Primer
gactcacctagtgctgaaga

SEQ ID NO: 4272 - DNA, 20 bp, Artificial Sequence
  Primer
gccagtaaggagaagagagt

SEQ ID NO: 4273 - DNA, 20 bp, Artificial Sequence
  Primer
cagttggcatgatcaactgc

SEQ ID NO: 4274 - DNA, 20 bp, Artificial Sequence
  Primer
agctagctagttcttccagc

SEQ ID NO: 4275 - DNA, 20 bp, Artificial Sequence
  Primer
cctgcgtttgcagcaatttg

SEQ ID NO: 4276 - DNA, 20 bp, Artificial Sequence
  Primer
ggtcgttgcttgatctgaca

SEQ ID NO: 4277 - DNA, 20 bp, Artificial Sequence
  Primer
ctctgcaatgagagcttctg

SEQ ID NO: 4278 - DNA, 20 bp, Artificial Sequence
  Primer
ggccctagagtgacttttac

SEQ ID NO: 4279 - DNA, 20 bp, Artificial Sequence
  Primer
cttgagactcacgtactcaa

SEQ ID NO: 4280 - DNA, 20 bp, Artificial Sequence
  Primer
gacgatggtcgtgtcttctt

SEQ ID NO: 4281 - DNA, 20 bp, Artificial Sequence
  Primer
cttcccagaaatggaggttc

SEQ ID NO: 4282 - DNA, 20 bp, Artificial Sequence
  Primer
gaaacgaggctcgaagaatc

SEQ ID NO: 4283 - DNA, 20 bp, Artificial Sequence
  Primer
ggagagacgctgcattttgt

SEQ ID NO: 4284 - DNA, 20 bp, Artificial Sequence
  Primer
ggatagccactgctcaacaa

SEQ ID NO: 4285 - DNA, 20 bp, Artificial Sequence
  Primer
cgagcagctatttccaggtt

SEQ ID NO: 4286 - DNA, 20 bp, Artificial Sequence
  Primer
cgaagctaaaaaccagcagg

SEQ ID NO: 4287 - DNA, 20 bp, Artificial Sequence
  Primer
gaagcgttcaatgcgaccat

SEQ ID NO: 4288 - DNA, 20 bp, Artificial Sequence
  Primer
ggagagacgctgcattttgt

SEQ ID NO: 4289 - DNA, 20 bp, Artificial Sequence
  Primer
attctaagcggaggctcggt

SEQ ID NO: 4290 - DNA, 20 bp, Artificial Sequence
  Primer
gtggagaagagtgttcgatg

SEQ ID NO: 4291 - DNA, 20 bp, Artificial Sequence
  Primer
gcgcaaagccaacgtgttcg

SEQ ID NO: 4292 - DNA, 20 bp, Artificial Sequence
  Primer
gtgtgcaaagctcctctatc

SEQ ID NO: 4293 - DNA, 20 bp, Artificial Sequence
  Primer
ttcatcaggcagtgagggta

SEQ ID NO: 4294 - DNA, 20 bp, Artificial Sequence
  Primer
gagaggagagtagcagattc

SEQ ID NO: 4295 - DNA, 20 bp, Artificial Sequence
  Primer
gggagatgctttcaggtttc

SEQ ID NO: 4296 - DNA, 20 bp, Artificial Sequence
  Primer
tattatggcttctggggatg

SEQ ID NO: 4297 - DNA, 20 bp, Artificial Sequence
  Primer
gttgttccagaggccctatt

SEQ ID NO: 4298 - DNA, 20 bp, Artificial Sequence
  Primer
gatcaacgggttttggcttc

SEQ ID NO: 4299 - DNA, 20 bp, Artificial Sequence
  Primer
ggacatcaccgctgttgatt

SEQ ID NO: 4300 - DNA, 20 bp, Artificial Sequence
  Primer
tggtagtgcagggcaagata

SEQ ID NO: 4301 - DNA, 20 bp, Artificial Sequence
  Primer
ggcaagatttcccttgcact

SEQ ID NO: 4302 - DNA, 20 bp, Artificial Sequence
  Primer
ctctagttcgttctatcgac

SEQ ID NO: 4303 - DNA, 20 bp, Artificial Sequence
  Primer
gaacacgttttcctggagga

SEQ ID NO: 4304 - DNA, 20 bp, Artificial Sequence
  Primer
tcccagagggagtgttgggg

SEQ ID NO: 4305 - DNA, 20 bp, Artificial Sequence
  Primer
ctcatcccatggattaggag

SEQ ID NO: 4306 - DNA, 20 bp, Artificial Sequence
  Primer
gctccccaagtataatcagc

SEQ ID NO: 4307 - DNA, 20 bp, Artificial Sequence
  Primer
cctactatcgtagagcgttg

SEQ ID NO: 4308 - DNA, 20 bp, Artificial Sequence
  Primer
cgcagcaattttcagagcag

SEQ ID NO: 4309 - DNA, 20 bp, Artificial Sequence
  Primer
cgttgactctctgcgataag

SEQ ID NO: 4310 - DNA, 20 bp, Artificial Sequence
  Primer
caattctgtcgatacagggg

SEQ ID NO: 4311 - DNA, 20 bp, Artificial Sequence
  Primer
cagcaactaccaagactacg

SEQ ID NO: 4312 - DNA, 20 bp, Artificial Sequence
  Primer
ctgcagcaaatgaagagcga

SEQ ID NO: 4313 - DNA, 20 bp, Artificial Sequence
  Primer
ccttctcagagcggatattc

SEQ ID NO: 4314 - DNA, 20 bp, Artificial Sequence
  Primer
ccgaagcttttaatgccgca

SEQ ID NO: 4315 - DNA, 20 bp, Artificial Sequence
  Primer
gcttacgatggaagagctgg

SEQ ID NO: 4316 - DNA, 20 bp, Artificial Sequence
  Primer
gtcgggtgaattttctccct

SEQ ID NO: 4317 - DNA, 20 bp, Artificial Sequence
  Primer
cacaggaaagcctatgctct

SEQ ID NO: 4318 - DNA, 20 bp, Artificial Sequence
  Primer
gggagaacggctagataatc

SEQ ID NO: 4319 - DNA, 20 bp, Artificial Sequence
  Primer
gagtaaggggttgtgtagag

SEQ ID NO: 4320 - DNA, 20 bp, Artificial Sequence
  Primer
gagactcgagcttggacaat

SEQ ID NO: 4321 - DNA, 20 bp, Artificial Sequence
  Primer
gacgtatcctcgtaagcgat

SEQ ID NO: 4322 - DNA, 20 bp, Artificial Sequence
  Primer
gccagttgcttaagcgctat

SEQ ID NO: 4323 - DNA, 20 bp, Artificial Sequence
  Primer
gtggttacgataccagctgt

SEQ ID NO: 4324 - DNA, 20 bp, Artificial Sequence
  Primer
gcgctgggaatatacaaggc

SEQ ID NO: 4325 - DNA, 20 bp, Artificial Sequence
  Primer
cttctcacctcacggttaga

SEQ ID NO: 4326 - DNA, 20 bp, Artificial Sequence
  Primer
aacttcatggctccgtccat

SEQ ID NO: 4327 - DNA, 20 bp, Artificial Sequence
  Primer
cgcatcgagaatttcgtcag

SEQ ID NO: 4328 - DNA, 20 bp, Artificial Sequence
  Primer
ctctgtgctctcggatttct

SEQ ID NO: 4329 - DNA, 20 bp, Artificial Sequence
  Primer
tgctgcatttctcgtatgcg

SEQ ID NO: 4330 - DNA, 20 bp, Artificial Sequence
  Primer
gcggagatccattgatagac

SEQ ID NO: 4331 - DNA, 20 bp, Artificial Sequence
  Primer
cgacagggcaactgtaacaa

SEQ ID NO: 4332 - DNA, 20 bp, Artificial Sequence
  Primer
gaccctgtatcgttaatcgg

SEQ ID NO: 4333 - DNA, 20 bp, Artificial Sequence
  Primer
cgtcgtagtccgcttattcg

SEQ ID NO: 4334 - DNA, 20 bp, Artificial Sequence
  Primer
ggaacagagccagatagtca

SEQ ID NO: 4335 - DNA, 20 bp, Artificial Sequence
  Primer
cggtcaaaattcatgcgttc

SEQ ID NO: 4336 - DNA, 20 bp, Artificial Sequence
  Primer
gatggatttcagcgatctcc

SEQ ID NO: 4337 - DNA, 20 bp, Artificial Sequence
  Primer
gggctggggcttttagtaaa

SEQ ID NO: 4338 - DNA, 20 bp, Artificial Sequence
  Primer
cacctcgataaggtgctgtt

SEQ ID NO: 4339 - DNA, 20 bp, Artificial Sequence
  Primer
gacctccagacccattgatt

SEQ ID NO: 4340 - DNA, 20 bp, Artificial Sequence
  Primer
gctgatcgaatatggtgaag

SEQ ID NO: 4341 - DNA, 20 bp, Artificial Sequence
  Primer
tacgtcgagctcctaccgta

SEQ ID NO: 4342 - DNA, 20 bp, Artificial Sequence
  Primer
gtcatcgagtggtcttggga

SEQ ID NO: 4343 - DNA, 20 bp, Artificial Sequence
  Primer
tcttgatgggaagacaggcg

SEQ ID NO: 4344 - DNA, 20 bp, Artificial Sequence
  Primer
gtaaaggtcctggaggacct

SEQ ID NO: 4345 - DNA, 20 bp, Artificial Sequence
  Primer
gcgaaagagttcgatgtgct

SEQ ID NO: 4346 - DNA, 20 bp, Artificial Sequence
  Primer
gttaggcatgagtgcctgct

SEQ ID NO: 4347 - DNA, 20 bp, Artificial Sequence
  Primer
agcggtactccaatagctga

SEQ ID NO: 4348 - DNA, 20 bp, Artificial Sequence
  Primer
ggcttgggagagattctcaa

SEQ ID NO: 4349 - DNA, 20 bp, Artificial Sequence
  Primer
cgagaggcgaaagtttcctt

SEQ ID NO: 4350 - DNA, 20 bp, Artificial Sequence
  Primer
gtggtgcgattaatacggga

SEQ ID NO: 4351 - DNA, 20 bp, Artificial Sequence
  Primer
ccacgactgtcatagttcca

SEQ ID NO: 4352 - DNA, 20 bp, Artificial Sequence
  Primer
cctccccattctacgtagta

SEQ ID NO: 4353 - DNA, 20 bp, Artificial Sequence
  Primer
ccacttgtttgagaagggag

SEQ ID NO: 4354 - DNA, 20 bp, Artificial Sequence
  Primer
gctgcagctatgaaacgttc

SEQ ID NO: 4355 - DNA, 20 bp, Artificial Sequence
  Primer
ggaattcatctccggtccta

SEQ ID NO: 4356 - DNA, 20 bp, Artificial Sequence
  Primer
gaaggcggaaattcacatgg

SEQ ID NO: 4357 - DNA, 20 bp, Artificial Sequence
  Primer
ggggattcctctgtaatgag

SEQ ID NO: 4358 - DNA, 20 bp, Artificial Sequence
  Primer
tgcgagaacacagcttctat

SEQ ID NO: 4359 - DNA, 20 bp, Artificial Sequence
  Primer
gtgagctcctaagcagtgaa

SEQ ID NO: 4360 - DNA, 20 bp, Artificial Sequence
  Primer
gggatcagctaatagggaag

SEQ ID NO: 4361 - DNA, 20 bp, Artificial Sequence
  Primer
tcaagggaaggtggtgtttg

SEQ ID NO: 4362 - DNA, 20 bp, Artificial Sequence
  Primer
gacctgtaggaattgtgcgt

SEQ ID NO: 4363 - DNA, 20 bp, Artificial Sequence
  Primer
ggcgagatttcttggcatca

SEQ ID NO: 4364 - DNA, 20 bp, Artificial Sequence
  Primer
ttgttggacaaacagcgagc

SEQ ID NO: 4365 - DNA, 20 bp, Artificial Sequence
  Primer
cctcccagtatgctatttcc

SEQ ID NO: 4366 - DNA, 20 bp, Artificial Sequence
  Primer
ccctggctttaggttttctg

SEQ ID NO: 4367 - DNA, 20 bp, Artificial Sequence
  Primer
gcttgtcattggtaatgcgg

SEQ ID NO: 4368 - DNA, 20 bp, Artificial Sequence
  Primer
ggccagagctcgtgctcaag

SEQ ID NO: 4369 - DNA, 20 bp, Artificial Sequence
  Primer
ggctatgtatgcgaatgtag

SEQ ID NO: 4370 - DNA, 20 bp, Artificial Sequence
  Primer
cattcctgggttgatcgcaa

SEQ ID NO: 4371 - DNA, 20 bp, Artificial Sequence
  Primer
gggcttttaataggtgccct

SEQ ID NO: 4372 - DNA, 20 bp, Artificial Sequence
  Primer
gggctattatgctccgtcaa

SEQ ID NO: 4373 - DNA, 20 bp, Artificial Sequence
  Primer
ggcgactttagggtatacag

SEQ ID NO: 4374 - DNA, 20 bp, Artificial Sequence
  Primer
gggttggtctgtgtctgttt

SEQ ID NO: 4375 - DNA, 20 bp, Artificial Sequence
  Primer
gagcttttttagcgcggtca

SEQ ID NO: 4376 - DNA, 20 bp, Artificial Sequence
  Primer
ggtgataaggtatttcccag

SEQ ID NO: 4377 - DNA, 20 bp, Artificial Sequence
  Primer
cgtctcgctaagtctccttt

SEQ ID NO: 4378 - DNA, 20 bp, Artificial Sequence
  Primer
ttcgttgcccctcctttatc

SEQ ID NO: 4379 - DNA, 20 bp, Artificial Sequence
  Primer
ggctgcggcattaattcaac

SEQ ID NO: 4380 - DNA, 20 bp, Artificial Sequence
  Primer
ggcctcttatcagatggttg

SEQ ID NO: 4381 - DNA, 20 bp, Artificial Sequence
  Primer
gcaggttagtagcagaaatc

SEQ ID NO: 4382 - DNA, 20 bp, Artificial Sequence
  Primer
gtcacaggccacaatgcgtt

SEQ ID NO: 4383 - DNA, 20 bp, Artificial Sequence
  Primer
ccaggagggcggaataaaaa

SEQ ID NO: 4384 - DNA, 20 bp, Artificial Sequence
  Primer
gcaggttagtagcagaaatc

SEQ ID NO: 4385 - DNA, 20 bp, Artificial Sequence
  Primer
catccaccagtagcaagcag

SEQ ID NO: 4386 - DNA, 20 bp, Artificial Sequence
  Primer
gtaagcattccaaagctccg

SEQ ID NO: 4387 - DNA, 20 bp, Artificial Sequence
  Primer
tctctgctgctgcagcttct

SEQ ID NO: 4388 - DNA, 20 bp, Artificial Sequence
  Primer
cgtggtcgatatgagcaatg

SEQ ID NO: 4389 - DNA, 20 bp, Artificial Sequence
  Primer
tcctcgaggggagttttatc

SEQ ID NO: 4390 - DNA, 20 bp, Artificial Sequence
  Primer
ccgtatcctttcgtcacaga

SEQ ID NO: 4391 - DNA, 20 bp, Artificial Sequence
  Primer
gttgattggtttggccgtga

SEQ ID NO: 4392 - DNA, 20 bp, Artificial Sequence
  Primer
ctggtgtagctattccttgc

SEQ ID NO: 4393 - DNA, 20 bp, Artificial Sequence
  Primer
gcaggcttatggtctaacct

SEQ ID NO: 4394 - DNA, 20 bp, Artificial Sequence
  Primer
gcaatgcgattgcttctacg

SEQ ID NO: 4395 - DNA, 20 bp, Artificial Sequence
  Primer
gcctatttagggttcgatcc

SEQ ID NO: 4396 - DNA, 20 bp, Artificial Sequence
  Primer
cgttaaagtagctcgagcag

SEQ ID NO: 4397 - DNA, 20 bp, Artificial Sequence
  Primer
ggcagctatattggtcgaca

SEQ ID NO: 4398 - DNA, 20 bp, Artificial Sequence
  Primer
cccgagtttctcagatacac

SEQ ID NO: 4399 - DNA, 20 bp, Artificial Sequence
  Primer
ctcatgttggcgatttgtgg

SEQ ID NO: 4400 - DNA, 20 bp, Artificial Sequence
  Primer
gtaacgggatccgaaacaag

SEQ ID NO: 4401 - DNA, 20 bp, Artificial Sequence
  Primer
gctatagaggaaccgtcttc

SEQ ID NO: 4402 - DNA, 20 bp, Artificial Sequence
  Primer
ctgtcttgcccagctatact

SEQ ID NO: 4403 - DNA, 20 bp, Artificial Sequence
  Primer
ggcaggaagggaggctaaaa

SEQ ID NO: 4404 - DNA, 20 bp, Artificial Sequence
  Primer
ttccatttgcctagatggct

SEQ ID NO: 4405 - DNA, 20 bp, Artificial Sequence
  Primer
ttggctgggacagtaccggc

SEQ ID NO: 4406 - DNA, 20 bp, Artificial Sequence
  Primer
cgcaaccagcaagtcctaaa

SEQ ID NO: 4407 - DNA, 20 bp, Artificial Sequence
  Primer
agcgtacctattcctactgc

SEQ ID NO: 4408 - DNA, 20 bp, Artificial Sequence
  Primer
ggagtgctcactaccaacaa

SEQ ID NO: 4409 - DNA, 20 bp, Artificial Sequence
  Primer
ttgcctcctaaggaagagga

SEQ ID NO: 4410 - DNA, 20 bp, Artificial Sequence
  Primer
gttttgggggtgacataacg

SEQ ID NO: 4411 - DNA, 20 bp, Artificial Sequence
  Primer
cgagtagagagtttgtatcc

SEQ ID NO: 4412 - DNA, 20 bp, Artificial Sequence
  Primer
gctgccaccataacttttgg

SEQ ID NO: 4413 - DNA, 20 bp, Artificial Sequence
  Primer
gagaggctgcattactcgtt

SEQ ID NO: 4414 - DNA, 20 bp, Artificial Sequence
  Primer
ggtaggtattcttgggatgc

SEQ ID NO: 4415 - DNA, 20 bp, Artificial Sequence
  Primer
ggcgttcgcttccttattac

SEQ ID NO: 4416 - DNA, 20 bp, Artificial Sequence
  Primer
cgagtagagagtttgtatcc

SEQ ID NO: 4417 - DNA, 20 bp, Artificial Sequence
  Primer
aaggtggagagagcttggtt

SEQ ID NO: 4418 - DNA, 20 bp, Artificial Sequence
  Primer
gagcaaaaagtgagcaggca

SEQ ID NO: 4419 - DNA, 20 bp, Artificial Sequence
  Primer
ccgtatcacgagtcggagta

SEQ ID NO: 4420 - DNA, 20 bp, Artificial Sequence
  Primer
gaagccatgatttcttctgc

SEQ ID NO: 4421 - DNA, 20 bp, Artificial Sequence
  Primer
caatgcctgtctcactaacc

SEQ ID NO: 4422 - DNA, 20 bp, Artificial Sequence
  Primer
cccccttttgtgggtaagaa

SEQ ID NO: 4423 - DNA, 20 bp, Artificial Sequence
  Primer
acctttgcgtacgagtttgg

SEQ ID NO: 4424 - DNA, 20 bp, Artificial Sequence
  Primer
cccccttttgtgggtaagaa

SEQ ID NO: 4425 - DNA, 20 bp, Artificial Sequence
  Primer
cgcttttgcgaagaggtctt

SEQ ID NO: 4426 - DNA, 20 bp, Artificial Sequence
  Primer
gtaggagcttgtagccagtt

SEQ ID NO: 4427 - DNA, 20 bp, Artificial Sequence
  Primer
agacgccttctgtgactcta

SEQ ID NO: 4428 - DNA, 20 bp, Artificial Sequence
  Primer
ctgtagttgggagtgcatac

SEQ ID NO: 4429 - DNA, 20 bp, Artificial Sequence
  Primer
ccgtgatgagcaagaatgac

SEQ ID NO: 4430 - DNA, 20 bp, Artificial Sequence
  Primer
tgcaggagatgacgttgctt

SEQ ID NO: 4431 - DNA, 20 bp, Artificial Sequence
  Primer
gatgcgatggtcaccacagc

SEQ ID NO: 4432 - DNA, 20 bp, Artificial Sequence
  Primer
cgagctttgtgttgcgattg

SEQ ID NO: 4433 - DNA, 20 bp, Artificial Sequence
  Primer
cgtagcagtaaaagctggag

SEQ ID NO: 4434 - DNA, 20 bp, Artificial Sequence
  Primer
gagcagtcgaaagagcgtaa

SEQ ID NO: 4435 - DNA, 20 bp, Artificial Sequence
  Primer
cattctccttgtcgatagat

SEQ ID NO: 4436 - DNA, 20 bp, Artificial Sequence
  Primer
gttcgcttcccaagagacta

SEQ ID NO: 4437 - DNA, 20 bp, Artificial Sequence
  Primer
tggaatgaccggcctttctg

SEQ ID NO: 4438 - DNA, 20 bp, Artificial Sequence
  Primer
tccgtagcagtaaaagctgg

SEQ ID NO: 4439 - DNA, 20 bp, Artificial Sequence
  Primer
cgtctttgcctttcctagag

SEQ ID NO: 4440 - DNA, 20 bp, Artificial Sequence
  Primer
ttgccggtactgcttaccat

SEQ ID NO: 4441 - DNA, 20 bp, Artificial Sequence
  Primer
gtcctgatgctagaggttca

SEQ ID NO: 4442 - DNA, 20 bp, Artificial Sequence
  Primer
tgctgttgagcctcggttta

SEQ ID NO: 4443 - DNA, 20 bp, Artificial Sequence
  Primer
ggcaaggccttcctatcgag

SEQ ID NO: 4444 - DNA, 20 bp, Artificial Sequence
  Primer
cagtaacaggggcctattct

SEQ ID NO: 4445 - DNA, 20 bp, Artificial Sequence
  Primer
caagtctgtaccacgtaggt

SEQ ID NO: 4446 - DNA, 20 bp, Artificial Sequence
  Primer
ctcgttcccttcggtctatt

SEQ ID NO: 4447 - DNA, 20 bp, Artificial Sequence
  Primer
gggttaaagggagagggact

SEQ ID NO: 4448 - DNA, 20 bp, Artificial Sequence
  Primer
tggctccagtcctgtggtcg

SEQ ID NO: 4449 - DNA, 20 bp, Artificial Sequence
  Primer
ggtgattgagtcttgggaag

SEQ ID NO: 4450 - DNA, 20 bp, Artificial Sequence
  Primer
tccggaagggctagtgttta

SEQ ID NO: 4451 - DNA, 20 bp, Artificial Sequence
  Primer
cccataaattctctcgactg

SEQ ID NO: 4452 - DNA, 20 bp, Artificial Sequence
  Primer
gctcaaatgcgagagggaaa

SEQ ID NO: 4453 - DNA, 20 bp, Artificial Sequence
  Primer
gtcaagcaattgcgaacaag

SEQ ID NO: 4454 - DNA, 20 bp, Artificial Sequence
  Primer
cccataaattctctcgactg

SEQ ID NO: 4455 - DNA, 20 bp, Artificial Sequence
  Primer
gtccagtctgtaaaagctgc

SEQ ID NO: 4456 - DNA, 20 bp, Artificial Sequence
  Primer
gctgtttctcgagagcttct

SEQ ID NO: 4457 - DNA, 20 bp, Artificial Sequence
  Primer
gcagcacattcttcgagtct

SEQ ID NO: 4458 - DNA, 20 bp, Artificial Sequence
  Primer
aatatgcatcgaggcgcgct

SEQ ID NO: 4459 - DNA, 20 bp, Artificial Sequence
  Primer
ggtaggcaaaaagcaacctt

SEQ ID NO: 4460 - DNA, 20 bp, Artificial Sequence
  Primer
ttgcgccatactgttcgctg

SEQ ID NO: 4461 - DNA, 20 bp, Artificial Sequence
  Primer
aggactataggttgcagcgg

SEQ ID NO: 4462 - DNA, 20 bp, Artificial Sequence
  Primer
gcctctcttttttctcctct

SEQ ID NO: 4463 - DNA, 20 bp, Artificial Sequence
  Primer
cagaccttctcgatcgtttg

SEQ ID NO: 4464 - DNA, 20 bp, Artificial Sequence
  Primer
ggtaggcaaaaagcaacctt

SEQ ID NO: 4465 - DNA, 20 bp, Artificial Sequence
  Primer
ggagcaaggacttgaatatc

SEQ ID NO: 4466 - DNA, 20 bp, Artificial Sequence
  Primer
ccggaaagtttctcttcaca

SEQ ID NO: 4467 - DNA, 20 bp, Artificial Sequence
  Primer
ccacgcaaacgatcaaactc

SEQ ID NO: 4468 - DNA, 20 bp, Artificial Sequence
  Primer
ggttcccaagatccagatag

SEQ ID NO: 4469 - DNA, 20 bp, Artificial Sequence
  Primer
gccgctagcgaatttgatta

SEQ ID NO: 4470 - DNA, 20 bp, Artificial Sequence
  Primer
gccgctagcgaatttgatta

SEQ ID NO: 4471 - DNA, 20 bp, Artificial Sequence
  Primer
gaagacgagtttgtacctgc

SEQ ID NO: 4472 - DNA, 20 bp, Artificial Sequence
  Primer
caaatgccggcagtcactat

SEQ ID NO: 4473 - DNA, 20 bp, Artificial Sequence
  Primer
tcgaccagatctgtatctgc

SEQ ID NO: 4474 - DNA, 20 bp, Artificial Sequence
  Primer
ggaaaaactggtaaggctgc

SEQ ID NO: 4475 - DNA, 20 bp, Artificial Sequence
  Primer
tgaaaagaatcgctgcgggc

SEQ ID NO: 4476 - DNA, 20 bp, Artificial Sequence
  Primer
cgagtttgtacctgcaacag

SEQ ID NO: 4477 - DNA, 20 bp, Artificial Sequence
  Primer
gaacttagcgatgggacaag

SEQ ID NO: 4478 - DNA, 20 bp, Artificial Sequence
  Primer
ctgaagcagctgctaagtag

SEQ ID NO: 4479 - DNA, 20 bp, Artificial Sequence
  Primer
gaggcgtttctgggttagaa

SEQ ID NO: 4480 - DNA, 20 bp, Artificial Sequence
  Primer
tcagctgaaaagcgaacgga

SEQ ID NO: 4481 - DNA, 20 bp, Artificial Sequence
  Primer
cagagtccaatgctagaagc

SEQ ID NO: 4482 - DNA, 20 bp, Artificial Sequence
  Primer
gtggtgcaaaacctagcgat

SEQ ID NO: 4483 - DNA, 20 bp, Artificial Sequence
  Primer
gggaagccgaagatatcttg

SEQ ID NO: 4484 - DNA, 20 bp, Artificial Sequence
  Primer
aagcgttagttggaggcgtt

SEQ ID NO: 4485 - DNA, 20 bp, Artificial Sequence
  Primer
gaagatgttcttcccaaggg

SEQ ID NO: 4486 - DNA, 20 bp, Artificial Sequence
  Primer
cgcgtgctaaaagctcgtat

SEQ ID NO: 4487 - DNA, 20 bp, Artificial Sequence
  Primer
ggtgcgttctttccctttgt

SEQ ID NO: 4488 - DNA, 20 bp, Artificial Sequence
  Primer
catgagtcattggttgcgac

SEQ ID NO: 4489 - DNA, 20 bp, Artificial Sequence
  Primer
atggcttgagcttgcttagc

SEQ ID NO: 4490 - DNA, 20 bp, Artificial Sequence
  Primer
tgcccctgttatcgttcagg

SEQ ID NO: 4491 - DNA, 20 bp, Artificial Sequence
  Primer
cgctgaggtgaaggattttg

SEQ ID NO: 4492 - DNA, 20 bp, Artificial Sequence
  Primer
attcattggactcctgggca

SEQ ID NO: 4493 - DNA, 20 bp, Artificial Sequence
  Primer
cccctatagagactaacgac

SEQ ID NO: 4494 - DNA, 20 bp, Artificial Sequence
  Primer
gaggggattcaggcgattat

SEQ ID NO: 4495 - DNA, 20 bp, Artificial Sequence
  Primer
ccagggatccagcataaagt

SEQ ID NO: 4496 - DNA, 20 bp, Artificial Sequence
  Primer
cgaagtgtatcctcacatcg

SEQ ID NO: 4497 - DNA, 20 bp, Artificial Sequence
  Primer
ctgaggacaagcgattgttg

SEQ ID NO: 4498 - DNA, 20 bp, Artificial Sequence
  Primer
gcagatgctgagttgcagaa

SEQ ID NO: 4499 - DNA, 20 bp, Artificial Sequence
  Primer
gtctttccgactgctctagt

SEQ ID NO: 4500 - DNA, 20 bp, Artificial Sequence
  Primer
ccggagtatcggatgaggat

SEQ ID NO: 4501 - DNA, 20 bp, Artificial Sequence
  Primer
ggatcgccggttaacacaat

SEQ ID NO: 4502 - DNA, 20 bp, Artificial Sequence
  Primer
cgcgtgtgctaatctgtttg

SEQ ID NO: 4503 - DNA, 20 bp, Artificial Sequence
  Primer
gtatgccagcgtatccactc

SEQ ID NO: 4504 - DNA, 20 bp, Artificial Sequence
  Primer
acgcgaaccttacaacacct

SEQ ID NO: 4505 - DNA, 20 bp, Artificial Sequence
  Primer
gcgctcggcgctcacatgag

SEQ ID NO: 4506 - DNA, 20 bp, Artificial Sequence
  Primer
gctgttctgggatgttctct

SEQ ID NO: 4507 - DNA, 20 bp, Artificial Sequence
  Primer
gtcttaagaaggcctttggg

SEQ ID NO: 4508 - DNA, 20 bp, Artificial Sequence
  Primer
cctctctgtgctatttcctg

SEQ ID NO: 4509 - DNA, 20 bp, Artificial Sequence
  Primer
gtggtatcatgagcaagagg

SEQ ID NO: 4510 - DNA, 20 bp, Artificial Sequence
  Primer
ccctagcagttgaagtgttt

SEQ ID NO: 4511 - DNA, 20 bp, Artificial Sequence
  Primer
gagccataactgcctgaaca

SEQ ID NO: 4512 - DNA, 20 bp, Artificial Sequence
  Primer
gcgaagcttctcaacaacag

SEQ ID NO: 4513 - DNA, 20 bp, Artificial Sequence
  Primer
aagcaaagcaggagaggtgg

SEQ ID NO: 4514 - DNA, 20 bp, Artificial Sequence
  Primer
ccccccgtacgtaatctttt

SEQ ID NO: 4515 - DNA, 20 bp, Artificial Sequence
  Primer
ccgtaagtgtaacgcttgag

SEQ ID NO: 4516 - DNA, 20 bp, Artificial Sequence
  Primer
ctcctgtttatgcccaaggt

SEQ ID NO: 4517 - DNA, 20 bp, Artificial Sequence
  Primer
cgaattggcagtggtctgta

SEQ ID NO: 4518 - DNA, 20 bp, Artificial Sequence
  Primer
gagggcatgatcacctaaga

SEQ ID NO: 4519 - DNA, 20 bp, Artificial Sequence
  Primer
gaactcccaattctagggag

SEQ ID NO: 4520 - DNA, 20 bp, Artificial Sequence
  Primer
ggttcttcgctgttctttgg

SEQ ID NO: 4521 - DNA, 20 bp, Artificial Sequence
  Primer
gactggtgttactggagtca

SEQ ID NO: 4522 - DNA, 20 bp, Artificial Sequence
  Primer
cgcattgcgggcacaaaaat

SEQ ID NO: 4523 - DNA, 20 bp, Artificial Sequence
  Primer
gcagcatcctcaaaaaaggc

SEQ ID NO: 4524 - DNA, 20 bp, Artificial Sequence
  Primer
ggggtgacgatcgggtgccg

SEQ ID NO: 4525 - DNA, 20 bp, Artificial Sequence
  Primer
gaggaagtagggagcttaga

SEQ ID NO: 4526 - DNA, 20 bp, Artificial Sequence
  Primer
gcggattacaagaacgggaa

SEQ ID NO: 4527 - DNA, 20 bp, Artificial Sequence
  Primer
tgcttctgcagaagctgcca

SEQ ID NO: 4528 - DNA, 20 bp, Artificial Sequence
  Primer
caggatgttttggatccggt

SEQ ID NO: 4529 - DNA, 20 bp, Artificial Sequence
  Primer
tgtccacatggttccttcac

SEQ ID NO: 4530 - DNA, 20 bp, Artificial Sequence
  Primer
gaggttgccgggttcttttt

SEQ ID NO: 4531 - DNA, 20 bp, Artificial Sequence
  Primer
ctcgtttgatggctgcttac

SEQ ID NO: 4532 - DNA, 20 bp, Artificial Sequence
  Primer
caagcaggtgagtaagtagg

SEQ ID NO: 4533 - DNA, 20 bp, Artificial Sequence
  Primer
gagcaccccaacgagtggag

SEQ ID NO: 4534 - DNA, 20 bp, Artificial Sequence
  Primer
tatgcttaccaacgggtcac

SEQ ID NO: 4535 - DNA, 20 bp, Artificial Sequence
  Primer
caagggctctgtttcatgtc

SEQ ID NO: 4536 - DNA, 20 bp, Artificial Sequence
  Primer
gatcgaatcgcagaagtcaa

SEQ ID NO: 4537 - DNA, 20 bp, Artificial Sequence
  Primer
ctccagagttagagaggaag

SEQ ID NO: 4538 - DNA, 20 bp, Artificial Sequence
  Primer
ggattccccctaagagtcta

SEQ ID NO: 4539 - DNA, 20 bp, Artificial Sequence
  Primer
tcccagagctgtcgtgaaca

SEQ ID NO: 4540 - DNA, 20 bp, Artificial Sequence
  Primer
cagagaatgcccttcatcag

SEQ ID NO: 4541 - DNA, 20 bp, Artificial Sequence
  Primer
caggtctttagcagagtaca

SEQ ID NO: 4542 - DNA, 20 bp, Artificial Sequence
  Primer
agttgcgcttgtacagtagc

SEQ ID NO: 4543 - DNA, 20 bp, Artificial Sequence
  Primer
ggcgtgtcactccacattgc

SEQ ID NO: 4544 - DNA, 20 bp, Artificial Sequence
  Primer
gggacggagattttcccggc

SEQ ID NO: 4545 - DNA, 20 bp, Artificial Sequence
  Primer
ggtatggtgcctcctaatac

SEQ ID NO: 4546 - DNA, 20 bp, Artificial Sequence
  Primer
gggaaggctctctagaattt

SEQ ID NO: 4547 - DNA, 20 bp, Artificial Sequence
  Primer
gcagtggaacaacagttgct

SEQ ID NO: 4548 - DNA, 20 bp, Artificial Sequence
  Primer
gatgcagatgctgcgcacta

SEQ ID NO: 4549 - DNA, 20 bp, Artificial Sequence
  Primer
ggaagtagagtccggttcta

SEQ ID NO: 4550 - DNA, 20 bp, Artificial Sequence
  Primer
gtactgagacaacgctccta

SEQ ID NO: 4551 - DNA, 20 bp, Artificial Sequence
  Primer
gggaacgttgctttcctgaa

SEQ ID NO: 4552 - DNA, 20 bp, Artificial Sequence
  Primer
gttccaatcatcatgcttgc

SEQ ID NO: 4553 - DNA, 20 bp, Artificial Sequence
  Primer
cgacaacatctacaccgtct

SEQ ID NO: 4554 - DNA, 20 bp, Artificial Sequence
  Primer
tcctcctaccaatcctccag

SEQ ID NO: 4555 - DNA, 20 bp, Artificial Sequence
  Primer
ggggggatgttattttagcc

SEQ ID NO: 4556 - DNA, 20 bp, Artificial Sequence
  Primer
gcgcagtcttccaaacttct

SEQ ID NO: 4557 - DNA, 20 bp, Artificial Sequence
  Primer
cagcagcagaggtagtgtta

SEQ ID NO: 4558 - DNA, 20 bp, Artificial Sequence
  Primer
gtgatgcaaacgtctttcca

SEQ ID NO: 4559 - DNA, 20 bp, Artificial Sequence
  Primer
ctacaattgaaaggcgccca

SEQ ID NO: 4560 - DNA, 20 bp, Artificial Sequence
  Primer
ggaactgtagcgtatccgtt

SEQ ID NO: 4561 - DNA, 20 bp, Artificial Sequence
  Primer
gcagatgttggagctgaaga

SEQ ID NO: 4562 - DNA, 20 bp, Artificial Sequence
  Primer
gtccatactgtcgtagactg

SEQ ID NO: 4563 - DNA, 20 bp, Artificial Sequence
  Primer
gactgattctcgctcacaac

SEQ ID NO: 4564 - DNA, 20 bp, Artificial Sequence
  Primer
cagctccttcattgggagtt

SEQ ID NO: 4565 - DNA, 20 bp, Artificial Sequence
  Primer
ctcgaggatcttggtaaacc

SEQ ID NO: 4566 - DNA, 20 bp, Artificial Sequence
  Primer
acaggtgccgtctttgaagt

SEQ ID NO: 4567 - DNA, 20 bp, Artificial Sequence
  Primer
tgggaatacactagaggtgc

SEQ ID NO: 4568 - DNA, 20 bp, Artificial Sequence
  Primer
tagggccattatccactagg

SEQ ID NO: 4569 - DNA, 20 bp, Artificial Sequence
  Primer
gcagagcaatttccccattg

SEQ ID NO: 4570 - DNA, 20 bp, Artificial Sequence
  Primer
gggggaggattatgaattgg

SEQ ID NO: 4571 - DNA, 20 bp, Artificial Sequence
  Primer
gaggagtcgacaaccttccc

SEQ ID NO: 4572 - DNA, 20 bp, Artificial Sequence
  Primer
ggagtagggtgataccacat

SEQ ID NO: 4573 - DNA, 20 bp, Artificial Sequence
  Primer
acacaagattcgggggatcg

SEQ ID NO: 4574 - DNA, 20 bp, Artificial Sequence
  Primer
ggatcggggaaaggttttcg

SEQ ID NO: 4575 - DNA, 20 bp, Artificial Sequence
  Primer
ggcagagaccgtttttgttg

SEQ ID NO: 4576 - DNA, 20 bp, Artificial Sequence
  Primer
ttcccttgcggtcggtggat

SEQ ID NO: 4577 - DNA, 20 bp, Artificial Sequence
  Primer
gtgcccttgtaagaaacctg

SEQ ID NO: 4578 - DNA, 20 bp, Artificial Sequence
  Primer
gaccagggaatgaggctgtt

SEQ ID NO: 4579 - DNA, 20 bp, Artificial Sequence
  Primer
gggagcggattccttatagt

SEQ ID NO: 4580 - DNA, 20 bp, Artificial Sequence
  Primer
ggcagagggagtcattttgt

SEQ ID NO: 4581 - DNA, 20 bp, Artificial Sequence
  Primer
gagacagaacaacgtctcct

SEQ ID NO: 4582 - DNA, 20 bp, Artificial Sequence
  Primer
gtgcccttgtaagaaacctg

SEQ ID NO: 4583 - DNA, 20 bp, Artificial Sequence
  Primer
ggcttctgcttggcctaaaa

SEQ ID NO: 4584 - DNA, 20 bp, Artificial Sequence
  Primer
gttcaaccttcggaaagcgt

SEQ ID NO: 4585 - DNA, 20 bp, Artificial Sequence
  Primer
tcagaccagtcgtaggagtc

SEQ ID NO: 4586 - DNA, 20 bp, Artificial Sequence
  Primer
ttggcatttgtggagggaca

SEQ ID NO: 4587 - DNA, 20 bp, Artificial Sequence
  Primer
tttggcgcatatggagcgaa

SEQ ID NO: 4588 - DNA, 20 bp, Artificial Sequence
  Primer
gcgcagaagacgataaccta

SEQ ID NO: 4589 - DNA, 20 bp, Artificial Sequence
  Primer
ggtgtccagagggatatctt

SEQ ID NO: 4590 - DNA, 20 bp, Artificial Sequence
  Primer
gcatcgacactatctgtgcg

SEQ ID NO: 4591 - DNA, 20 bp, Artificial Sequence
  Primer
aaaggatgccacctccaagc

SEQ ID NO: 4592 - DNA, 20 bp, Artificial Sequence
  Primer
ctttcctcatagtctccttg

SEQ ID NO: 4593 - DNA, 20 bp, Artificial Sequence
  Primer
ctgctctcctgttgctattg

SEQ ID NO: 4594 - DNA, 20 bp, Artificial Sequence
  Primer
cgctatgatggttacagcga

SEQ ID NO: 4595 - DNA, 20 bp, Artificial Sequence
  Primer
cgaagcatttcgtcgtgttc

SEQ ID NO: 4596 - DNA, 20 bp, Artificial Sequence
  Primer
gctttctcggaaagaaggag

SEQ ID NO: 4597 - DNA, 20 bp, Artificial Sequence
  Primer
cgaaagtgcattctgcagtc

SEQ ID NO: 4598 - DNA, 20 bp, Artificial Sequence
  Primer
cgaggagttactgctagact

SEQ ID NO: 4599 - DNA, 20 bp, Artificial Sequence
  Primer
actctccaatggttccgcat

SEQ ID NO: 4600 - DNA, 20 bp, Artificial Sequence
  Primer
cgatctgccttttacagcga

SEQ ID NO: 4601 - DNA, 20 bp, Artificial Sequence
  Primer
gttgcctacatgggaatgga

SEQ ID NO: 4602 - DNA, 20 bp, Artificial Sequence
  Primer
ctcgcatggcctctttaggg

SEQ ID NO: 4603 - DNA, 20 bp, Artificial Sequence
  Primer
ggtgcttgtcgaggtcttta

SEQ ID NO: 4604 - DNA, 20 bp, Artificial Sequence
  Primer
ggcacagggggaagtattct

SEQ ID NO: 4605 - DNA, 20 bp, Artificial Sequence
  Primer
gatccctgcggtaaagtctt

SEQ ID NO: 4606 - DNA, 20 bp, Artificial Sequence
  Primer
ggagggttttcactgtagag

SEQ ID NO: 4607 - DNA, 20 bp, Artificial Sequence
  Primer
tgccaaagaaaaacggtccg

SEQ ID NO: 4608 - DNA, 20 bp, Artificial Sequence
  Primer
cactcgagtcatgcaaagga

SEQ ID NO: 4609 - DNA, 20 bp, Artificial Sequence
  Primer
ggaaagaatggatccctgtc

SEQ ID NO: 4610 - DNA, 20 bp, Artificial Sequence
  Primer
gtcccattttggggtacgat

SEQ ID NO: 4611 - DNA, 20 bp, Artificial Sequence
  Primer
ccagattgtgttgcaaccca

SEQ ID NO: 4612 - DNA, 20 bp, Artificial Sequence
  Primer
gcggcactcaaagcaatatg

SEQ ID NO: 4613 - DNA, 20 bp, Artificial Sequence
  Primer
ggagagtctttagtcgcttc

SEQ ID NO: 4614 - DNA, 20 bp, Artificial Sequence
  Primer
tatttggagctcagacggga

SEQ ID NO: 4615 - DNA, 20 bp, Artificial Sequence
  Primer
gaagctattgtctcagatgc

SEQ ID NO: 4616 - DNA, 20 bp, Artificial Sequence
  Primer
gcatggtagcagaaaagagg

SEQ ID NO: 4617 - DNA, 20 bp, Artificial Sequence
  Primer
aagagatgcagcgctttgct

SEQ ID NO: 4618 - DNA, 20 bp, Artificial Sequence
  Primer
ccagtccatgagacgtttgt

SEQ ID NO: 4619 - DNA, 20 bp, Artificial Sequence
  Primer
ggtcaacaacagagaagcca

SEQ ID NO: 4620 - DNA, 20 bp, Artificial Sequence
  Primer
ccctagtaagcggaaaaagc

SEQ ID NO: 4621 - DNA, 20 bp, Artificial Sequence
  Primer
ccatcaagagtatgtgcgtg

SEQ ID NO: 4622 - DNA, 20 bp, Artificial Sequence
  Primer
gtagttaccccttccttagc

SEQ ID NO: 4623 - DNA, 20 bp, Artificial Sequence
  Primer
tctttggagcagccctaaac

SEQ ID NO: 4624 - DNA, 20 bp, Artificial Sequence
  Primer
cagagcggcttataagggta

SEQ ID NO: 4625 - DNA, 20 bp, Artificial Sequence
  Primer
gaaggaggagttctgttgag

SEQ ID NO: 4626 - DNA, 20 bp, Artificial Sequence
  Primer
cagaaggctgcgagaaatgt

SEQ ID NO: 4627 - DNA, 20 bp, Artificial Sequence
  Primer
ggctgtcaaccttccttttg

SEQ ID NO: 4628 - DNA, 20 bp, Artificial Sequence
  Primer
cgacgagaacagactggtaa

SEQ ID NO: 4629 - DNA, 20 bp, Artificial Sequence
  Primer
tgtcgctagggacgacgatt

SEQ ID NO: 4630 - DNA, 20 bp, Artificial Sequence
  Primer
gctctgcaactagagacaag

SEQ ID NO: 4631 - DNA, 20 bp, Artificial Sequence
  Primer
tatacggagcaggaaagacg

SEQ ID NO: 4632 - DNA, 20 bp, Artificial Sequence
  Primer
caggaacatataacaagggg

SEQ ID NO: 4633 - DNA, 20 bp, Artificial Sequence
  Primer
gtagtatgttatgaggggtt

SEQ ID NO: 4634 - DNA, 20 bp, Artificial Sequence
  Primer
tttacagagagagcgagcca

SEQ ID NO: 4635 - DNA, 20 bp, Artificial Sequence
  Primer
gctgcacacgctgaagaaaa

SEQ ID NO: 4636 - DNA, 20 bp, Artificial Sequence
  Primer
ggaagaaattctcgcgctac

SEQ ID NO: 4637 - DNA, 20 bp, Artificial Sequence
  Primer
gatcttggataagagctcgc

SEQ ID NO: 4638 - DNA, 20 bp, Artificial Sequence
  Primer
gccgaacctgtgtctttttc

SEQ ID NO: 4639 - DNA, 20 bp, Artificial Sequence
  Primer
agttcccttaggggaggcca

SEQ ID NO: 4640 - DNA, 20 bp, Artificial Sequence
  Primer
gcggaggaaaacttctcttg

SEQ ID NO: 4641 - DNA, 20 bp, Artificial Sequence
  Primer
ctaatcttccagcgttgcct

SEQ ID NO: 4642 - DNA, 20 bp, Artificial Sequence
  Primer
ccatgcttcaatagcatcgc

SEQ ID NO: 4643 - DNA, 20 bp, Artificial Sequence
  Primer
gctttggacatcatcaacag

SEQ ID NO: 4644 - DNA, 20 bp, Artificial Sequence
  Primer
atgccatggaggaagatcca

SEQ ID NO: 4645 - DNA, 20 bp, Artificial Sequence
  Primer
ccacgccaaacgcattaagc

SEQ ID NO: 4646 - DNA, 20 bp, Artificial Sequence
  Primer
cataacttcccttctggagg

SEQ ID NO: 4647 - DNA, 20 bp, Artificial Sequence
  Primer
cgctctgtacgtctatatcg

SEQ ID NO: 4648 - DNA, 20 bp, Artificial Sequence
  Primer
gcgcttgttagcaaaaggac

SEQ ID NO: 4649 - DNA, 20 bp, Artificial Sequence
  Primer
cgttgccttattgcgtcctt

SEQ ID NO: 4650 - DNA, 20 bp, Artificial Sequence
  Primer
caacgcctcattactctggt

SEQ ID NO: 4651 - DNA, 20 bp, Artificial Sequence
  Primer
cgcgacgctatcgttatgaa

SEQ ID NO: 4652 - DNA, 20 bp, Artificial Sequence
  Primer
ctgaacgaaggactagttgc

SEQ ID NO: 4653 - DNA, 20 bp, Artificial Sequence
  Primer
ctgtggaaagagaaacagca

SEQ ID NO: 4654 - DNA, 20 bp, Artificial Sequence
  Primer
ggaatttggtaggcagtgac

SEQ ID NO: 4655 - DNA, 20 bp, Artificial Sequence
  Primer
cgagaaccattccagctttc

SEQ ID NO: 4656 - DNA, 20 bp, Artificial Sequence
  Primer
gcaacgagttgtagggagaa

SEQ ID NO: 4657 - DNA, 20 bp, Artificial Sequence
  Primer
aacttcagccagaagaaggg

SEQ ID NO: 4658 - DNA, 20 bp, Artificial Sequence
  Primer
gcatagatcgttttaggccc

SEQ ID NO: 4659 - DNA, 20 bp, Artificial Sequence
  Primer
cgaatgatatgccaattcgg

SEQ ID NO: 4660 - DNA, 20 bp, Artificial Sequence
  Primer
ggatcacagctgcgatacat

SEQ ID NO: 4661 - DNA, 20 bp, Artificial Sequence
  Primer
ccggtctctgtctcaagatt

SEQ ID NO: 4662 - DNA, 20 bp, Artificial Sequence
  Primer
gccagagatcggctagtatt

SEQ ID NO: 4663 - DNA, 20 bp, Artificial Sequence
  Primer
tatttttcactagctctcgg

SEQ ID NO: 4664 - DNA, 20 bp, Artificial Sequence
  Primer
ccggtctctgtctcaagatt

SEQ ID NO: 4665 - DNA, 20 bp, Artificial Sequence
  Primer
aaagccggtcctctgttatg

SEQ ID NO: 4666 - DNA, 20 bp, Artificial Sequence
  Primer
tccgggggttcgaatccctc

SEQ ID NO: 4667 - DNA, 20 bp, Artificial Sequence
  Primer
gcaaagcaagctagagcctt

SEQ ID NO: 4668 - DNA, 20 bp, Artificial Sequence
  Primer
tcgagagaggcaaggccgtt

SEQ ID NO: 4669 - DNA, 20 bp, Artificial Sequence
  Primer
ctggatctatttccagagcg

SEQ ID NO: 4670 - DNA, 20 bp, Artificial Sequence
  Primer
gcgggctatggcttttaact

SEQ ID NO: 4671 - DNA, 20 bp, Artificial Sequence
  Primer
cgcttcccttactctgtcat

SEQ ID NO: 4672 - DNA, 20 bp, Artificial Sequence
  Primer
gctccgggaacactaaaaac

SEQ ID NO: 4673 - DNA, 20 bp, Artificial Sequence
  Primer
cttccctaacagagcaaagg

SEQ ID NO: 4674 - DNA, 20 bp, Artificial Sequence
  Primer
ctttcctcctttcttagggc

SEQ ID NO: 4675 - DNA, 20 bp, Artificial Sequence
  Primer
gctgaggaacgagcgattat

SEQ ID NO: 4676 - DNA, 20 bp, Artificial Sequence
  Primer
cctagcggagataagcagat

SEQ ID NO: 4677 - DNA, 20 bp, Artificial Sequence
  Primer
gttgagggtctacaggagtt

SEQ ID NO: 4678 - DNA, 20 bp, Artificial Sequence
  Primer
ggtgggcaattaactcttgc

SEQ ID NO: 4679 - DNA, 20 bp, Artificial Sequence
  Primer
gcacctgtctgttctttgga

SEQ ID NO: 4680 - DNA, 20 bp, Artificial Sequence
  Primer
gcaagcttaacttggtagtc

SEQ ID NO: 4681 - DNA, 20 bp, Artificial Sequence
  Primer
gcttcgcaagaagctgtaga

SEQ ID NO: 4682 - DNA, 20 bp, Artificial Sequence
  Primer
cagacgggaaaaaactgtcg

SEQ ID NO: 4683 - DNA, 20 bp, Artificial Sequence
  Primer
caaacgctacatcgcagaag

SEQ ID NO: 4684 - DNA, 20 bp, Artificial Sequence
  Primer
ggtaagctgcttctttttgc

SEQ ID NO: 4685 - DNA, 20 bp, Artificial Sequence
  Primer
gactgctcgaacttatccca

SEQ ID NO: 4686 - DNA, 20 bp, Artificial Sequence
  Primer
ctgggataccgaagtcagtt

SEQ ID NO: 4687 - DNA, 20 bp, Artificial Sequence
  Primer
atatccgagagctgctcagt

SEQ ID NO: 4688 - DNA, 20 bp, Artificial Sequence
  Primer
cgcgtgattatccgtaaggt

SEQ ID NO: 4689 - DNA, 20 bp, Artificial Sequence
  Primer
gcagaaggtgaagttcttca

SEQ ID NO: 4690 - DNA, 20 bp, Artificial Sequence
  Primer
cggagcggtaaggtgccttt

SEQ ID NO: 4691 - DNA, 20 bp, Artificial Sequence
  Primer
cgatggggcagatgaagata

SEQ ID NO: 4692 - DNA, 20 bp, Artificial Sequence
  Primer
ggaggatgggttaagaatcc

SEQ ID NO: 4693 - DNA, 20 bp, Artificial Sequence
  Primer
agtctttgagtgcgttgcgt

SEQ ID NO: 4694 - DNA, 20 bp, Artificial Sequence
  Primer
gccgttttccatccgttgtt

SEQ ID NO: 4695 - DNA, 20 bp, Artificial Sequence
  Primer
ggcaacgcctggagttgtat

SEQ ID NO: 4696 - DNA, 20 bp, Artificial Sequence
  Primer
gggagagcaaacaacttctc

SEQ ID NO: 4697 - DNA, 20 bp, Artificial Sequence
  Primer
gggaaaagtggggatgcttt

SEQ ID NO: 4698 - DNA, 20 bp, Artificial Sequence
  Primer
tggtgcgattcatcgtcttg

SEQ ID NO: 4699 - DNA, 20 bp, Artificial Sequence
  Primer
cgatgctctccaagagtttg

SEQ ID NO: 4700 - DNA, 20 bp, Artificial Sequence
  Primer
caggcaggggttaccgttgt

SEQ ID NO: 4701 - DNA, 20 bp, Artificial Sequence
  Primer
ccgtacctgaagtagaagca

SEQ ID NO: 4702 - DNA, 20 bp, Artificial Sequence
  Primer
gcgcgtgctctttatccata

SEQ ID NO: 4703 - DNA, 20 bp, Artificial Sequence
  Primer
gacggtaaaggtcgatcgaa

SEQ ID NO: 4704 - DNA, 20 bp, Artificial Sequence
  Primer
cgatccctactgtaattcgg

SEQ ID NO: 4705 - DNA, 20 bp, Artificial Sequence
  Primer
ggtctatggcaaaaggttcg

SEQ ID NO: 4706 - DNA, 20 bp, Artificial Sequence
  Primer
cctattgccgatcaagggaa

SEQ ID NO: 4707 - DNA, 20 bp, Artificial Sequence
  Primer
gcatttgggtctgctggtat

SEQ ID NO: 4708 - DNA, 20 bp, Artificial Sequence
  Primer
ctttcactgcccgttcatca

SEQ ID NO: 4709 - DNA, 20 bp, Artificial Sequence
  Primer
caggagctcttcaaggatct

SEQ ID NO: 4710 - DNA, 20 bp, Artificial Sequence
  Primer
ctcttctgacaagagacggt

SEQ ID NO: 4711 - DNA, 20 bp, Artificial Sequence
  Primer
cggaataagtgtgtaggagg

SEQ ID NO: 4712 - DNA, 20 bp, Artificial Sequence
  Primer
tacgctatgctgggggaata

SEQ ID NO: 4713 - DNA, 20 bp, Artificial Sequence
  Primer
gcttaggaatcgcattcgct

SEQ ID NO: 4714 - DNA, 20 bp, Artificial Sequence
  Primer
cagggctagtgcttcttaac

SEQ ID NO: 4715 - DNA, 20 bp, Artificial Sequence
  Primer
gtttattgaggcgggattgg

SEQ ID NO: 4716 - DNA, 20 bp, Artificial Sequence
  Primer
tatcgctgctgtctccgacg

SEQ ID NO: 4717 - DNA, 20 bp, Artificial Sequence
  Primer
cgctaatcaatgtccctgtg

SEQ ID NO: 4718 - DNA, 20 bp, Artificial Sequence
  Primer
gagtcctcaagcgctaatca

SEQ ID NO: 4719 - DNA, 20 bp, Artificial Sequence
  Primer
tcttgacgcggagaagcttt

SEQ ID NO: 4720 - DNA, 20 bp, Artificial Sequence
  Primer
gcagaatgcaacaggcaact

SEQ ID NO: 4721 - DNA, 20 bp, Artificial Sequence
  Primer
gattgggagggagctccaat

SEQ ID NO: 4722 - DNA, 20 bp, Artificial Sequence
  Primer
cgtgtgtggtgcttagagtt

SEQ ID NO: 4723 - DNA, 20 bp, Artificial Sequence
  Primer
tctaggagttagtggagctg

SEQ ID NO: 4724 - DNA, 20 bp, Artificial Sequence
  Primer
aggatatgaggcgaatgctg

SEQ ID NO: 4725 - DNA, 20 bp, Artificial Sequence
  Primer
taacaacgtggcctgttcgg

SEQ ID NO: 4726 - DNA, 20 bp, Artificial Sequence
  Primer
aggagctgcgtgtcgctctg

SEQ ID NO: 4727 - DNA, 20 bp, Artificial Sequence
  Primer
gcaatgcaggggatgttgtt

SEQ ID NO: 4728 - DNA, 20 bp, Artificial Sequence
  Primer
gaagcttcagccgaaatcag

SEQ ID NO: 4729 - DNA, 20 bp, Artificial Sequence
  Primer
ggagcgattttagctactgg

SEQ ID NO: 4730 - DNA, 20 bp, Artificial Sequence
  Primer
ggtgcttctgttttagggac

SEQ ID NO: 4731 - DNA, 20 bp, Artificial Sequence
  Primer
tcggaacatctttggtagcg

SEQ ID NO: 4732 - DNA, 20 bp, Artificial Sequence
  Primer
cgtattgcagacaggtttgg

SEQ ID NO: 4733 - DNA, 20 bp, Artificial Sequence
  Primer
gggaagtatggggaaaacct

SEQ ID NO: 4734 - DNA, 20 bp, Artificial Sequence
  Primer
gggtagctatctgcagtcta

SEQ ID NO: 4735 - DNA, 20 bp, Artificial Sequence
  Primer
accgtcgtgtctggagaata

SEQ ID NO: 4736 - DNA, 20 bp, Artificial Sequence
  Primer
ggtgtgcagtaattgcaagc

SEQ ID NO: 4737 - DNA, 20 bp, Artificial Sequence
  Primer
gagaaggatgatctggagaa

SEQ ID NO: 4738 - DNA, 20 bp, Artificial Sequence
  Primer
gtggtcaatcagcgcagaaa

SEQ ID NO: 4739 - DNA, 20 bp, Artificial Sequence
  Primer
gttcccccttattggtgagt

SEQ ID NO: 4740 - DNA, 20 bp, Artificial Sequence
  Primer
ctgctaatgcaggggtcaaa

SEQ ID NO: 4741 - DNA, 20 bp, Artificial Sequence
  Primer
cttcgtaggagagggtgttt

SEQ ID NO: 4742 - DNA, 20 bp, Artificial Sequence
  Primer
cctgcagattctggatcagt

SEQ ID NO: 4743 - DNA, 20 bp, Artificial Sequence
  Primer
gcgctgttgtatccctagta

SEQ ID NO: 4744 - DNA, 20 bp, Artificial Sequence
  Primer
cctcctgcagacatacttcc

SEQ ID NO: 4745 - DNA, 20 bp, Artificial Sequence
  Primer
gcttttgcctttcgtaggag

SEQ ID NO: 4746 - DNA, 20 bp, Artificial Sequence
  Primer
cctgtttttcggttgcgctt

SEQ ID NO: 4747 - DNA, 20 bp, Artificial Sequence
  Primer
gacggggatttactgttcac

SEQ ID NO: 4748 - DNA, 20 bp, Artificial Sequence
  Primer
gactgcggatcttcatttgg

SEQ ID NO: 4749 - DNA, 20 bp, Artificial Sequence
  Primer
gattcgttgcatccgagttg

SEQ ID NO: 4750 - DNA, 20 bp, Artificial Sequence
  Primer
gcgcagaagaacaagaaggt

SEQ ID NO: 4751 - DNA, 20 bp, Artificial Sequence
  Primer
cttagggctttctcaaaccc

SEQ ID NO: 4752 - DNA, 20 bp, Artificial Sequence
  Primer
gaaggaagcgtttcgctaag

SEQ ID NO: 4753 - DNA, 20 bp, Artificial Sequence
  Primer
tcccccttaggtctggttta

SEQ ID NO: 4754 - DNA, 20 bp, Artificial Sequence
  Primer
caccaattatggtggcgaag

SEQ ID NO: 4755 - DNA, 20 bp, Artificial Sequence
  Primer
gcaaattcgatagctgtgtg

SEQ ID NO: 4756 - DNA, 20 bp, Artificial Sequence
  Primer
gctgaaggggttgctgatta

SEQ ID NO: 4757 - DNA, 20 bp, Artificial Sequence
  Primer
ggcatcatcgcttgtgtaga

SEQ ID NO: 4758 - DNA, 20 bp, Artificial Sequence
  Primer
cggtagcacgacgataagat

SEQ ID NO: 4759 - DNA, 20 bp, Artificial Sequence
  Primer
cgtttcaggcccccaaattg

SEQ ID NO: 4760 - DNA, 20 bp, Artificial Sequence
  Primer
cgttgcatcaacacggtaga

SEQ ID NO: 4761 - DNA, 20 bp, Artificial Sequence
  Primer
cccgtagcaggtacctataa

SEQ ID NO: 4762 - DNA, 20 bp, Artificial Sequence
  Primer
ccctaaggccattcaaaggc

SEQ ID NO: 4763 - DNA, 20 bp, Artificial Sequence
  Primer
ggcagtttctaggtctgaag

SEQ ID NO: 4764 - DNA, 20 bp, Artificial Sequence
  Primer
gctaggatgagtgggaagtt

SEQ ID NO: 4765 - DNA, 20 bp, Artificial Sequence
  Primer
caatgccatggtcggcaagg

SEQ ID NO: 4766 - DNA, 20 bp, Artificial Sequence
  Primer
ggcgagaaatgccctgttta

SEQ ID NO: 4767 - DNA, 20 bp, Artificial Sequence
  Primer
ctgggtcaaattgcgcacta

SEQ ID NO: 4768 - DNA, 20 bp, Artificial Sequence
  Primer
ggcgagatagcgttgttctt

SEQ ID NO: 4769 - DNA, 20 bp, Artificial Sequence
  Primer
gctaaagagcggagagtgat

SEQ ID NO: 4770 - DNA, 20 bp, Artificial Sequence
  Primer
ttgctaaaagtgctggggtg

SEQ ID NO: 4771 - DNA, 20 bp, Artificial Sequence
  Primer
tacccaactagaggccacta

SEQ ID NO: 4772 - DNA, 20 bp, Artificial Sequence
  Primer
cagacggatgaataccgaac

SEQ ID NO: 4773 - DNA, 20 bp, Artificial Sequence
  Primer
ggggaacaggctcttatgta

SEQ ID NO: 4774 - DNA, 20 bp, Artificial Sequence
  Primer
ccagaacctgctgttttgag

SEQ ID NO: 4775 - DNA, 20 bp, Artificial Sequence
  Primer
gaggataagagtgctccagg

SEQ ID NO: 4776 - DNA, 20 bp, Artificial Sequence
  Primer
cagagactcatgtgcatgag

SEQ ID NO: 4777 - DNA, 20 bp, Artificial Sequence
  Primer
tagcagggactagtccttgc

SEQ ID NO: 4778 - DNA, 20 bp, Artificial Sequence
  Primer
gacctcagggcaagattcta

SEQ ID NO: 4779 - DNA, 20 bp, Artificial Sequence
  Primer
ctggatgatagtggtttgcg

SEQ ID NO: 4780 - DNA, 20 bp, Artificial Sequence
  Primer
cgagtgtacaacggtgttga

SEQ ID NO: 4781 - DNA, 20 bp, Artificial Sequence
  Primer
cactgtgcatcactgtgtca

SEQ ID NO: 4782 - DNA, 20 bp, Artificial Sequence
  Primer
agacggtccacatatccatc

SEQ ID NO: 4783 - DNA, 20 bp, Artificial Sequence
  Primer
ggcaatagcaagcccatcat

SEQ ID NO: 4784 - DNA, 20 bp, Artificial Sequence
  Primer
cgctaaatacttcatcctgg

SEQ ID NO: 4785 - DNA, 20 bp, Artificial Sequence
  Primer
ttccttggggatacgaggat

SEQ ID NO: 4786 - DNA, 20 bp, Artificial Sequence
  Primer
ggagaatggcctctgtttca

SEQ ID NO: 4787 - DNA, 20 bp, Artificial Sequence
  Primer
gtgaatgtggactacggagt

SEQ ID NO: 4788 - DNA, 20 bp, Artificial Sequence
  Primer
aaaaggctctgtatagagcc

SEQ ID NO: 4789 - DNA, 20 bp, Artificial Sequence
  Primer
cagagcttcgaaaacttgcg

SEQ ID NO: 4790 - DNA, 20 bp, Artificial Sequence
  Primer
tacgggattgcatgttgctg

SEQ ID NO: 4791 - DNA, 20 bp, Artificial Sequence
  Primer
cgtcgtaagggacgtcttta

SEQ ID NO: 4792 - DNA, 20 bp, Artificial Sequence
  Primer
gtctacaagttagggagcgt

SEQ ID NO: 4793 - DNA, 20 bp, Artificial Sequence
  Primer
caaagagactagggacgagt

SEQ ID NO: 4794 - DNA, 20 bp, Artificial Sequence
  Primer
aaagagctcgggaagctctc

SEQ ID NO: 4795 - DNA, 20 bp, Artificial Sequence
  Primer
gcttgtgcagagtcattgct

SEQ ID NO: 4796 - DNA, 20 bp, Artificial Sequence
  Primer
ccagtggagacttgagatga

SEQ ID NO: 4797 - DNA, 20 bp, Artificial Sequence
  Primer
tatcgagggattgcccaaga

SEQ ID NO: 4798 - DNA, 20 bp, Artificial Sequence
  Primer
catccctacactatcttcgg

SEQ ID NO: 4799 - DNA, 20 bp, Artificial Sequence
  Primer
gcggctaaagaagaggagat

SEQ ID NO: 4800 - DNA, 20 bp, Artificial Sequence
  Primer
gagcgaatccatcccttcat

SEQ ID NO: 4801 - DNA, 20 bp, Artificial Sequence
  Primer
atcgctccgcatcacattac

SEQ ID NO: 4802 - DNA, 20 bp, Artificial Sequence
  Primer
ctggtagaacgatttgagag

SEQ ID NO: 4803 - DNA, 20 bp, Artificial Sequence
  Primer
gcaatccacgcatcattgtt

SEQ ID NO: 4804 - DNA, 20 bp, Artificial Sequence
  Primer
ggagcagaagcaactccttt

SEQ ID NO: 4805 - DNA, 20 bp, Artificial Sequence
  Primer
cccttgcaggtcgttgaata

SEQ ID NO: 4806 - DNA, 20 bp, Artificial Sequence
  Primer
gctgcatatcctctctcttc

SEQ ID NO: 4807 - DNA, 20 bp, Artificial Sequence
  Primer
gctgtgggttatcaagcgtt

SEQ ID NO: 4808 - DNA, 20 bp, Artificial Sequence
  Primer
gggcttttctgtgtagcgat

SEQ ID NO: 4809 - DNA, 20 bp, Artificial Sequence
  Primer
tcgatgctccgaatgaccgt

SEQ ID NO: 4810 - DNA, 20 bp, Artificial Sequence
  Primer
cgagaacacgattacgtcgt

SEQ ID NO: 4811 - DNA, 20 bp, Artificial Sequence
  Primer
ccaaaaggggttcctcttac

SEQ ID NO: 4812 - DNA, 20 bp, Artificial Sequence
  Primer
gcgtctttgcctattcacga

SEQ ID NO: 4813 - DNA, 20 bp, Artificial Sequence
  Primer
gtcgtccctggaagggatga

SEQ ID NO: 4814 - DNA, 20 bp, Artificial Sequence
  Primer
cgctatagaacaggaagcac

SEQ ID NO: 4815 - DNA, 20 bp, Artificial Sequence
  Primer
aaaaccgagacacagggacg

SEQ ID NO: 4816 - DNA, 20 bp, Artificial Sequence
  Primer
gccatccctgtgccttccgt

SEQ ID NO: 4817 - DNA, 20 bp, Artificial Sequence
  Primer
ccatgtgccttaggtggaat

SEQ ID NO: 4818 - DNA, 20 bp, Artificial Sequence
  Primer
atgacaactgtttccgcagc

SEQ ID NO: 4819 - DNA, 20 bp, Artificial Sequence
  Primer
gtctgtacagttagttgctg

SEQ ID NO: 4820 - DNA, 20 bp, Artificial Sequence
  Primer
cgctattgttggagcaacca

SEQ ID NO: 4821 - DNA, 20 bp, Artificial Sequence
  Primer
gcagaggttaaaggcgaagt

SEQ ID NO: 4822 - DNA, 20 bp, Artificial Sequence
  Primer
gccaaggatgagctatggat

SEQ ID NO: 4823 - DNA, 20 bp, Artificial Sequence
  Primer
gggtcgagcagatgttatcg

SEQ ID NO: 4824 - DNA, 20 bp, Artificial Sequence
  Primer
cgaagtacatgctgatcctg

SEQ ID NO: 4825 - DNA, 20 bp, Artificial Sequence
  Primer
cggttattctcaggccagtt

SEQ ID NO: 4826 - DNA, 20 bp, Artificial Sequence
  Primer
cggagcaatcattacgtctg

SEQ ID NO: 4827 - DNA, 20 bp, Artificial Sequence
  Primer
cgctggttaggaagtttctc

SEQ ID NO: 4828 - DNA, 20 bp, Artificial Sequence
  Primer
gcgaaaaaagccttagctct

SEQ ID NO: 4829 - DNA, 20 bp, Artificial Sequence
  Primer
cgataatgcattgccagagc

SEQ ID NO: 4830 - DNA, 20 bp, Artificial Sequence
  Primer
ggaagaacgcggttttctgt

SEQ ID NO: 4831 - DNA, 20 bp, Artificial Sequence
  Primer
caccatccgtaaagcagaac

SEQ ID NO: 4832 - DNA, 20 bp, Artificial Sequence
  Primer
cgcatcacgagcaattggat

SEQ ID NO: 4833 - DNA, 20 bp, Artificial Sequence
  Primer
ggataccacaaattctcccg

SEQ ID NO: 4834 - DNA, 20 bp, Artificial Sequence
  Primer
ggatctggtaaaacagcggt

SEQ ID NO: 4835 - DNA, 20 bp, Artificial Sequence
  Primer
cgaaggttcttcttcgatgc

SEQ ID NO: 4836 - DNA, 20 bp, Artificial Sequence
  Primer
cggttcctgctttagaagag

SEQ ID NO: 4837 - DNA, 20 bp, Artificial Sequence
  Primer
gggtcgtgtcgtattgactt

SEQ ID NO: 4838 - DNA, 20 bp, Artificial Sequence
  Primer
ctcaacggcgttgggatcgg

SEQ ID NO: 4839 - DNA, 20 bp, Artificial Sequence
  Primer
cagagggttttcaggagttc

SEQ ID NO: 4840 - DNA, 20 bp, Artificial Sequence
  Primer
gccaacgcttgatatcaacg

SEQ ID NO: 4841 - DNA, 20 bp, Artificial Sequence
  Primer
gaagcagatgaaagcgatgg

SEQ ID NO: 4842 - DNA, 20 bp, Artificial Sequence
  Primer
gggaagacaacagtctcttc

SEQ ID NO: 4843 - DNA, 20 bp, Artificial Sequence
  Primer
gttctgtgtattggaggcac

SEQ ID NO: 4844 - DNA, 20 bp, Artificial Sequence
  Primer
cgtactacaggcaagcgatt

SEQ ID NO: 4845 - DNA, 20 bp, Artificial Sequence
  Primer
cttgggccattgcattgagt

SEQ ID NO: 4846 - DNA, 20 bp, Artificial Sequence
  Primer
gggatgctcctattgattct

SEQ ID NO: 4847 - DNA, 20 bp, Artificial Sequence
  Primer
caggcaattgtgattctcgg

SEQ ID NO: 4848 - DNA, 20 bp, Artificial Sequence
  Primer
aggacaagtgttacgagttc

SEQ ID NO: 4849 - DNA, 20 bp, Artificial Sequence
  Primer
ctttgtgcccctttacacca

SEQ ID NO: 4850 - DNA, 20 bp, Artificial Sequence
  Primer
cttgggccattgcattgagt

SEQ ID NO: 4851 - DNA, 20 bp, Artificial Sequence
  Primer
gtcgttatcggcctaggtgt

SEQ ID NO: 4852 - DNA, 20 bp, Artificial Sequence
  Primer
ctttgcgaaaagctgcgaag

SEQ ID NO: 4853 - DNA, 20 bp, Artificial Sequence
  Primer
cacaaagatcactgcgaaaa

SEQ ID NO: 4854 - DNA, 20 bp, Artificial Sequence
  Primer
ccagctcgctgatcaagaaa

SEQ ID NO: 4855 - DNA, 20 bp, Artificial Sequence
  Primer
ggagttaggacgatattccg

SEQ ID NO: 4856 - DNA, 20 bp, Artificial Sequence
  Primer
gctcggtatgtgtgctgtat

SEQ ID NO: 4857 - DNA, 20 bp, Artificial Sequence
  Primer
ggatctgtagggaagacaac

SEQ ID NO: 4858 - DNA, 20 bp, Artificial Sequence
  Primer
agcgcagtgagcgagattat

SEQ ID NO: 4859 - DNA, 20 bp, Artificial Sequence
  Primer
gcatgacgtttatggatccg

SEQ ID NO: 4860 - DNA, 20 bp, Artificial Sequence
  Primer
gagatgggagtttctgaacc

SEQ ID NO: 4861 - DNA, 20 bp, Artificial Sequence
  Primer
agttctgcccaggtacagga

SEQ ID NO: 4862 - DNA, 20 bp, Artificial Sequence
  Primer
gtgtacgcgatgttatgagg

SEQ ID NO: 4863 - DNA, 20 bp, Artificial Sequence
  Primer
cttgaaaggaaacgcctcct

SEQ ID NO: 4864 - DNA, 20 bp, Artificial Sequence
  Primer
tgctgcaggagtcggtgggg

SEQ ID NO: 4865 - DNA, 20 bp, Artificial Sequence
  Primer
cgcgacattcttctggacaa

SEQ ID NO: 4866 - DNA, 20 bp, Artificial Sequence
  Primer
cttgaaaggaaacgcctcct

SEQ ID NO: 4867 - DNA, 20 bp, Artificial Sequence
  Primer
ggctggaactcttgaatggt

SEQ ID NO: 4868 - DNA, 20 bp, Artificial Sequence
  Primer
ttcaagatgcgcttgaggct

SEQ ID NO: 4869 - DNA, 20 bp, Artificial Sequence
  Primer
ggagatttagggttgcgtgt

SEQ ID NO: 4870 - DNA, 20 bp, Artificial Sequence
  Primer
cggggatgtgatttctgttg

SEQ ID NO: 4871 - DNA, 20 bp, Artificial Sequence
  Primer
gcgctggtccaacagcttta

SEQ ID NO: 4872 - DNA, 20 bp, Artificial Sequence
  Primer
ggcgattgtttcttcgctga

SEQ ID NO: 4873 - DNA, 20 bp, Artificial Sequence
  Primer
cttccgagtctggtctaaac

SEQ ID NO: 4874 - DNA, 20 bp, Artificial Sequence
  Primer
cgagagacaagacgttgagt

SEQ ID NO: 4875 - DNA, 20 bp, Artificial Sequence
  Primer
cttctctcttcttcttgctg

SEQ ID NO: 4876 - DNA, 20 bp, Artificial Sequence
  Primer
tcagatggtacctggatagc

SEQ ID NO: 4877 - DNA, 20 bp, Artificial Sequence
  Primer
acgaaccaatggtgtatcgg

SEQ ID NO: 4878 - DNA, 20 bp, Artificial Sequence
  Primer
gggactcttcacgatgtaag

SEQ ID NO: 4879 - DNA, 20 bp, Artificial Sequence
  Primer
ccaggagactaagaacactc

SEQ ID NO: 4880 - DNA, 20 bp, Artificial Sequence
  Primer
aaaaggagaagggggtagcc

SEQ ID NO: 4881 - DNA, 20 bp, Artificial Sequence
  Primer
gcggatactagtgaagatcc

SEQ ID NO: 4882 - DNA, 20 bp, Artificial Sequence
  Primer
ggcacctgtatcaacacact

SEQ ID NO: 4883 - DNA, 20 bp, Artificial Sequence
  Primer
gaggtactccgcggaactac

SEQ ID NO: 4884 - DNA, 20 bp, Artificial Sequence
  Primer
cgattctgccaatagagtgg

SEQ ID NO: 4885 - DNA, 20 bp, Artificial Sequence
  Primer
gaatctttggccttcactcc

SEQ ID NO: 4886 - DNA, 20 bp, Artificial Sequence
  Primer
caatagcggcatctactcct

SEQ ID NO: 4887 - DNA, 20 bp, Artificial Sequence
  Primer
ccgttgttcgaactccagtt

SEQ ID NO: 4888 - DNA, 20 bp, Artificial Sequence
  Primer
atccgaagggttgtaagagc

SEQ ID NO: 4889 - DNA, 20 bp, Artificial Sequence
  Primer
gcgtggtctatcaagatcgt

SEQ ID NO: 4890 - DNA, 20 bp, Artificial Sequence
  Primer
gctaggcgcatttcttggat

SEQ ID NO: 4891 - DNA, 20 bp, Artificial Sequence
  Primer
acggacccagcataaatgag

SEQ ID NO: 4892 - DNA, 20 bp, Artificial Sequence
  Primer
agccgatcatagctatctgc

SEQ ID NO: 4893 - DNA, 20 bp, Artificial Sequence
  Primer
ggtgagggagatccaattcg

SEQ ID NO: 4894 - DNA, 20 bp, Artificial Sequence
  Primer
gactgaatgaggtgaagggt

SEQ ID NO: 4895 - DNA, 20 bp, Artificial Sequence
  Primer
cgcaagctctctttatggag

SEQ ID NO: 4896 - DNA, 20 bp, Artificial Sequence
  Primer
gttgatagatccgccgcaca

SEQ ID NO: 4897 - DNA, 20 bp, Artificial Sequence
  Primer
agcaagtgtggcaggtactc

SEQ ID NO: 4898 - DNA, 20 bp, Artificial Sequence
  Primer
cgtatcttttagcgccatga

SEQ ID NO: 4899 - DNA, 20 bp, Artificial Sequence
  Primer
cgaggtgccttttattaggg

SEQ ID NO: 4900 - DNA, 20 bp, Artificial Sequence
  Primer
ctccacagacgccaaaatgt

SEQ ID NO: 4901 - DNA, 20 bp, Artificial Sequence
  Primer
gtctacagtcttagtgaggg

SEQ ID NO: 4902 - DNA, 20 bp, Artificial Sequence
  Primer
aacatgactgcaggttgtcc

SEQ ID NO: 4903 - DNA, 20 bp, Artificial Sequence
  Primer
ggcctgctggaaagatcaaa

SEQ ID NO: 4904 - DNA, 20 bp, Artificial Sequence
  Primer
cggcgacaagaataaggtct

SEQ ID NO: 4905 - DNA, 20 bp, Artificial Sequence
  Primer
caagtgcgtagaagacaagc

SEQ ID NO: 4906 - DNA, 20 bp, Artificial Sequence
  Primer
caccgggtttcagagagaat

SEQ ID NO: 4907 - DNA, 20 bp, Artificial Sequence
  Primer
ggacattgccagacgggcag

SEQ ID NO: 4908 - DNA, 20 bp, Artificial Sequence
  Primer
gtatgtaggctgcagatgac

SEQ ID NO: 4909 - DNA, 20 bp, Artificial Sequence
  Primer
cggaggaaccgatggtgtgg

SEQ ID NO: 4910 - DNA, 20 bp, Artificial Sequence
  Primer
tccatagaacctggatcgtc

SEQ ID NO: 4911 - DNA, 20 bp, Artificial Sequence
  Primer
gggttgtggatacactggat

SEQ ID NO: 4912 - DNA, 20 bp, Artificial Sequence
  Primer
gcgcgctgtttctatgttac

SEQ ID NO: 4913 - DNA, 20 bp, Artificial Sequence
  Primer
tctgggcgctatccgatcta

SEQ ID NO: 4914 - DNA, 20 bp, Artificial Sequence
  Primer
ctgccctagccatttggcta

SEQ ID NO: 4915 - DNA, 20 bp, Artificial Sequence
  Primer
ggatataaaatgggcagccg

SEQ ID NO: 4916 - DNA, 20 bp, Artificial Sequence
  Primer
cttgcagaaggagcacaaat

SEQ ID NO: 4917 - DNA, 20 bp, Artificial Sequence
  Primer
agcgttgcagacgtttgccg

SEQ ID NO: 4918 - DNA, 20 bp, Artificial Sequence
  Primer
catgggtggtgtcttaggaa

SEQ ID NO: 4919 - DNA, 20 bp, Artificial Sequence
  Primer
ccggattgagcagctgttgc

SEQ ID NO: 4920 - DNA, 20 bp, Artificial Sequence
  Primer
tagggctttcagcgttgcag

SEQ ID NO: 4921 - DNA, 20 bp, Artificial Sequence
  Primer
gcttcttctgtaggaagggt

SEQ ID NO: 4922 - DNA, 20 bp, Artificial Sequence
  Primer
gccaactcttatggatcgac

SEQ ID NO: 4923 - DNA, 20 bp, Artificial Sequence
  Primer
gcttcaggcatgaaaacagc

SEQ ID NO: 4924 - DNA, 20 bp, Artificial Sequence
  Primer
gggcgttgcatagagtgtat

SEQ ID NO: 4925 - DNA, 20 bp, Artificial Sequence
  Primer
ctggggcgcaagaaactttt

SEQ ID NO: 4926 - DNA, 20 bp, Artificial Sequence
  Primer
cgcctatccttagacttctg

SEQ ID NO: 4927 - DNA, 20 bp, Artificial Sequence
  Primer
ggtgcttgttgagggtggcg

SEQ ID NO: 4928 - DNA, 20 bp, Artificial Sequence
  Primer
cgtgtagctattgttgggtc

SEQ ID NO: 4929 - DNA, 20 bp, Artificial Sequence
  Primer
tcggcacggttccctcatgg

SEQ ID NO: 4930 - DNA, 20 bp, Artificial Sequence
  Primer
gggcattggttagatctgcc

SEQ ID NO: 4931 - DNA, 20 bp, Artificial Sequence
  Primer
gagaattagctcgggcggat

SEQ ID NO: 4932 - DNA, 20 bp, Artificial Sequence
  Primer
gccggagaaaaagtctctac

SEQ ID NO: 4933 - DNA, 20 bp, Artificial Sequence
  Primer
ccggccagccagaccctgta

SEQ ID NO: 4934 - DNA, 20 bp, Artificial Sequence
  Primer
ggggccgaagtttttgggtg

SEQ ID NO: 4935 - DNA, 20 bp, Artificial Sequence
  Primer
ggagttgcagttcagacaga

SEQ ID NO: 4936 - DNA, 20 bp, Artificial Sequence
  Primer
gtgtgataggtgaaggttgg

SEQ ID NO: 4937 - DNA, 20 bp, Artificial Sequence
  Primer
gagatcagcggctcctgaaa

SEQ ID NO: 4938 - DNA, 20 bp, Artificial Sequence
  Primer
gtctcgccatgagatcttct

SEQ ID NO: 4939 - DNA, 20 bp, Artificial Sequence
  Primer
gccaaggagatataggcaga

SEQ ID NO: 4940 - DNA, 20 bp, Artificial Sequence
  Primer
ggattgcagggactagaaag

SEQ ID NO: 4941 - DNA, 20 bp, Artificial Sequence
  Primer
ccctacaaaggcttgttctc

SEQ ID NO: 4942 - DNA, 20 bp, Artificial Sequence
  Primer
gagagcctgatatcctatcc

SEQ ID NO: 4943 - DNA, 20 bp, Artificial Sequence
  Primer
ccacaagttcacttgacgca

SEQ ID NO: 4944 - DNA, 20 bp, Artificial Sequence
  Primer
ggtctcctgtgagcatacat

SEQ ID NO: 4945 - DNA, 20 bp, Artificial Sequence
  Primer
accatccctgttaagactgg

SEQ ID NO: 4946 - DNA, 20 bp, Artificial Sequence
  Primer
ctcgtgaagtgtggactaac

SEQ ID NO: 4947 - DNA, 20 bp, Artificial Sequence
  Primer
gcaaggctcctcctattctt

SEQ ID NO: 4948 - DNA, 20 bp, Artificial Sequence
  Primer
gaccatccctgttaagactg

SEQ ID NO: 4949 - DNA, 20 bp, Artificial Sequence
  Primer
ggagaacttcttctggactc

SEQ ID NO: 4950 - DNA, 20 bp, Artificial Sequence
  Primer
gtgatgcggatggagttact

SEQ ID NO: 4951 - DNA, 20 bp, Artificial Sequence
  Primer
gttcgttgccctgtatcgaa

SEQ ID NO: 4952 - DNA, 20 bp, Artificial Sequence
  Primer
gaagcgtcatagagagcaag

SEQ ID NO: 4953 - DNA, 20 bp, Artificial Sequence
  Primer
cgatagggtccgccatgttt

SEQ ID NO: 4954 - DNA, 20 bp, Artificial Sequence
  Primer
cccaatcataggttgtccct

SEQ ID NO: 4955 - DNA, 20 bp, Artificial Sequence
  Primer
agctgcaagaaggtagccta

SEQ ID NO: 4956 - DNA, 20 bp, Artificial Sequence
  Primer
ggagataagggtgtccgaaa

SEQ ID NO: 4957 - DNA, 20 bp, Artificial Sequence
  Primer
gggagagagctttttgctca

SEQ ID NO: 4958 - DNA, 20 bp, Artificial Sequence
  Primer
gggtagagcccgctaagtat

SEQ ID NO: 4959 - DNA, 20 bp, Artificial Sequence
  Primer
ggctcctatggcaagatagt

SEQ ID NO: 4960 - DNA, 20 bp, Artificial Sequence
  Primer
ggacagcaagttcaagaagc

SEQ ID NO: 4961 - DNA, 20 bp, Artificial Sequence
  Primer
cagggcctgatgctgtttat

SEQ ID NO: 4962 - DNA, 20 bp, Artificial Sequence
  Primer
ggtctgaccgagatagagaa

SEQ ID NO: 4963 - DNA, 20 bp, Artificial Sequence
  Primer
ggctaccttctctgcaacta

SEQ ID NO: 4964 - DNA, 20 bp, Artificial Sequence
  Primer
cagggcctgatgctgtttat

SEQ ID NO: 4965 - DNA, 20 bp, Artificial Sequence
  Primer
gcgggacggccaaatatttc

SEQ ID NO: 4966 - DNA, 20 bp, Artificial Sequence
  Primer
gtaacgcttgctgacgaaga

SEQ ID NO: 4967 - DNA, 20 bp, Artificial Sequence
  Primer
catcccatgatggtggcaaa

SEQ ID NO: 4968 - DNA, 20 bp, Artificial Sequence
  Primer
atcgtcgctccatctagagc

SEQ ID NO: 4969 - DNA, 20 bp, Artificial Sequence
  Primer
cttccccatcttccttctac

SEQ ID NO: 4970 - DNA, 20 bp, Artificial Sequence
  Primer
gcaggcatagcgtctaatga

SEQ ID NO: 4971 - DNA, 20 bp, Artificial Sequence
  Primer
gagaagcgcgtaaaagagag

SEQ ID NO: 4972 - DNA, 20 bp, Artificial Sequence
  Primer
gagaaacgaaaggtgggctt

SEQ ID NO: 4973 - DNA, 20 bp, Artificial Sequence
  Primer
cgaagtcgaaccatccagtt

SEQ ID NO: 4974 - DNA, 20 bp, Artificial Sequence
  Primer
aaggttgtcgatggggagat

SEQ ID NO: 4975 - DNA, 20 bp, Artificial Sequence
  Primer
cctcggaatccagtattcag

SEQ ID NO: 4976 - DNA, 20 bp, Artificial Sequence
  Primer
gtgggcgtaatggtgtgatg

SEQ ID NO: 4977 - DNA, 20 bp, Artificial Sequence
  Primer
ggattgctcgaagaggttga

SEQ ID NO: 4978 - DNA, 20 bp, Artificial Sequence
  Primer
ctcgtgctaacgatactgtg

SEQ ID NO: 4979 - DNA, 20 bp, Artificial Sequence
  Primer
ccacagcgcattcttgaaga

SEQ ID NO: 4980 - DNA, 20 bp, Artificial Sequence
  Primer
cttcggtgattataacggcg

SEQ ID NO: 4981 - DNA, 20 bp, Artificial Sequence
  Primer
gcggtcatttttggtggaag

SEQ ID NO: 4982 - DNA, 20 bp, Artificial Sequence
  Primer
tgaaagccaatgaacaggtc

SEQ ID NO: 4983 - DNA, 20 bp, Artificial Sequence
  Primer
cggactcactattcacgaac

SEQ ID NO: 4984 - DNA, 20 bp, Artificial Sequence
  Primer
atgccacagcgcattcttga

SEQ ID NO: 4985 - DNA, 20 bp, Artificial Sequence
  Primer
gaggagctctgattaaaggg

SEQ ID NO: 4986 - DNA, 20 bp, Artificial Sequence
  Primer
tacgcggacgcgatcaggta

SEQ ID NO: 4987 - DNA, 20 bp, Artificial Sequence
  Primer
cgacgtaagcagttagcttc

SEQ ID NO: 4988 - DNA, 20 bp, Artificial Sequence
  Primer
ggttggagctgatactgtga

SEQ ID NO: 4989 - DNA, 20 bp, Artificial Sequence
  Primer
cgaggcgagactctttttcc

SEQ ID NO: 4990 - DNA, 20 bp, Artificial Sequence
  Primer
cagtttctcccgctaagatg

SEQ ID NO: 4991 - DNA, 20 bp, Artificial Sequence
  Primer
ctgtcatatcctcttcgcta

SEQ ID NO: 4992 - DNA, 20 bp, Artificial Sequence
  Primer
cggtgtgtattagcgctcaa

SEQ ID NO: 4993 - DNA, 20 bp, Artificial Sequence
  Primer
ggctactcttgaccctagaa

SEQ ID NO: 4994 - DNA, 20 bp, Artificial Sequence
  Primer
cgcaatcctttgcttgtagg

SEQ ID NO: 4995 - DNA, 20 bp, Artificial Sequence
  Primer
tcgctaaccctgctgtgata

SEQ ID NO: 4996 - DNA, 20 bp, Artificial Sequence
  Primer
ggctcgttcgccgcgacccg

SEQ ID NO: 4997 - DNA, 20 bp, Artificial Sequence
  Primer
cttgatacccagcattgcgt

SEQ ID NO: 4998 - DNA, 20 bp, Artificial Sequence
  Primer
aggggttaacactctcagac

SEQ ID NO: 4999 - DNA, 20 bp, Artificial Sequence
  Primer
cgtaagcgagagaaggcttc

SEQ ID NO: 5000 - DNA, 20 bp, Artificial Sequence
  Primer
ccgaaagccgcgccaataga

SEQ ID NO: 5001 - DNA, 20 bp, Artificial Sequence
  Primer
cagcgctcctccttaagaag

SEQ ID NO: 5002 - DNA, 20 bp, Artificial Sequence
  Primer
gcgtagttccttcttgagag

SEQ ID NO: 5003 - DNA, 20 bp, Artificial Sequence
  Primer
cgaatccagaaagagcgatg

SEQ ID NO: 5004 - DNA, 20 bp, Artificial Sequence
  Primer
gaattgacgaatcgcaccat

SEQ ID NO: 5005 - DNA, 20 bp, Artificial Sequence
  Primer
cgacagttaccttgcagaac

SEQ ID NO: 5006 - DNA, 20 bp, Artificial Sequence
  Primer
gctgattcgcgatattcgca

SEQ ID NO: 5007 - DNA, 20 bp, Artificial Sequence
  Primer
gcaatctctgaagcttgtcg

SEQ ID NO: 5008 - DNA, 20 bp, Artificial Sequence
  Primer
gcgtgttgaaggacgtaact

SEQ ID NO: 5009 - DNA, 20 bp, Artificial Sequence
  Primer
caccgagatgcaaaccgggg

SEQ ID NO: 5010 - DNA, 20 bp, Artificial Sequence
  Primer
aatatggctggtagagggac

SEQ ID NO: 5011 - DNA, 20 bp, Artificial Sequence
  Primer
ccttgttgtataggcgcctt

SEQ ID NO: 5012 - DNA, 20 bp, Artificial Sequence
  Primer
acgatgtgcagattctgggt

SEQ ID NO: 5013 - DNA, 20 bp, Artificial Sequence
  Primer
gcaagagagagaaaactcag

SEQ ID NO: 5014 - DNA, 20 bp, Artificial Sequence
  Primer
ccttgttgtataggcgcctt

SEQ ID NO: 5015 - DNA, 20 bp, Artificial Sequence
  Primer
cgtcaaaagagtttggtgag

SEQ ID NO: 5016 - DNA, 20 bp, Artificial Sequence
  Primer
ctgcctagcctttttctctc

SEQ ID NO: 5017 - DNA, 20 bp, Artificial Sequence
  Primer
ccatggcagatctatccttg

SEQ ID NO: 5018 - DNA, 20 bp, Artificial Sequence
  Primer
gttgcctacgtggaagtagg

SEQ ID NO: 5019 - DNA, 20 bp, Artificial Sequence
  Primer
ggaacctctatttgaggagg

SEQ ID NO: 5020 - DNA, 20 bp, Artificial Sequence
  Primer
gcatgggtagcagcctttag

SEQ ID NO: 5021 - DNA, 20 bp, Artificial Sequence
  Primer
gctggacaatacgctcttgc

SEQ ID NO: 5022 - DNA, 20 bp, Artificial Sequence
  Primer
ggagccagcatactcataga

SEQ ID NO: 5023 - DNA, 20 bp, Artificial Sequence
  Primer
ctcgatttgcttcctcctgt

SEQ ID NO: 5024 - DNA, 20 bp, Artificial Sequence
  Primer
gaagttgtgttgcacgtggt

SEQ ID NO: 5025 - DNA, 20 bp, Artificial Sequence
  Primer
cgtgttgcacgaaggaatga

SEQ ID NO: 5026 - DNA, 20 bp, Artificial Sequence
  Primer
ggcgatccctcttgatcaaa

SEQ ID NO: 5027 - DNA, 20 bp, Artificial Sequence
  Primer
gagatcttgctaccaatggg

SEQ ID NO: 5028 - DNA, 20 bp, Artificial Sequence
  Primer
atggaaggttggccgcggag

SEQ ID NO: 5029 - DNA, 20 bp, Artificial Sequence
  Primer
cgaggaggatttcaagggat

SEQ ID NO: 5030 - DNA, 20 bp, Artificial Sequence
  Primer
gcaagatcctcaacgtgttc

SEQ ID NO: 5031 - DNA, 20 bp, Artificial Sequence
  Primer
cgggtgccacaactattccc

SEQ ID NO: 5032 - DNA, 20 bp, Artificial Sequence
  Primer
cgagaagatgaaccagcttg

SEQ ID NO: 5033 - DNA, 20 bp, Artificial Sequence
  Primer
gacgaggatcctagttttgc

SEQ ID NO: 5034 - DNA, 20 bp, Artificial Sequence
  Primer
gtagtcttcctggtacggaa

SEQ ID NO: 5035 - DNA, 20 bp, Artificial Sequence
  Primer
caggaagttcttcctggaac

SEQ ID NO: 5036 - DNA, 20 bp, Artificial Sequence
  Primer
gcaagaggtttacgagccat

SEQ ID NO: 5037 - DNA, 20 bp, Artificial Sequence
  Primer
ggaggtatattttgggagca

SEQ ID NO: 5038 - DNA, 20 bp, Artificial Sequence
  Primer
cttgcgattcttcctcagga

SEQ ID NO: 5039 - DNA, 20 bp, Artificial Sequence
  Primer
cctaagtgtgtgcgaatgac

SEQ ID NO: 5040 - DNA, 20 bp, Artificial Sequence
  Primer
ctatacgagagatggatcgc

SEQ ID NO: 5041 - DNA, 20 bp, Artificial Sequence
  Primer
agccccaccagagataaagc

SEQ ID NO: 5042 - DNA, 20 bp, Artificial Sequence
  Primer
ggaggtatattttgggagca

SEQ ID NO: 5043 - DNA, 20 bp, Artificial Sequence
  Primer
aggaacctgcacgtctcggc

SEQ ID NO: 5044 - DNA, 20 bp, Artificial Sequence
  Primer
tgaccctgactccccaataa

SEQ ID NO: 5045 - DNA, 20 bp, Artificial Sequence
  Primer
tagcagtacgcgaggcagag

SEQ ID NO: 5046 - DNA, 20 bp, Artificial Sequence
  Primer
gagtatcagatggccagaag

SEQ ID NO: 5047 - DNA, 20 bp, Artificial Sequence
  Primer
tgcaggctcttcctttttcg

SEQ ID NO: 5048 - DNA, 20 bp, Artificial Sequence
  Primer
ggaggctaaacgtctagtga

SEQ ID NO: 5049 - DNA, 20 bp, Artificial Sequence
  Primer
cctcagtgtgtgattgactc

SEQ ID NO: 5050 - DNA, 20 bp, Artificial Sequence
  Primer
tctgcgagcctctttgggta

SEQ ID NO: 5051 - DNA, 20 bp, Artificial Sequence
  Primer
ggtagagaactgcaaacacc

SEQ ID NO: 5052 - DNA, 20 bp, Artificial Sequence
  Primer
cgggacgctatctaatgctt

SEQ ID NO: 5053 - DNA, 20 bp, Artificial Sequence
  Primer
gagagagttgcgtggaacat

SEQ ID NO: 5054 - DNA, 20 bp, Artificial Sequence
  Primer
caggtcttgatgtcgatgct

SEQ ID NO: 5055 - DNA, 20 bp, Artificial Sequence
  Primer
gcgccaggtattagtgaaga

SEQ ID NO: 5056 - DNA, 20 bp, Artificial Sequence
  Primer
gggcttatacggatccacaa

SEQ ID NO: 5057 - DNA, 20 bp, Artificial Sequence
  Primer
gggcattacaatcttgggtt

SEQ ID NO: 5058 - DNA, 20 bp, Artificial Sequence
  Primer
ggtgctgcgattacttggaa

SEQ ID NO: 5059 - DNA, 20 bp, Artificial Sequence
  Primer
gcgattgcctgttttgatcg

SEQ ID NO: 5060 - DNA, 20 bp, Artificial Sequence
  Primer
ccccaaaacaaagaaacccc

SEQ ID NO: 5061 - DNA, 20 bp, Artificial Sequence
  Primer
agtgattgcgcgagtagggt

SEQ ID NO: 5062 - DNA, 20 bp, Artificial Sequence
  Primer
gatccgtggccaacaagttt

SEQ ID NO: 5063 - DNA, 20 bp, Artificial Sequence
  Primer
gatctgatcgcagctttgga

SEQ ID NO: 5064 - DNA, 20 bp, Artificial Sequence
  Primer
cgatcgggcattatcaagtg

SEQ ID NO: 5065 - DNA, 20 bp, Artificial Sequence
  Primer
ggcatttcattgctttgcgg

SEQ ID NO: 5066 - DNA, 20 bp, Artificial Sequence
  Primer
tgaaagacgtgtggttcgct

SEQ ID NO: 5067 - DNA, 20 bp, Artificial Sequence
  Primer
ctgtattgcgatggctggaa

SEQ ID NO: 5068 - DNA, 20 bp, Artificial Sequence
  Primer
gagcaaaagccatgttggca

SEQ ID NO: 5069 - DNA, 20 bp, Artificial Sequence
  Primer
gctcagatttcagacttggg

SEQ ID NO: 5070 - DNA, 20 bp, Artificial Sequence
  Primer
cgcgctcaagtagaccgata

SEQ ID NO: 5071 - DNA, 20 bp, Artificial Sequence
  Primer
gcctctccagagatcttgaa

SEQ ID NO: 5072 - DNA, 20 bp, Artificial Sequence
  Primer
acaagtgctgcaccacgttc

SEQ ID NO: 5073 - DNA, 20 bp, Artificial Sequence
  Primer
ccgtagctaactctgcttct

SEQ ID NO: 5074 - DNA, 20 bp, Artificial Sequence
  Primer
gcaggctctggctttgtgag

SEQ ID NO: 5075 - DNA, 20 bp, Artificial Sequence
  Primer
ggatctctgctgcttgttca

SEQ ID NO: 5076 - DNA, 20 bp, Artificial Sequence
  Primer
gcagaaaccgtccctgcatc

SEQ ID NO: 5077 - DNA, 20 bp, Artificial Sequence
  Primer
ctagcctctttctcagcaga

SEQ ID NO: 5078 - DNA, 20 bp, Artificial Sequence
  Primer
ctctaaccgctgagctaaag

SEQ ID NO: 5079 - DNA, 20 bp, Artificial Sequence
  Primer
tggtagagcaacgcattcgt

SEQ ID NO: 5080 - DNA, 20 bp, Artificial Sequence
  Primer
cgttgccagataggcaaatc

SEQ ID NO: 5081 - DNA, 20 bp, Artificial Sequence
  Primer
gatcctctgcattcggacta

SEQ ID NO: 5082 - DNA, 20 bp, Artificial Sequence
  Primer
gccgtatctccggttctctt

SEQ ID NO: 5083 - DNA, 20 bp, Artificial Sequence
  Primer
cgatcctacttccgtagatg

SEQ ID NO: 5084 - DNA, 20 bp, Artificial Sequence
  Primer
gttatgctcgtcgtgctgtg

SEQ ID NO: 5085 - DNA, 20 bp, Artificial Sequence
  Primer
cactcttctcgtcctgttgt

SEQ ID NO: 5086 - DNA, 20 bp, Artificial Sequence
  Primer
ttcaagcggaatcgcaagga

SEQ ID NO: 5087 - DNA, 20 bp, Artificial Sequence
  Primer
ctgaaactacagcgcagagc

SEQ ID NO: 5088 - DNA, 20 bp, Artificial Sequence
  Primer
agcacgcttttcatccatgc

SEQ ID NO: 5089 - DNA, 20 bp, Artificial Sequence
  Primer
gcagcagagcctagtagtaa

SEQ ID NO: 5090 - DNA, 20 bp, Artificial Sequence
  Primer
aggacctggcagtgtattgc

SEQ ID NO: 5091 - DNA, 20 bp, Artificial Sequence
  Primer
gggaatctggggagaactaa

SEQ ID NO: 5092 - DNA, 20 bp, Artificial Sequence
  Primer
cgcagagccttgtagattct

SEQ ID NO: 5093 - DNA, 20 bp, Artificial Sequence
  Primer
gacagagcagagaaggttgt

SEQ ID NO: 5094 - DNA, 20 bp, Artificial Sequence
  Primer
gcaagctctaataggaacga

SEQ ID NO: 5095 - DNA, 20 bp, Artificial Sequence
  Primer
cgtgctagagaggttttagc

SEQ ID NO: 5096 - DNA, 20 bp, Artificial Sequence
  Primer
ggtggagtctttgaaagctc

SEQ ID NO: 5097 - DNA, 20 bp, Artificial Sequence
  Primer
tgattggagagcggggacga

SEQ ID NO: 5098 - DNA, 20 bp, Artificial Sequence
  Primer
gaaagaaaatgtgctggcag

SEQ ID NO: 5099 - DNA, 20 bp, Artificial Sequence
  Primer
acagacggtcaagcagggta

SEQ ID NO: 5100 - DNA, 20 bp, Artificial Sequence
  Primer
gtcgatttcgcaatcgatca

SEQ ID NO: 5101 - DNA, 20 bp, Artificial Sequence
  Primer
gtgctgcggtgaataaacct

SEQ ID NO: 5102 - DNA, 20 bp, Artificial Sequence
  Primer
cagggtaatggtgacgaaga

SEQ ID NO: 5103 - DNA, 20 bp, Artificial Sequence
  Primer
ggacatcttgtgcaatcagg

SEQ ID NO: 5104 - DNA, 20 bp, Artificial Sequence
  Primer
cccgagaattggagtgctaa

SEQ ID NO: 5105 - DNA, 20 bp, Artificial Sequence
  Primer
gctctctgccaatcaagttg

SEQ ID NO: 5106 - DNA, 20 bp, Artificial Sequence
  Primer
ccagatgctggatggcgtat

SEQ ID NO: 5107 - DNA, 20 bp, Artificial Sequence
  Primer
agatactgctgaaagcgcag

SEQ ID NO: 5108 - DNA, 20 bp, Artificial Sequence
  Primer
agctgctcgtcagttgtttg

SEQ ID NO: 5109 - DNA, 20 bp, Artificial Sequence
  Primer
ccaacccaatctcaaaacgc

SEQ ID NO: 5110 - DNA, 20 bp, Artificial Sequence
  Primer
ggattcgtgcggtgaagaat

SEQ ID NO: 5111 - DNA, 20 bp, Artificial Sequence
  Primer
ggtaatgagggagagcctgc

SEQ ID NO: 5112 - DNA, 20 bp, Artificial Sequence
  Primer
aggactgagtaaaacggagc

SEQ ID NO: 5113 - DNA, 20 bp, Artificial Sequence
  Primer
agttgtatagcgtcgcgcca

SEQ ID NO: 5114 - DNA, 20 bp, Artificial Sequence
  Primer
ccgggaaaatgtgttttggg

SEQ ID NO: 5115 - DNA, 20 bp, Artificial Sequence
  Primer
cggatatgatccaaggaagc

SEQ ID NO: 5116 - DNA, 20 bp, Artificial Sequence
  Primer
cgcataagagtgtgtggaat

SEQ ID NO: 5117 - DNA, 20 bp, Artificial Sequence
  Primer
gaggtcgctcataagttcgt

SEQ ID NO: 5118 - DNA, 20 bp, Artificial Sequence
  Primer
ccatgcgggtgcagcgccat

SEQ ID NO: 5119 - DNA, 20 bp, Artificial Sequence
  Primer
gtttacgggatcccctctat

SEQ ID NO: 5120 - DNA, 20 bp, Artificial Sequence
  Primer
cgcactattaaggctatccg

SEQ ID NO: 5121 - DNA, 20 bp, Artificial Sequence
  Primer
gtctgttcgaaaccaaggag

SEQ ID NO: 5122 - DNA, 20 bp, Artificial Sequence
  Primer
tccggagagtgcggagcgag

SEQ ID NO: 5123 - DNA, 20 bp, Artificial Sequence
  Primer
cctaggaagagggctttttt

SEQ ID NO: 5124 - DNA, 20 bp, Artificial Sequence
  Primer
ggtttgggagttgcatgtgc

SEQ ID NO: 5125 - DNA, 20 bp, Artificial Sequence
  Primer
ggcggagctggtgttacgga

SEQ ID NO: 5126 - DNA, 20 bp, Artificial Sequence
  Primer
atagcgagtcggtctgttcg

SEQ ID NO: 5127 - DNA, 20 bp, Artificial Sequence
  Primer
ccacgatttctcctgcattg

SEQ ID NO: 5128 - DNA, 20 bp, Artificial Sequence
  Primer
aaggattcggcggattagca

SEQ ID NO: 5129 - DNA, 20 bp, Artificial Sequence
  Primer
gccggctttcttatgtagac

SEQ ID NO: 5130 - DNA, 20 bp, Artificial Sequence
  Primer
gcgataagagttctcgacag

SEQ ID NO: 5131 - DNA, 20 bp, Artificial Sequence
  Primer
ccaccgagctaaacataagg

SEQ ID NO: 5132 - DNA, 20 bp, Artificial Sequence
  Primer
ccacgatttctcctgcattg

SEQ ID NO: 5133 - DNA, 20 bp, Artificial Sequence
  Primer
gcttctccaacggggaaagc

SEQ ID NO: 5134 - DNA, 20 bp, Artificial Sequence
  Primer
cagtcggaaagagcgtacat

SEQ ID NO: 5135 - DNA, 20 bp, Artificial Sequence
  Primer
gcgatgccgaaattgcgaat

SEQ ID NO: 5136 - DNA, 20 bp, Artificial Sequence
  Primer
cttagctacagcatccgcat

SEQ ID NO: 5137 - DNA, 20 bp, Artificial Sequence
  Primer
gcaggcggaagatcatatgt

SEQ ID NO: 5138 - DNA, 20 bp, Artificial Sequence
  Primer
gcgatgccgaaattgcgaat

SEQ ID NO: 5139 - DNA, 20 bp, Artificial Sequence
  Primer
cttgcgtggattcagagtct

SEQ ID NO: 5140 - DNA, 20 bp, Artificial Sequence
  Primer
ggcggattctcaatgcctat

SEQ ID NO: 5141 - DNA, 20 bp, Artificial Sequence
  Primer
ctcctcttttctgcatctgc

SEQ ID NO: 5142 - DNA, 20 bp, Artificial Sequence
  Primer
agagggtgtattccctatcg

SEQ ID NO: 5143 - DNA, 20 bp, Artificial Sequence
  Primer
cagtgctacaggaggattgt

SEQ ID NO: 5144 - DNA, 20 bp, Artificial Sequence
  Primer
cagctgttggcgtatcttcc

SEQ ID NO: 5145 - DNA, 20 bp, Artificial Sequence
  Primer
gctccaaatagatgacgagg

SEQ ID NO: 5146 - DNA, 20 bp, Artificial Sequence
  Primer
ggcgctttggaaagtagcaa

SEQ ID NO: 5147 - DNA, 20 bp, Artificial Sequence
  Primer
ggaccacagttgggaatatg

SEQ ID NO: 5148 - DNA, 20 bp, Artificial Sequence
  Primer
tcaaggatcggaaggctttc

SEQ ID NO: 5149 - DNA, 20 bp, Artificial Sequence
  Primer
gcgacgaatgatacgatacc

SEQ ID NO: 5150 - DNA, 20 bp, Artificial Sequence
  Primer
ggtgcgcgtgttctttctaa

SEQ ID NO: 5151 - DNA, 20 bp, Artificial Sequence
  Primer
ggacgcatagattcagcgaa

SEQ ID NO: 5152 - DNA, 20 bp, Artificial Sequence
  Primer
cttggacgaatgactgcgaa

SEQ ID NO: 5153 - DNA, 20 bp, Artificial Sequence
  Primer
ttctcaaccaccttcccgat

SEQ ID NO: 5154 - DNA, 20 bp, Artificial Sequence
  Primer
ggaaggcatgtagctattgg

SEQ ID NO: 5155 - DNA, 20 bp, Artificial Sequence
  Primer
gcatcgtttttgcggcttca

SEQ ID NO: 5156 - DNA, 20 bp, Artificial Sequence
  Primer
gcgacgaatgatacgatacc

SEQ ID NO: 5157 - DNA, 20 bp, Artificial Sequence
  Primer
ccgaatatcctacttgcgac

SEQ ID NO: 5158 - DNA, 20 bp, Artificial Sequence
  Primer
atcctgtagggcgtcccgaa

SEQ ID NO: 5159 - DNA, 20 bp, Artificial Sequence
  Primer
ggtttctgcaggaagagtgc

SEQ ID NO: 5160 - DNA, 20 bp, Artificial Sequence
  Primer
gaccttctacctatgccact

SEQ ID NO: 5161 - DNA, 20 bp, Artificial Sequence
  Primer
aagcgcgcttcttccgctct

SEQ ID NO: 5162 - DNA, 20 bp, Artificial Sequence
  Primer
gcttcggatagtatgtcctg

SEQ ID NO: 5163 - DNA, 20 bp, Artificial Sequence
  Primer
gcatgtgtatcgtcttctgc

SEQ ID NO: 5164 - DNA, 20 bp, Artificial Sequence
  Primer
gcgcaatggatcgatcggca

SEQ ID NO: 5165 - DNA, 20 bp, Artificial Sequence
  Primer
ggctcctgagaaaacgtgta

SEQ ID NO: 5166 - DNA, 20 bp, Artificial Sequence
  Primer
ctatccaaggaaaccaaggg

SEQ ID NO: 5167 - DNA, 20 bp, Artificial Sequence
  Primer
cgtgcattggtcgttacaca

SEQ ID NO: 5168 - DNA, 20 bp, Artificial Sequence
  Primer
caagacttcgggatagttgc

SEQ ID NO: 5169 - DNA, 20 bp, Artificial Sequence
  Primer
caaagcagagctcggtaatg

SEQ ID NO: 5170 - DNA, 20 bp, Artificial Sequence
  Primer
cagagtcttgtacatcggtg

SEQ ID NO: 5171 - DNA, 20 bp, Artificial Sequence
  Primer
ggaggtctgcatttctccat

SEQ ID NO: 5172 - DNA, 20 bp, Artificial Sequence
  Primer
gcttgtttgaggcttgcttg

SEQ ID NO: 5173 - DNA, 20 bp, Artificial Sequence
  Primer
ctacatcgtattcgagccct

SEQ ID NO: 5174 - DNA, 20 bp, Artificial Sequence
  Primer
ccacaggattggatggtgtt

SEQ ID NO: 5175 - DNA, 20 bp, Artificial Sequence
  Primer
ggatcctcgtgaggataaga

SEQ ID NO: 5176 - DNA, 20 bp, Artificial Sequence
  Primer
ttcgagatccagcacactgg

SEQ ID NO: 5177 - DNA, 20 bp, Artificial Sequence
  Primer
ggagtgggttgtaaggttgt

SEQ ID NO: 5178 - DNA, 20 bp, Artificial Sequence
  Primer
gaatggcattcggcagtctt

SEQ ID NO: 5179 - DNA, 20 bp, Artificial Sequence
  Primer
ggttgatggagaagacggtt

SEQ ID NO: 5180 - DNA, 20 bp, Artificial Sequence
  Primer
ggttggaaaagctgttggag

SEQ ID NO: 5181 - DNA, 20 bp, Artificial Sequence
  Primer
ggaacaacttcctgaaggag

SEQ ID NO: 5182 - DNA, 20 bp, Artificial Sequence
  Primer
gatgctagagccttaggaga

SEQ ID NO: 5183 - DNA, 20 bp, Artificial Sequence
  Primer
ggggtcgaagtctattttat

SEQ ID NO: 5184 - DNA, 20 bp, Artificial Sequence
  Primer
ctgttggagaatttcctgcg

SEQ ID NO: 5185 - DNA, 20 bp, Artificial Sequence
  Primer
caagtcagcggggaattttc

SEQ ID NO: 5186 - DNA, 20 bp, Artificial Sequence
  Primer
ctccatcaacaggagaggta

SEQ ID NO: 5187 - DNA, 20 bp, Artificial Sequence
  Primer
gcgtcccatccttacaacat

SEQ ID NO: 5188 - DNA, 20 bp, Artificial Sequence
  Primer
caagtcagcggggaattttc

SEQ ID NO: 5189 - DNA, 20 bp, Artificial Sequence
  Primer
gactgctctccaatattgcg

SEQ ID NO: 5190 - DNA, 20 bp, Artificial Sequence
  Primer
gcagattagcctaccacaca

SEQ ID NO: 5191 - DNA, 20 bp, Artificial Sequence
  Primer
gaacgctgtgctcttattgg

SEQ ID NO: 5192 - DNA, 20 bp, Artificial Sequence
  Primer
ctcttccccgtaacgatgtg

SEQ ID NO: 5193 - DNA, 20 bp, Artificial Sequence
  Primer
caacacctcgtaaggtgaca

SEQ ID NO: 5194 - DNA, 20 bp, Artificial Sequence
  Primer
gaacgctgtgctcttattgg

SEQ ID NO: 5195 - DNA, 20 bp, Artificial Sequence
  Primer
gtctcttaatccaccctgag

SEQ ID NO: 5196 - DNA, 20 bp, Artificial Sequence
  Primer
gcaccgatactcttcaggat

SEQ ID NO: 5197 - DNA, 20 bp, Artificial Sequence
  Primer
ccatcctgatacgcaagcaa

SEQ ID NO: 5198 - DNA, 20 bp, Artificial Sequence
  Primer
ctacgtaagctccttcttgg

SEQ ID NO: 5199 - DNA, 20 bp, Artificial Sequence
  Primer
cactggaggtattcgttgtg

SEQ ID NO: 5200 - DNA, 20 bp, Artificial Sequence
  Primer
cacggcaagtcatcggctat

SEQ ID NO: 5201 - DNA, 20 bp, Artificial Sequence
  Primer
cggatttcctagattctcag

SEQ ID NO: 5202 - DNA, 20 bp, Artificial Sequence
  Primer
cctcctccaaacaaccatcc

SEQ ID NO: 5203 - DNA, 20 bp, Artificial Sequence
  Primer
gcgcaacgtttccttgctta

SEQ ID NO: 5204 - DNA, 20 bp, Artificial Sequence
  Primer
gagtcttgtatcgctaccca

SEQ ID NO: 5205 - DNA, 20 bp, Artificial Sequence
  Primer
gcaaaagcgaggcttcaaag

SEQ ID NO: 5206 - DNA, 20 bp, Artificial Sequence
  Primer
ggaggcgtgatcgcctatgg

SEQ ID NO: 5207 - DNA, 20 bp, Artificial Sequence
  Primer
gattctgtctttgctctcgg

SEQ ID NO: 5208 - DNA, 20 bp, Artificial Sequence
  Primer
ccctagagttacagtgaagt

SEQ ID NO: 5209 - DNA, 20 bp, Artificial Sequence
  Primer
cgggagcggctctttctgat

SEQ ID NO: 5210 - DNA, 20 bp, Artificial Sequence
  Primer
cggatttcctagattctcag

SEQ ID NO: 5211 - DNA, 20 bp, Artificial Sequence
  Primer
ctttcctcatcactctcctc

SEQ ID NO: 5212 - DNA, 20 bp, Artificial Sequence
  Primer
gttgcataggctcagacagt

SEQ ID NO: 5213 - DNA, 20 bp, Artificial Sequence
  Primer
cccaggcaaagcaaaaagca

SEQ ID NO: 5214 - DNA, 20 bp, Artificial Sequence
  Primer
cgtaacatcccagtaagacg

SEQ ID NO: 5215 - DNA, 20 bp, Artificial Sequence
  Primer
caacagaccatagctggcta

SEQ ID NO: 5216 - DNA, 20 bp, Artificial Sequence
  Primer
ggaagactcttaccagcaca

SEQ ID NO: 5217 - DNA, 20 bp, Artificial Sequence
  Primer
ggtgtgggctcttaaaagac

SEQ ID NO: 5218 - DNA, 20 bp, Artificial Sequence
  Primer
catacaaccgacccatggtt

SEQ ID NO: 5219 - DNA, 20 bp, Artificial Sequence
  Primer
gtgcttcgagcgctttctta

SEQ ID NO: 5220 - DNA, 20 bp, Artificial Sequence
  Primer
cgtcgcgcagcgtataaatg

SEQ ID NO: 5221 - DNA, 20 bp, Artificial Sequence
  Primer
gaggatttcaacgctcctgc

SEQ ID NO: 5222 - DNA, 20 bp, Artificial Sequence
  Primer
tcggacgccttcgtggactc

SEQ ID NO: 5223 - DNA, 20 bp, Artificial Sequence
  Primer
gtagacacgagattcctttg

SEQ ID NO: 5224 - DNA, 20 bp, Artificial Sequence
  Primer
gcttgtatttcggctgggag

SEQ ID NO: 5225 - DNA, 20 bp, Artificial Sequence
  Primer
cacgaagtaaccatgttgcc

SEQ ID NO: 5226 - DNA, 20 bp, Artificial Sequence
  Primer
gccaactctctcaactctac

SEQ ID NO: 5227 - DNA, 20 bp, Artificial Sequence
  Primer
caggaggttgcccaatatag

SEQ ID NO: 5228 - DNA, 20 bp, Artificial Sequence
  Primer
cgtaatacagacgagacgag

SEQ ID NO: 5229 - DNA, 20 bp, Artificial Sequence
  Primer
ggttgatggtatagagagac

SEQ ID NO: 5230 - DNA, 20 bp, Artificial Sequence
  Primer
tgaccaacaagcctatgcgg

SEQ ID NO: 5231 - DNA, 20 bp, Artificial Sequence
  Primer
gaccttaagcctctgacaga

SEQ ID NO: 5232 - DNA, 20 bp, Artificial Sequence
  Primer
cgacctttacagagaccaag

SEQ ID NO: 5233 - DNA, 20 bp, Artificial Sequence
  Primer
ctaaagcgggttcaacctcc

SEQ ID NO: 5234 - DNA, 20 bp, Artificial Sequence
  Primer
atatcaatggctggccgtgc

SEQ ID NO: 5235 - DNA, 20 bp, Artificial Sequence
  Primer
gcccccatgaactcaaagaa

SEQ ID NO: 5236 - DNA, 20 bp, Artificial Sequence
  Primer
gggttcaacctccatagcat

SEQ ID NO: 5237 - DNA, 20 bp, Artificial Sequence
  Primer
cacaccgcttttattgtggg

SEQ ID NO: 5238 - DNA, 20 bp, Artificial Sequence
  Primer
gcccccatgaactcaaagaa

SEQ ID NO: 5239 - DNA, 20 bp, Artificial Sequence
  Primer
ccttctgcagagaagagagt

SEQ ID NO: 5240 - DNA, 20 bp, Artificial Sequence
  Primer
ccaatctgtaggtccagtta

SEQ ID NO: 5241 - DNA, 20 bp, Artificial Sequence
  Primer
gtttttgtgtcggtctctgg

SEQ ID NO: 5242 - DNA, 20 bp, Artificial Sequence
  Primer
gagctcgtgcaagtatgttc

SEQ ID NO: 5243 - DNA, 20 bp, Artificial Sequence
  Primer
cccagcggcggcacgcaact

SEQ ID NO: 5244 - DNA, 20 bp, Artificial Sequence
  Primer
cttgccccgcagcttaattt

SEQ ID NO: 5245 - DNA, 20 bp, Artificial Sequence
  Primer
gtcgccccaaaagcttttgt

SEQ ID NO: 5246 - DNA, 20 bp, Artificial Sequence
  Primer
gctcaaagctcagctctgtt

SEQ ID NO: 5247 - DNA, 20 bp, Artificial Sequence
  Primer
cttccgttgtctctacacga

SEQ ID NO: 5248 - DNA, 20 bp, Artificial Sequence
  Primer
tgttccgtcccgggttacct

SEQ ID NO: 5249 - DNA, 20 bp, Artificial Sequence
  Primer
gcttagctaacccttctagc

SEQ ID NO: 5250 - DNA, 20 bp, Artificial Sequence
  Primer
cccttgatccttagcaagag

SEQ ID NO: 5251 - DNA, 20 bp, Artificial Sequence
  Primer
gtccagccaaagccttttct

SEQ ID NO: 5252 - DNA, 20 bp, Artificial Sequence
  Primer
gcacaaggattattcgttgc

SEQ ID NO: 5253 - DNA, 20 bp, Artificial Sequence
  Primer
ggaagaaagtatcgccccaa

SEQ ID NO: 5254 - DNA, 20 bp, Artificial Sequence
  Primer
ggagatagctgcgtttcccc

SEQ ID NO: 5255 - DNA, 20 bp, Artificial Sequence
  Primer
gatgcgattacacgatccca

SEQ ID NO: 5256 - DNA, 20 bp, Artificial Sequence
  Primer
ccaaactccttcgccaaatg

SEQ ID NO: 5257 - DNA, 20 bp, Artificial Sequence
  Primer
ctggagtaactcctagagca

SEQ ID NO: 5258 - DNA, 20 bp, Artificial Sequence
  Primer
cattgtggtggatgcatcct

SEQ ID NO: 5259 - DNA, 20 bp, Artificial Sequence
  Primer
ttgagaagggcatcccctgc

SEQ ID NO: 5260 - DNA, 20 bp, Artificial Sequence
  Primer
caatccctgcagaaggaatc

SEQ ID NO: 5261 - DNA, 20 bp, Artificial Sequence
  Primer
gcgaaactcttcttgggatg

SEQ ID NO: 5262 - DNA, 20 bp, Artificial Sequence
  Primer
ggtaaccgttctcttcatcc

SEQ ID NO: 5263 - DNA, 20 bp, Artificial Sequence
  Primer
agcttccgagggctctttta

SEQ ID NO: 5264 - DNA, 20 bp, Artificial Sequence
  Primer
cgcacagtagccaaatatcg

SEQ ID NO: 5265 - DNA, 20 bp, Artificial Sequence
  Primer
gagcgaaccattagcctgaa

SEQ ID NO: 5266 - DNA, 20 bp, Artificial Sequence
  Primer
cctgtagtctttctggtagg

SEQ ID NO: 5267 - DNA, 20 bp, Artificial Sequence
  Primer
gtactccgcaaagcagcaaa

SEQ ID NO: 5268 - DNA, 20 bp, Artificial Sequence
  Primer
ccggctcgatcctaaacaaa

SEQ ID NO: 5269 - DNA, 20 bp, Artificial Sequence
  Primer
ggatctctctttgacaaggg

SEQ ID NO: 5270 - DNA, 20 bp, Artificial Sequence
  Primer
gcctgcccttctccatgata

SEQ ID NO: 5271 - DNA, 20 bp, Artificial Sequence
  Primer
ctcgcagatgcttttacgac

SEQ ID NO: 5272 - DNA, 20 bp, Artificial Sequence
  Primer
cggggaaagagagtctctaa

SEQ ID NO: 5273 - DNA, 20 bp, Artificial Sequence
  Primer
gttcgtaacggccatgtgat

SEQ ID NO: 5274 - DNA, 20 bp, Artificial Sequence
  Primer
gcgtcgctttaatttctcct

SEQ ID NO: 5275 - DNA, 20 bp, Artificial Sequence
  Primer
cgtaagactgcctgtaaacc

SEQ ID NO: 5276 - DNA, 20 bp, Artificial Sequence
  Primer
cactgagcttacaaacccct

SEQ ID NO: 5277 - DNA, 20 bp, Artificial Sequence
  Primer
gacagggaaaaccctctcta

SEQ ID NO: 5278 - DNA, 20 bp, Artificial Sequence
  Primer
ccgcgtatcctggacattgt

SEQ ID NO: 5279 - DNA, 20 bp, Artificial Sequence
  Primer
caatgtcgtcaacggagcaa

SEQ ID NO: 5280 - DNA, 20 bp, Artificial Sequence
  Primer
ggagcctgtcttccaactaa

SEQ ID NO: 5281 - DNA, 20 bp, Artificial Sequence
  Primer
acctcacgattcttgcaagc

SEQ ID NO: 5282 - DNA, 20 bp, Artificial Sequence
  Primer
gtgcaagctattatgcaggg

SEQ ID NO: 5283 - DNA, 20 bp, Artificial Sequence
  Primer
ggagcaattggcacaccaaa

SEQ ID NO: 5284 - DNA, 20 bp, Artificial Sequence
  Primer
tggtgaaaccccggaacata

SEQ ID NO: 5285 - DNA, 20 bp, Artificial Sequence
  Primer
gctgcagatcgcatccattt

SEQ ID NO: 5286 - DNA, 20 bp, Artificial Sequence
  Primer
tcgtcgtgcgaatgctgtaa

SEQ ID NO: 5287 - DNA, 20 bp, Artificial Sequence
  Primer
cctttccctggagaggttcg

SEQ ID NO: 5288 - DNA, 20 bp, Artificial Sequence
  Primer
catggtctccggatggtaaa

SEQ ID NO: 5289 - DNA, 20 bp, Artificial Sequence
  Primer
caagagtctcagcaagctga

SEQ ID NO: 5290 - DNA, 20 bp, Artificial Sequence
  Primer
aatactctgaaccagcctgc

SEQ ID NO: 5291 - DNA, 20 bp, Artificial Sequence
  Primer
ggcttagcaacagcattagg

SEQ ID NO: 5292 - DNA, 20 bp, Artificial Sequence
  Primer
gcaagatgccttctgtgctt

SEQ ID NO: 5293 - DNA, 20 bp, Artificial Sequence
  Primer
gctctccttctggaatagca

SEQ ID NO: 5294 - DNA, 20 bp, Artificial Sequence
  Primer
catgatcgccatgcctctta

SEQ ID NO: 5295 - DNA, 20 bp, Artificial Sequence
  Primer
ggtgatctgccgccgattta

SEQ ID NO: 5296 - DNA, 20 bp, Artificial Sequence
  Primer
gaccgtttgggggattctat

SEQ ID NO: 5297 - DNA, 20 bp, Artificial Sequence
  Primer
gggtagtcaacatcccattg

SEQ ID NO: 5298 - DNA, 20 bp, Artificial Sequence
  Primer
ggcgtagctcttccactatt

SEQ ID NO: 5299 - DNA, 20 bp, Artificial Sequence
  Primer
acactggctcggcctaaacg

SEQ ID NO: 5300 - DNA, 20 bp, Artificial Sequence
  Primer
agagagaaacccccagctca

SEQ ID NO: 5301 - DNA, 20 bp, Artificial Sequence
  Primer
ggagcgtctgtttccactaa

SEQ ID NO: 5302 - DNA, 20 bp, Artificial Sequence
  Primer
ggataggcttctgcataagc

SEQ ID NO: 5303 - DNA, 20 bp, Artificial Sequence
  Primer
caggaggctgatctgctaaa

SEQ ID NO: 5304 - DNA, 20 bp, Artificial Sequence
  Primer
cacatcccgatacggaatga

SEQ ID NO: 5305 - DNA, 20 bp, Artificial Sequence
  Primer
catagaatagtgcaccgcag

SEQ ID NO: 5306 - DNA, 20 bp, Artificial Sequence
  Primer
cccctccttttatcgtatcg

SEQ ID NO: 5307 - DNA, 20 bp, Artificial Sequence
  Primer
cagtgcaagcttgtcttgga

SEQ ID NO: 5308 - DNA, 20 bp, Artificial Sequence
  Primer
cgagagatctcttgctcttg

SEQ ID NO: 5309 - DNA, 20 bp, Artificial Sequence
  Primer
gttgcgaaacaagatccgac

SEQ ID NO: 5310 - DNA, 20 bp, Artificial Sequence
  Primer
ctgcacaagagccacaaacc

SEQ ID NO: 5311 - DNA, 20 bp, Artificial Sequence
  Primer
cgcatccgactttccacata

SEQ ID NO: 5312 - DNA, 20 bp, Artificial Sequence
  Primer
cgagacatgacgaagaaagg

SEQ ID NO: 5313 - DNA, 20 bp, Artificial Sequence
  Primer
ggatccgcaggcaatttttc

SEQ ID NO: 5314 - DNA, 20 bp, Artificial Sequence
  Primer
cagcgctaacgtattccgaa

SEQ ID NO: 5315 - DNA, 20 bp, Artificial Sequence
  Primer
ctgaaagaaacgcgagctct

SEQ ID NO: 5316 - DNA, 20 bp, Artificial Sequence
  Primer
caacgtattgagaccggaga

SEQ ID NO: 5317 - DNA, 20 bp, Artificial Sequence
  Primer
gcatggagagatgtttggag

SEQ ID NO: 5318 - DNA, 20 bp, Artificial Sequence
  Primer
cgcatctgctaacgttgcta

SEQ ID NO: 5319 - DNA, 20 bp, Artificial Sequence
  Primer
caaacgcagatcgatggagc

SEQ ID NO: 5320 - DNA, 20 bp, Artificial Sequence
  Primer
ccgaagaagccatccaatct

SEQ ID NO: 5321 - DNA, 20 bp, Artificial Sequence
  Primer
ccccctttgcttgaggattt

SEQ ID NO: 5322 - DNA, 20 bp, Artificial Sequence
  Primer
acagggtctctttcccgttc

SEQ ID NO: 5323 - DNA, 20 bp, Artificial Sequence
  Primer
ctgcatatctgcactcagga

SEQ ID NO: 5324 - DNA, 20 bp, Artificial Sequence
  Primer
ccgattactaaagaagctgg

SEQ ID NO: 5325 - DNA, 20 bp, Artificial Sequence
  Primer
atggaagaggtgcatgacca

SEQ ID NO: 5326 - DNA, 20 bp, Artificial Sequence
  Primer
ctcgctatcgtcaaggatgc

SEQ ID NO: 5327 - DNA, 20 bp, Artificial Sequence
  Primer
cagctcttccagacactctt

SEQ ID NO: 5328 - DNA, 20 bp, Artificial Sequence
  Primer
cctgccatctcatccgccac

SEQ ID NO: 5329 - DNA, 20 bp, Artificial Sequence
  Primer
ggcacagcaaaaacctctac

SEQ ID NO: 5330 - DNA, 20 bp, Artificial Sequence
  Primer
gagaaggctcgcaagagaaa

SEQ ID NO: 5331 - DNA, 20 bp, Artificial Sequence
  Primer
cgtgcccaagaattggcaaa

SEQ ID NO: 5332 - DNA, 20 bp, Artificial Sequence
  Primer
atcgcgacaccctctcaata

SEQ ID NO: 5333 - DNA, 20 bp, Artificial Sequence
  Primer
ctggctgcatgctgtactat

SEQ ID NO: 5334 - DNA, 20 bp, Artificial Sequence
  Primer
cttttcacacatcctcgcca

SEQ ID NO: 5335 - DNA, 20 bp, Artificial Sequence
  Primer
cggcgatggatcttgcaaat

SEQ ID NO: 5336 - DNA, 20 bp, Artificial Sequence
  Primer
gaaccgtgtcgcacggatct

SEQ ID NO: 5337 - DNA, 20 bp, Artificial Sequence
  Primer
gtcttcgtccttccaacaac

SEQ ID NO: 5338 - DNA, 20 bp, Artificial Sequence
  Primer
tccccactcagctacatctt

SEQ ID NO: 5339 - DNA, 20 bp, Artificial Sequence
  Primer
ccgccgcagcttaactatta

SEQ ID NO: 5340 - DNA, 20 bp, Artificial Sequence
  Primer
gcagaggagctcaaatctct

SEQ ID NO: 5341 - DNA, 20 bp, Artificial Sequence
  Primer
ggttaccgtggctattactg

SEQ ID NO: 5342 - DNA, 20 bp, Artificial Sequence
  Primer
gggggaagtaaaaaggctac

SEQ ID NO: 5343 - DNA, 20 bp, Artificial Sequence
  Primer
cagcggaatgttagactctc

SEQ ID NO: 5344 - DNA, 20 bp, Artificial Sequence
  Primer
gcagaaagaactggcccaaa

SEQ ID NO: 5345 - DNA, 20 bp, Artificial Sequence
  Primer
gaagctaaaccaacccgaag

SEQ ID NO: 5346 - DNA, 20 bp, Artificial Sequence
  Primer
cctttagcgcagatgttctc

SEQ ID NO: 5347 - DNA, 20 bp, Artificial Sequence
  Primer
atgctggttaggagagccta

SEQ ID NO: 5348 - DNA, 20 bp, Artificial Sequence
  Primer
ccaacccgaagaatctcaag

SEQ ID NO: 5349 - DNA, 20 bp, Artificial Sequence
  Primer
ctgcgagaaagtaggacaag

SEQ ID NO: 5350 - DNA, 20 bp, Artificial Sequence
  Primer
cacaaagcatctccgctatg

SEQ ID NO: 5351 - DNA, 20 bp, Artificial Sequence
  Primer
cctggatacgagcatagaga

SEQ ID NO: 5352 - DNA, 20 bp, Artificial Sequence
  Primer
ctccttcttgagctagcgca

SEQ ID NO: 5353 - DNA, 20 bp, Artificial Sequence
  Primer
ctcgcattcccccaatttcc

SEQ ID NO: 5354 - DNA, 20 bp, Artificial Sequence
  Primer
cctggatacgagcatagaga

SEQ ID NO: 5355 - DNA, 20 bp, Artificial Sequence
  Primer
ccttcaccaactctgcgatt

SEQ ID NO: 5356 - DNA, 20 bp, Artificial Sequence
  Primer
gctgtaagaggagagcatac

SEQ ID NO: 5357 - DNA, 20 bp, Artificial Sequence
  Primer
gctgacagctccaaataacc

SEQ ID NO: 5358 - DNA, 20 bp, Artificial Sequence
  Primer
gaacggagagacaaagcttc

SEQ ID NO: 5359 - DNA, 20 bp, Artificial Sequence
  Primer
cagccaggaaagcacattct

SEQ ID NO: 5360 - DNA, 20 bp, Artificial Sequence
  Primer
cttctttagggaccactagc

SEQ ID NO: 5361 - DNA, 20 bp, Artificial Sequence
  Primer
cacctcatccaaagcctcta

SEQ ID NO: 5362 - DNA, 20 bp, Artificial Sequence
  Primer
ctttcccgtccttatcgcta

SEQ ID NO: 5363 - DNA, 20 bp, Artificial Sequence
  Primer
cctattcctcccagcaaaac

SEQ ID NO: 5364 - DNA, 20 bp, Artificial Sequence
  Primer
ccagttctactccatgctct

SEQ ID NO: 5365 - DNA, 20 bp, Artificial Sequence
  Primer
tacaccccaacaagctctcc

SEQ ID NO: 5366 - DNA, 20 bp, Artificial Sequence
  Primer
ggagatccccgatcgtaata

SEQ ID NO: 5367 - DNA, 20 bp, Artificial Sequence
  Primer
atccatatcctccgtgtcca

SEQ ID NO: 5368 - DNA, 20 bp, Artificial Sequence
  Primer
gccaaggctccaccaataat

SEQ ID NO: 5369 - DNA, 20 bp, Artificial Sequence
  Primer
gaataacgggatctgtgaac

SEQ ID NO: 5370 - DNA, 20 bp, Artificial Sequence
  Primer
cgcttgttaacggaagaagg

SEQ ID NO: 5371 - DNA, 20 bp, Artificial Sequence
  Primer
ggtttctttttcgggggggc

SEQ ID NO: 5372 - DNA, 20 bp, Artificial Sequence
  Primer
ggagagagcttctctatcca

SEQ ID NO: 5373 - DNA, 20 bp, Artificial Sequence
  Primer
cgacctttggatttgtgtgc

SEQ ID NO: 5374 - DNA, 20 bp, Artificial Sequence
  Primer
cgtacgaggctctgcttttt

SEQ ID NO: 5375 - DNA, 20 bp, Artificial Sequence
  Primer
accaaccagcaagggataca

SEQ ID NO: 5376 - DNA, 20 bp, Artificial Sequence
  Primer
cttcgcaagcatgtcgagat

SEQ ID NO: 5377 - DNA, 20 bp, Artificial Sequence
  Primer
cctctgcgatccttccttat

SEQ ID NO: 5378 - DNA, 20 bp, Artificial Sequence
  Primer
cctatgctgatgcttgcaac

SEQ ID NO: 5379 - DNA, 20 bp, Artificial Sequence
  Primer
ctcactgctattacactccc

SEQ ID NO: 5380 - DNA, 20 bp, Artificial Sequence
  Primer
cgccaacaattaacgccttc

SEQ ID NO: 5381 - DNA, 20 bp, Artificial Sequence
  Primer
ggcctttttagcctcttggg

SEQ ID NO: 5382 - DNA, 20 bp, Artificial Sequence
  Primer
cgaacaacatcgtcctgagt

SEQ ID NO: 5383 - DNA, 20 bp, Artificial Sequence
  Primer
ggactctccgatgaaatgga

SEQ ID NO: 5384 - DNA, 20 bp, Artificial Sequence
  Primer
cctcacgcagaataaacgga

SEQ ID NO: 5385 - DNA, 20 bp, Artificial Sequence
  Primer
gtagtcagtgaccgagcttc

SEQ ID NO: 5386 - DNA, 20 bp, Artificial Sequence
  Primer
gagagcgcttagaacactgt

SEQ ID NO: 5387 - DNA, 20 bp, Artificial Sequence
  Primer
ctcttcgctacttccgaaca

SEQ ID NO: 5388 - DNA, 20 bp, Artificial Sequence
  Primer
gctactctgggtcatttgga

SEQ ID NO: 5389 - DNA, 20 bp, Artificial Sequence
  Primer
gcctcatcactgatttccga

SEQ ID NO: 5390 - DNA, 20 bp, Artificial Sequence
  Primer
ggagagtcgttaggactctt

SEQ ID NO: 5391 - DNA, 20 bp, Artificial Sequence
  Primer
gcgatggacttaatggtctc

SEQ ID NO: 5392 - DNA, 20 bp, Artificial Sequence
  Primer
cagccattatcagccatgag

SEQ ID NO: 5393 - DNA, 20 bp, Artificial Sequence
  Primer
ggaagccataaaaaggccca

SEQ ID NO: 5394 - DNA, 20 bp, Artificial Sequence
  Primer
cgcgatggacttaatggtct

SEQ ID NO: 5395 - DNA, 20 bp, Artificial Sequence
  Primer
cgactctcaccagaacaatc

SEQ ID NO: 5396 - DNA, 20 bp, Artificial Sequence
  Primer
gctctctccctgagcattcg

SEQ ID NO: 5397 - DNA, 20 bp, Artificial Sequence
  Primer
gccgcattgggaacatgtat

SEQ ID NO: 5398 - DNA, 20 bp, Artificial Sequence
  Primer
cctctcttacaaagacgaac

SEQ ID NO: 5399 - DNA, 20 bp, Artificial Sequence
  Primer
gcagccttacaaatgctctg

SEQ ID NO: 5400 - DNA, 20 bp, Artificial Sequence
  Primer
gggatttccgccatgtgaaa

SEQ ID NO: 5401 - DNA, 20 bp, Artificial Sequence
  Primer
cgcagagggctctttgaaat

SEQ ID NO: 5402 - DNA, 20 bp, Artificial Sequence
  Primer
ccaaggatggaaatgcgtga

SEQ ID NO: 5403 - DNA, 20 bp, Artificial Sequence
  Primer
gacagctccggtagcacaag

SEQ ID NO: 5404 - DNA, 20 bp, Artificial Sequence
  Primer
ccaggagacctatgattcct

SEQ ID NO: 5405 - DNA, 20 bp, Artificial Sequence
  Primer
gcaggttccatgcgtacttt

SEQ ID NO: 5406 - DNA, 20 bp, Artificial Sequence
  Primer
cgtttccttccagaaacctc

SEQ ID NO: 5407 - DNA, 20 bp, Artificial Sequence
  Primer
ggtaccaaccacacagcaaa

SEQ ID NO: 5408 - DNA, 20 bp, Artificial Sequence
  Primer
ggtaccaaccacacagcaaa

SEQ ID NO: 5409 - DNA, 20 bp, Artificial Sequence
  Primer
gagctcgccgatacagaata

SEQ ID NO: 5410 - DNA, 20 bp, Artificial Sequence
  Primer
cacagaaactccagatgctc

SEQ ID NO: 5411 - DNA, 20 bp, Artificial Sequence
  Primer
gggatcttatcccaaaacac

SEQ ID NO: 5412 - DNA, 20 bp, Artificial Sequence
  Primer
gctagagcttgcttgtgaag

SEQ ID NO: 5413 - DNA, 20 bp, Artificial Sequence
  Primer
cgagttcgattccgtaatcc

SEQ ID NO: 5414 - DNA, 20 bp, Artificial Sequence
  Primer
cactccccaaaaacctgatg

SEQ ID NO: 5415 - DNA, 20 bp, Artificial Sequence
  Primer
ccataccagctaaaacctgc

SEQ ID NO: 5416 - DNA, 20 bp, Artificial Sequence
  Primer
caaccggacgcttttatgag

SEQ ID NO: 5417 - DNA, 20 bp, Artificial Sequence
  Primer
ggagctactccaccttcatt

SEQ ID NO: 5418 - DNA, 20 bp, Artificial Sequence
  Primer
gcataagcgctcattacctg

SEQ ID NO: 5419 - DNA, 20 bp, Artificial Sequence
  Primer
tgcaggaacctttgactgct

SEQ ID NO: 5420 - DNA, 20 bp, Artificial Sequence
  Primer
tgagatgctcccctctttgg

SEQ ID NO: 5421 - DNA, 20 bp, Artificial Sequence
  Primer
aaaccctaaccggcattcac

SEQ ID NO: 5422 - DNA, 20 bp, Artificial Sequence
  Primer
gcagctgcagaattgtctca

SEQ ID NO: 5423 - DNA, 20 bp, Artificial Sequence
  Primer
ctcgtaacgaaacatgggca

SEQ ID NO: 5424 - DNA, 20 bp, Artificial Sequence
  Primer
cctcacccctactccctctc

SEQ ID NO: 5425 - DNA, 20 bp, Artificial Sequence
  Primer
gtcggcacattaatctgtcc

SEQ ID NO: 5426 - DNA, 20 bp, Artificial Sequence
  Primer
gcacaaacaagtccttccac

SEQ ID NO: 5427 - DNA, 20 bp, Artificial Sequence
  Primer
ggagcactctgtccatctat

SEQ ID NO: 5428 - DNA, 20 bp, Artificial Sequence
  Primer
ttacggtaacgatgcaccca

SEQ ID NO: 5429 - DNA, 20 bp, Artificial Sequence
  Primer
ccatgcttttctccgtagcc

SEQ ID NO: 5430 - DNA, 20 bp, Artificial Sequence
  Primer
tgcgaaccgcctccgttatc

SEQ ID NO: 5431 - DNA, 20 bp, Artificial Sequence
  Primer
aagcccttcgtactaagggc

SEQ ID NO: 5432 - DNA, 20 bp, Artificial Sequence
  Primer
gcacccctaaaagagcttct

SEQ ID NO: 5433 - DNA, 20 bp, Artificial Sequence
  Primer
gcgatcttttcctcctctaa

SEQ ID NO: 5434 - DNA, 20 bp, Artificial Sequence
  Primer
cttcctcacgtcactatcct

SEQ ID NO: 5435 - DNA, 20 bp, Artificial Sequence
  Primer
cttctggccattcgacacaa

SEQ ID NO: 5436 - DNA, 20 bp, Artificial Sequence
  Primer
tatactggcctctcatgcag

SEQ ID NO: 5437 - DNA, 20 bp, Artificial Sequence
  Primer
gcccgacgatatgatctctt

SEQ ID NO: 5438 - DNA, 20 bp, Artificial Sequence
  Primer
caaactctgcgcccacctgc

SEQ ID NO: 5439 - DNA, 20 bp, Artificial Sequence
  Primer
gtggcgagataagaaagcag

SEQ ID NO: 5440 - DNA, 20 bp, Artificial Sequence
  Primer
ggcttatcccttaacatggc

SEQ ID NO: 5441 - DNA, 20 bp, Artificial Sequence
  Primer
ggctgcacgatggcaactcg

SEQ ID NO: 5442 - DNA, 20 bp, Artificial Sequence
  Primer
ccaccctttatacttcccta

SEQ ID NO: 5443 - DNA, 20 bp, Artificial Sequence
  Primer
cacctccaggaacaagaatc

SEQ ID NO: 5444 - DNA, 20 bp, Artificial Sequence
  Primer
gctcatcaatagcccaccaa

SEQ ID NO: 5445 - DNA, 20 bp, Artificial Sequence
  Primer
gggaagtatgccgacaattc

SEQ ID NO: 5446 - DNA, 20 bp, Artificial Sequence
  Primer
cttcgacagtccaagtccaa

SEQ ID NO: 5447 - DNA, 20 bp, Artificial Sequence
  Primer
acctgagcactaccatcacc

SEQ ID NO: 5448 - DNA, 20 bp, Artificial Sequence
  Primer
gcgcacaacgtcaaccataa

SEQ ID NO: 5449 - DNA, 20 bp, Artificial Sequence
  Primer
acaggctcatcagggaaacg

SEQ ID NO: 5450 - DNA, 20 bp, Artificial Sequence
  Primer
gacgagagaaaatacgcctg

SEQ ID NO: 5451 - DNA, 20 bp, Artificial Sequence
  Primer
cgctctccaaagaggcttgg

SEQ ID NO: 5452 - DNA, 20 bp, Artificial Sequence
  Primer
gttatgcgaatagtgcaggg

SEQ ID NO: 5453 - DNA, 20 bp, Artificial Sequence
  Primer
gcctgccattctcgtaattg

SEQ ID NO: 5454 - DNA, 20 bp, Artificial Sequence
  Primer
gcagcttgagccaaagcttc

SEQ ID NO: 5455 - DNA, 20 bp, Artificial Sequence
  Primer
ccagaaactccaaggacttc

SEQ ID NO: 5456 - DNA, 20 bp, Artificial Sequence
  Primer
gatcttgcggcttatttccg

SEQ ID NO: 5457 - DNA, 20 bp, Artificial Sequence
  Primer
gcctccagcttgttccaaaa

SEQ ID NO: 5458 - DNA, 20 bp, Artificial Sequence
  Primer
ggatccgtagtcttaatggg

SEQ ID NO: 5459 - DNA, 20 bp, Artificial Sequence
  Primer
gagcttccttggaagaaaac

SEQ ID NO: 5460 - DNA, 20 bp, Artificial Sequence
  Primer
gatcagcaaatcctctccag

SEQ ID NO: 5461 - DNA, 20 bp, Artificial Sequence
  Primer
cagcctcttctgaaacgaca

SEQ ID NO: 5462 - DNA, 20 bp, Artificial Sequence
  Primer
gccattttattgctgggctg

SEQ ID NO: 5463 - DNA, 20 bp, Artificial Sequence
  Primer
cgcttcacaacaacaacgga

SEQ ID NO: 5464 - DNA, 20 bp, Artificial Sequence
  Primer
gataaagaaaacgcggctcc

SEQ ID NO: 5465 - DNA, 20 bp, Artificial Sequence
  Primer
ccttgagtagtaagctcatc

SEQ ID NO: 5466 - DNA, 20 bp, Artificial Sequence
  Primer
cgctaagaaatcccacacca

SEQ ID NO: 5467 - DNA, 20 bp, Artificial Sequence
  Primer
cgggagttactggcttaaac

SEQ ID NO: 5468 - DNA, 20 bp, Artificial Sequence
  Primer
ccccgtccctttttgtctaa

SEQ ID NO: 5469 - DNA, 20 bp, Artificial Sequence
  Primer
cccaacttgtgtccaaccat

SEQ ID NO: 5470 - DNA, 20 bp, Artificial Sequence
  Primer
cggcctcggaatattcttgt

SEQ ID NO: 5471 - DNA, 20 bp, Artificial Sequence
  Primer
agtctacttcagcccctttc

SEQ ID NO: 5472 - DNA, 20 bp, Artificial Sequence
  Primer
cgatggcggcaggaaatatg

SEQ ID NO: 5473 - DNA, 20 bp, Artificial Sequence
  Primer
cggccttcttttcaccaaga

SEQ ID NO: 5474 - DNA, 20 bp, Artificial Sequence
  Primer
cccaacttgtgtccaaccat

SEQ ID NO: 5475 - DNA, 20 bp, Artificial Sequence
  Primer
cgtctcttggattcgaacag

SEQ ID NO: 5476 - DNA, 20 bp, Artificial Sequence
  Primer
ggcatcaacccgaacttcta

SEQ ID NO: 5477 - DNA, 20 bp, Artificial Sequence
  Primer
caacatcccccttctttacg

SEQ ID NO: 5478 - DNA, 20 bp, Artificial Sequence
  Primer
ccaggtctagcagtatggat

SEQ ID NO: 5479 - DNA, 20 bp, Artificial Sequence
  Primer
cgcttccctttaggattctc

SEQ ID NO: 5480 - DNA, 20 bp, Artificial Sequence
  Primer
ccattcgagtttcagcaggt

SEQ ID NO: 5481 - DNA, 20 bp, Artificial Sequence
  Primer
ggtttgtgctgtagttaccc

SEQ ID NO: 5482 - DNA, 20 bp, Artificial Sequence
  Primer
ctagccatggactctatcct

SEQ ID NO: 5483 - DNA, 20 bp, Artificial Sequence
  Primer
ccttgctacagagccttcta

SEQ ID NO: 5484 - DNA, 20 bp, Artificial Sequence
  Primer
ccgccatctcttcgttttag

SEQ ID NO: 5485 - DNA, 20 bp, Artificial Sequence
  Primer
caggagcaacaaacacctca

SEQ ID NO: 5486 - DNA, 20 bp, Artificial Sequence
  Primer
cgtttcgagtccgtacgatt

SEQ ID NO: 5487 - DNA, 20 bp, Artificial Sequence
  Primer
caagccgcaaattctccaac

SEQ ID NO: 5488 - DNA, 20 bp, Artificial Sequence
  Primer
gtctagcaggctgattatcg

SEQ ID NO: 5489 - DNA, 20 bp, Artificial Sequence
  Primer
ggcctttccctaattcagca

SEQ ID NO: 5490 - DNA, 20 bp, Artificial Sequence
  Primer
cttgaagcctgcgatagagt

SEQ ID NO: 5491 - DNA, 20 bp, Artificial Sequence
  Primer
cgttagctttcgcaaatccg

SEQ ID NO: 5492 - DNA, 20 bp, Artificial Sequence
  Primer
cgtaccgcaaaaagactctc

SEQ ID NO: 5493 - DNA, 20 bp, Artificial Sequence
  Primer
gatacttctgcgccattgtc

SEQ ID NO: 5494 - DNA, 20 bp, Artificial Sequence
  Primer
gaccaggtctgtctacaacg

SEQ ID NO: 5495 - DNA, 20 bp, Artificial Sequence
  Primer
cccccagaaaaaatgtcagc

SEQ ID NO: 5496 - DNA, 20 bp, Artificial Sequence
  Primer
ccaaagctttggcattatcc

SEQ ID NO: 5497 - DNA, 20 bp, Artificial Sequence
  Primer
gtgcatgctgaacaggaatc

SEQ ID NO: 5498 - DNA, 20 bp, Artificial Sequence
  Primer
gcatccccacctttacggat

SEQ ID NO: 5499 - DNA, 20 bp, Artificial Sequence
  Primer
gctcctagcaaagttaccct

SEQ ID NO: 5500 - DNA, 20 bp, Artificial Sequence
  Primer
gatacttctgcgccattgtc

SEQ ID NO: 5501 - DNA, 20 bp, Artificial Sequence
  Primer
ccacgaacaggcaaagaaag

SEQ ID NO: 5502 - DNA, 20 bp, Artificial Sequence
  Primer
cccccagaaaaaatgtcagc

SEQ ID NO: 5503 - DNA, 20 bp, Artificial Sequence
  Primer
gcaccagttccttttaagcc

SEQ ID NO: 5504 - DNA, 20 bp, Artificial Sequence
  Primer
accaacctcttcctcagtca

SEQ ID NO: 5505 - DNA, 20 bp, Artificial Sequence
  Primer
gcaactctttggctttaggc

SEQ ID NO: 5506 - DNA, 20 bp, Artificial Sequence
  Primer
gtcgcagcaaatgctgaaga

SEQ ID NO: 5507 - DNA, 20 bp, Artificial Sequence
  Primer
gctacaacttctatgggaga

SEQ ID NO: 5508 - DNA, 20 bp, Artificial Sequence
  Primer
gcaggagcttccaagccgat

SEQ ID NO: 5509 - DNA, 20 bp, Artificial Sequence
  Primer
agaactttggccaaaggagc

SEQ ID NO: 5510 - DNA, 20 bp, Artificial Sequence
  Primer
cgattctcttctcgtccatt

SEQ ID NO: 5511 - DNA, 20 bp, Artificial Sequence
  Primer
ctctatgactggatctcttg

SEQ ID NO: 5512 - DNA, 20 bp, Artificial Sequence
  Primer
acgccctacagctaatcttc

SEQ ID NO: 5513 - DNA, 20 bp, Artificial Sequence
  Primer
cgagtaggaggaggaatcaa

SEQ ID NO: 5514 - DNA, 20 bp, Artificial Sequence
  Primer
cccggatttccatcacttca

SEQ ID NO: 5515 - DNA, 20 bp, Artificial Sequence
  Primer
catcctgtaaagatgccgct

SEQ ID NO: 5516 - DNA, 20 bp, Artificial Sequence
  Primer
cgagtaggaggaggaatcaa

SEQ ID NO: 5517 - DNA, 20 bp, Artificial Sequence
  Primer
gctcagtttcacgaatgacg

SEQ ID NO: 5518 - DNA, 20 bp, Artificial Sequence
  Primer
cgggccaaagcccaagggat

SEQ ID NO: 5519 - DNA, 20 bp, Artificial Sequence
  Primer
gcgaaaggatccctgatttc

SEQ ID NO: 5520 - DNA, 20 bp, Artificial Sequence
  Primer
cggccttcgctgacttccat

SEQ ID NO: 5521 - DNA, 20 bp, Artificial Sequence
  Primer
ggggcttgcacaatctcaaa

SEQ ID NO: 5522 - DNA, 20 bp, Artificial Sequence
  Primer
gagagagcttaacctttcca

SEQ ID NO: 5523 - DNA, 20 bp, Artificial Sequence
  Primer
cgatgggttcatcacacaac

SEQ ID NO: 5524 - DNA, 20 bp, Artificial Sequence
  Primer
cgcgagagctaaaaccgtat

SEQ ID NO: 5525 - DNA, 20 bp, Artificial Sequence
  Primer
cgtagtatggagagatccga

SEQ ID NO: 5526 - DNA, 20 bp, Artificial Sequence
  Primer
cccctatatgagccttgcct

SEQ ID NO: 5527 - DNA, 20 bp, Artificial Sequence
  Primer
ccctgcctatgccatagaat

SEQ ID NO: 5528 - DNA, 20 bp, Artificial Sequence
  Primer
aaaacacccccctctgcacg

SEQ ID NO: 5529 - DNA, 20 bp, Artificial Sequence
  Primer
ctcgtctgttagcctcatct

SEQ ID NO: 5530 - DNA, 20 bp, Artificial Sequence
  Primer
gctaccttcctactcctgaa

SEQ ID NO: 5531 - DNA, 20 bp, Artificial Sequence
  Primer
gcctatctagggaaaaccgt

SEQ ID NO: 5532 - DNA, 20 bp, Artificial Sequence
  Primer
cgcttctttggagatggaga

SEQ ID NO: 5533 - DNA, 20 bp, Artificial Sequence
  Primer
gctgtgagttccctggataa

SEQ ID NO: 5534 - DNA, 20 bp, Artificial Sequence
  Primer
aaagccggcgatacactttg

SEQ ID NO: 5535 - DNA, 20 bp, Artificial Sequence
  Primer
ctccaaaagcaagcagagag

SEQ ID NO: 5536 - DNA, 20 bp, Artificial Sequence
  Primer
gtacgcgtccttagcaggga

SEQ ID NO: 5537 - DNA, 20 bp, Artificial Sequence
  Primer
gagcgtcgtaatcctactca

SEQ ID NO: 5538 - DNA, 20 bp, Artificial Sequence
  Primer
ggaagacatacactccttcc

SEQ ID NO: 5539 - DNA, 20 bp, Artificial Sequence
  Primer
gagcgttggggaaattgaca

SEQ ID NO: 5540 - DNA, 20 bp, Artificial Sequence
  Primer
ggcagctcctatcacaccta

SEQ ID NO: 5541 - DNA, 20 bp, Artificial Sequence
  Primer
atgctccccagtataagccg

SEQ ID NO: 5542 - DNA, 20 bp, Artificial Sequence
  Primer
ctcttgacggctctgcttat

SEQ ID NO: 5543 - DNA, 20 bp, Artificial Sequence
  Primer
gctgtccatacactaagcca

SEQ ID NO: 5544 - DNA, 20 bp, Artificial Sequence
  Primer
gacacacttccggatgcaaa

SEQ ID NO: 5545 - DNA, 20 bp, Artificial Sequence
  Primer
ctcagatgaagtagcggaac

SEQ ID NO: 5546 - DNA, 20 bp, Artificial Sequence
  Primer
gcgatttcgtcagagaacct

SEQ ID NO: 5547 - DNA, 20 bp, Artificial Sequence
  Primer
cctgcatgactccatggtaa

SEQ ID NO: 5548 - DNA, 20 bp, Artificial Sequence
  Primer
ccagggtggtacaacaattc

SEQ ID NO: 5549 - DNA, 20 bp, Artificial Sequence
  Primer
cgttcctctaggaacgatga

SEQ ID NO: 5550 - DNA, 20 bp, Artificial Sequence
  Primer
tcttcaccttgaacctcctc

SEQ ID NO: 5551 - DNA, 20 bp, Artificial Sequence
  Primer
gcagaagaagctgaactcca

SEQ ID NO: 5552 - DNA, 20 bp, Artificial Sequence
  Primer
cgatgagacgatatctctcc

SEQ ID NO: 5553 - DNA, 20 bp, Artificial Sequence
  Primer
ctcctcctcgtaacacaact

SEQ ID NO: 5554 - DNA, 20 bp, Artificial Sequence
  Primer
cggcttcaacagaggaatct

SEQ ID NO: 5555 - DNA, 20 bp, Artificial Sequence
  Primer
gagtagagggatctagccat

SEQ ID NO: 5556 - DNA, 20 bp, Artificial Sequence
  Primer
ccgagttctcttgctgaatg

SEQ ID NO: 5557 - DNA, 20 bp, Artificial Sequence
  Primer
cggagagagcactattaagg

SEQ ID NO: 5558 - DNA, 20 bp, Artificial Sequence
  Primer
ccccctcctaaataagcgta

SEQ ID NO: 5559 - DNA, 20 bp, Artificial Sequence
  Primer
tagctactaccccgtagaac

SEQ ID NO: 5560 - DNA, 20 bp, Artificial Sequence
  Primer
tgggatacgaaccacacgat

SEQ ID NO: 5561 - DNA, 20 bp, Artificial Sequence
  Primer
ccgtctctataggttggtta

SEQ ID NO: 5562 - DNA, 20 bp, Artificial Sequence
  Primer
cgcaataagagtcgatgcgt

SEQ ID NO: 5563 - DNA, 20 bp, Artificial Sequence
  Primer
ccgcgaaagcaacaccaagc

SEQ ID NO: 5564 - DNA, 20 bp, Artificial Sequence
  Primer
gaagtagggagccttttagc

SEQ ID NO: 5565 - DNA, 20 bp, Artificial Sequence
  Primer
ggctttgaatggcattctcc

SEQ ID NO: 5566 - DNA, 20 bp, Artificial Sequence
  Primer
ggacaaaaggctcacaaacg

SEQ ID NO: 5567 - DNA, 20 bp, Artificial Sequence
  Primer
gagcggtgacaggatgtggt

SEQ ID NO: 5568 - DNA, 20 bp, Artificial Sequence
  Primer
gcggcagcagaagttaacat

SEQ ID NO: 5569 - DNA, 20 bp, Artificial Sequence
  Primer
taccatctccatcagcatcg

SEQ ID NO: 5570 - DNA, 20 bp, Artificial Sequence
  Primer
cacaatctccccaatacacc

SEQ ID NO: 5571 - DNA, 20 bp, Artificial Sequence
  Primer
atcttccagcaaagttcccc

SEQ ID NO: 5572 - DNA, 20 bp, Artificial Sequence
  Primer
ggcagtgtgagcattaagac

SEQ ID NO: 5573 - DNA, 20 bp, Artificial Sequence
  Primer
ttcactcaaggctctctccc

SEQ ID NO: 5574 - DNA, 20 bp, Artificial Sequence
  Primer
gcctggcaatcctacaagaa

SEQ ID NO: 5575 - DNA, 20 bp, Artificial Sequence
  Primer
gaggaagagcgtgttgctat

SEQ ID NO: 5576 - DNA, 20 bp, Artificial Sequence
  Primer
gacatcaagacggccttaca

SEQ ID NO: 5577 - DNA, 20 bp, Artificial Sequence
  Primer
cggatgctcaaatctctcct

SEQ ID NO: 5578 - DNA, 20 bp, Artificial Sequence
  Primer
gcctcttccagagacattac

SEQ ID NO: 5579 - DNA, 20 bp, Artificial Sequence
  Primer
cgccaaatcatctgtggagc

SEQ ID NO: 5580 - DNA, 20 bp, Artificial Sequence
  Primer
acgaagatgggtctttctcc

SEQ ID NO: 5581 - DNA, 20 bp, Artificial Sequence
  Primer
ccaagcggtggagcaaaagt

SEQ ID NO: 5582 - DNA, 20 bp, Artificial Sequence
  Primer
ggccgaaaaccattctctct

SEQ ID NO: 5583 - DNA, 20 bp, Artificial Sequence
  Primer
tctctatctcagtatctgcc

SEQ ID NO: 5584 - DNA, 20 bp, Artificial Sequence
  Primer
cccctctagcagaatcccct

SEQ ID NO: 5585 - DNA, 20 bp, Artificial Sequence
  Primer
acgcattctttttccactcc

SEQ ID NO: 5586 - DNA, 20 bp, Artificial Sequence
  Primer
cgccacttccgcaaaaaaga

SEQ ID NO: 5587 - DNA, 20 bp, Artificial Sequence
  Primer
ctcctatccccaacaacaga

SEQ ID NO: 5588 - DNA, 20 bp, Artificial Sequence
  Primer
cgctcctgcaccttatgtaa

SEQ ID NO: 5589 - DNA, 20 bp, Artificial Sequence
  Primer
cacggagaatccggatgcgg

SEQ ID NO: 5590 - DNA, 20 bp, Artificial Sequence
  Primer
catcactcccgcctctccct

SEQ ID NO: 5591 - DNA, 20 bp, Artificial Sequence
  Primer
tagatcctgatcgcttgcga

SEQ ID NO: 5592 - DNA, 20 bp, Artificial Sequence
  Primer
gtcgaagcatcggatgaaga

SEQ ID NO: 5593 - DNA, 20 bp, Artificial Sequence
  Primer
cctaaatccccggtcattac

SEQ ID NO: 5594 - DNA, 20 bp, Artificial Sequence
  Primer
ccgctcttctccctttattg

SEQ ID NO: 5595 - DNA, 20 bp, Artificial Sequence
  Primer
gagctcttctcgatataggg

SEQ ID NO: 5596 - DNA, 20 bp, Artificial Sequence
  Primer
ctcccttgcatcgctaaaga

SEQ ID NO: 5597 - DNA, 20 bp, Artificial Sequence
  Primer
aggcgagcgttttaattccc

SEQ ID NO: 5598 - DNA, 20 bp, Artificial Sequence
  Primer
cgcaccttagatagagatgc

SEQ ID NO: 5599 - DNA, 20 bp, Artificial Sequence
  Primer
cttgcgtaatagtccgagga

SEQ ID NO: 5600 - DNA, 20 bp, Artificial Sequence
  Primer
ccaagattaccctggtgatg

SEQ ID NO: 5601 - DNA, 20 bp, Artificial Sequence
  Primer
gcgacttccccatccaatcg

SEQ ID NO: 5602 - DNA, 20 bp, Artificial Sequence
  Primer
tatgcctcgcacagagatca

SEQ ID NO: 5603 - DNA, 20 bp, Artificial Sequence
  Primer
ggtgaatagcaggattccct

SEQ ID NO: 5604 - DNA, 20 bp, Artificial Sequence
  Primer
ggcggtgacagctaaaacac

SEQ ID NO: 5605 - DNA, 20 bp, Artificial Sequence
  Primer
cccacttactgtgtcctgcc

SEQ ID NO: 5606 - DNA, 20 bp, Artificial Sequence
  Primer
ctgagtgtttcccattctgt

SEQ ID NO: 5607 - DNA, 20 bp, Artificial Sequence
  Primer
ggcacataacatgccccttt

SEQ ID NO: 5608 - DNA, 20 bp, Artificial Sequence
  Primer
gcccacttcatatccagtcc

SEQ ID NO: 5609 - DNA, 20 bp, Artificial Sequence
  Primer
gtgcgcacttagacatatcc

SEQ ID NO: 5610 - DNA, 20 bp, Artificial Sequence
  Primer
aacgtagctactccagcaac

SEQ ID NO: 5611 - DNA, 20 bp, Artificial Sequence
  Primer
cttggagatatcgtccagga

SEQ ID NO: 5612 - DNA, 20 bp, Artificial Sequence
  Primer
ggtgtttagtattggcccac

SEQ ID NO: 5613 - DNA, 20 bp, Artificial Sequence
  Primer
tagtagcgaagacgatggca

SEQ ID NO: 5614 - DNA, 20 bp, Artificial Sequence
  Primer
tcagagcaggtcactccctt

SEQ ID NO: 5615 - DNA, 20 bp, Artificial Sequence
  Primer
ttcggccctggaccggaagg

SEQ ID NO: 5616 - DNA, 20 bp, Artificial Sequence
  Primer
cacccaagccttaggaaatg

SEQ ID NO: 5617 - DNA, 20 bp, Artificial Sequence
  Primer
ggctcctcctacagcaatta

SEQ ID NO: 5618 - DNA, 20 bp, Artificial Sequence
  Primer
gagccgataagcactactga

SEQ ID NO: 5619 - DNA, 20 bp, Artificial Sequence
  Primer
ctcatgcactgtctcatgga

SEQ ID NO: 5620 - DNA, 20 bp, Artificial Sequence
  Primer
gcctctacagatacaagcga

SEQ ID NO: 5621 - DNA, 20 bp, Artificial Sequence
  Primer
cgttacccggtaatgctgtt

SEQ ID NO: 5622 - DNA, 20 bp, Artificial Sequence
  Primer
cctcttaagaccgtttctcc

SEQ ID NO: 5623 - DNA, 20 bp, Artificial Sequence
  Primer
cttctcgatacagcagtgga

SEQ ID NO: 5624 - DNA, 20 bp, Artificial Sequence
  Primer
cttccgcgattgccatatcg

SEQ ID NO: 5625 - DNA, 20 bp, Artificial Sequence
  Primer
accccgaaggaacccgtcat

SEQ ID NO: 5626 - DNA, 20 bp, Artificial Sequence
  Primer
ctcaagctcttgcactatgg

SEQ ID NO: 5627 - DNA, 20 bp, Artificial Sequence
  Primer
gcaacacaggtgccatgtat

SEQ ID NO: 5628 - DNA, 20 bp, Artificial Sequence
  Primer
ctttcgaagccttcggcaag

SEQ ID NO: 5629 - DNA, 20 bp, Artificial Sequence
  Primer
gtcgtccactcgattcttct

SEQ ID NO: 5630 - DNA, 20 bp, Artificial Sequence
  Primer
gcgatatgggctcgaaagtg

SEQ ID NO: 5631 - DNA, 20 bp, Artificial Sequence
  Primer
ccaccgtcaggagctgatag

SEQ ID NO: 5632 - DNA, 20 bp, Artificial Sequence
  Primer
ttgctgatcagattgcggtg

SEQ ID NO: 5633 - DNA, 20 bp, Artificial Sequence
  Primer
tccttgctcatcaccgcaaa

SEQ ID NO: 5634 - DNA, 20 bp, Artificial Sequence
  Primer
ctcggtcaacgacatttctg

SEQ ID NO: 5635 - DNA, 20 bp, Artificial Sequence
  Primer
cgaaacttgtcgcgtgaaac

SEQ ID NO: 5636 - DNA, 20 bp, Artificial Sequence
  Primer
caggcgaccctaattcaaga

SEQ ID NO: 5637 - DNA, 20 bp, Artificial Sequence
  Primer
cccaagcaccgagatagaaa

SEQ ID NO: 5638 - DNA, 20 bp, Artificial Sequence
  Primer
ctagcgatatggggatggtt

SEQ ID NO: 5639 - DNA, 20 bp, Artificial Sequence
  Primer
gggctaatcgaattccaacg

SEQ ID NO: 5640 - DNA, 20 bp, Artificial Sequence
  Primer
ccccattttttgacgtccag

SEQ ID NO: 5641 - DNA, 20 bp, Artificial Sequence
  Primer
acatgctcgcctcgagaata

SEQ ID NO: 5642 - DNA, 20 bp, Artificial Sequence
  Primer
acctcccccaacgaataaca

SEQ ID NO: 5643 - DNA, 20 bp, Artificial Sequence
  Primer
ccgcctcataatacgtaacg

SEQ ID NO: 5644 - DNA, 20 bp, Artificial Sequence
  Primer
gcaatcgcaggatgaagatg

SEQ ID NO: 5645 - DNA, 20 bp, Artificial Sequence
  Primer
ctagtttagcgagcgcttac

SEQ ID NO: 5646 - DNA, 20 bp, Artificial Sequence
  Primer
gagagctggggatacagaaa

SEQ ID NO: 5647 - DNA, 20 bp, Artificial Sequence
  Primer
atctctaagtcggacaagcc

SEQ ID NO: 5648 - DNA, 20 bp, Artificial Sequence
  Primer
ctcctactcctgtaagctct

SEQ ID NO: 5649 - DNA, 20 bp, Artificial Sequence
  Primer
gacgccacttgtcccacgga

SEQ ID NO: 5650 - DNA, 20 bp, Artificial Sequence
  Primer
gtttagcgagcgcttactga

SEQ ID NO: 5651 - DNA, 20 bp, Artificial Sequence
  Primer
acgcttctatcaaacgctgc

SEQ ID NO: 5652 - DNA, 20 bp, Artificial Sequence
  Primer
tcccgggttcctgtcctatg

SEQ ID NO: 5653 - DNA, 20 bp, Artificial Sequence
  Primer
cagctcggattcaaagagat

SEQ ID NO: 5654 - DNA, 20 bp, Artificial Sequence
  Primer
gcccgaaccttagatttctc

SEQ ID NO: 5655 - DNA, 20 bp, Artificial Sequence
  Primer
ggattggaaacggagatcac

SEQ ID NO: 5656 - DNA, 20 bp, Artificial Sequence
  Primer
gccacactagtcaccgcgaa

SEQ ID NO: 5657 - DNA, 20 bp, Artificial Sequence
  Primer
tcccaccttaaatgcagtgg

SEQ ID NO: 5658 - DNA, 20 bp, Artificial Sequence
  Primer
tggaagatccagctccttga

SEQ ID NO: 5659 - DNA, 20 bp, Artificial Sequence
  Primer
ctctgtatccgccagattga

SEQ ID NO: 5660 - DNA, 20 bp, Artificial Sequence
  Primer
ctcctccctttccatacatc

SEQ ID NO: 5661 - DNA, 20 bp, Artificial Sequence
  Primer
gatgtccgcaaaaccgtaga

SEQ ID NO: 5662 - DNA, 20 bp, Artificial Sequence
  Primer
gctcacaatagccaagaacg

SEQ ID NO: 5663 - DNA, 20 bp, Artificial Sequence
  Primer
ccgactcaagtttgcgaaac

SEQ ID NO: 5664 - DNA, 20 bp, Artificial Sequence
  Primer
ccttttcagcactctgcatc

SEQ ID NO: 5665 - DNA, 20 bp, Artificial Sequence
  Primer
ctcatggactcgacagcgcc

SEQ ID NO: 5666 - DNA, 20 bp, Artificial Sequence
  Primer
ggcttcgcattctccaaagc

SEQ ID NO: 5667 - DNA, 20 bp, Artificial Sequence
  Primer
cctcgtttccttttccaggt

SEQ ID NO: 5668 - DNA, 20 bp, Artificial Sequence
  Primer
gtagcagcagaggtaatggt

SEQ ID NO: 5669 - DNA, 20 bp, Artificial Sequence
  Primer
gcccttggtcaaaacctttc

SEQ ID NO: 5670 - DNA, 20 bp, Artificial Sequence
  Primer
cgtctttcctgtaggatcta

SEQ ID NO: 5671 - DNA, 20 bp, Artificial Sequence
  Primer
ggagagattagtgcagcaga

SEQ ID NO: 5672 - DNA, 20 bp, Artificial Sequence
  Primer
gcatccagaactgaatcgac

SEQ ID NO: 5673 - DNA, 20 bp, Artificial Sequence
  Primer
gtgtaaaggcctttctcccc

SEQ ID NO: 5674 - DNA, 20 bp, Artificial Sequence
  Primer
gggacaaggatatggtgttc

SEQ ID NO: 5675 - DNA, 20 bp, Artificial Sequence
  Primer
gaatgggctcccttcacaat

SEQ ID NO: 5676 - DNA, 20 bp, Artificial Sequence
  Primer
tatcgttcgtgcctatgcac

SEQ ID NO: 5677 - DNA, 20 bp, Artificial Sequence
  Primer
gtctgtgcattctctaccac

SEQ ID NO: 5678 - DNA, 20 bp, Artificial Sequence
  Primer
aagctagcatcaacagaccc

SEQ ID NO: 5679 - DNA, 20 bp, Artificial Sequence
  Primer
ccgcagaagggacttttgta

SEQ ID NO: 5680 - DNA, 20 bp, Artificial Sequence
  Primer
gaaactgtttcctgctccag

SEQ ID NO: 5681 - DNA, 20 bp, Artificial Sequence
  Primer
ggcacagcaaccatttggat

SEQ ID NO: 5682 - DNA, 20 bp, Artificial Sequence
  Primer
cattgcgactgcaacccatt

SEQ ID NO: 5683 - DNA, 20 bp, Artificial Sequence
  Primer
gcccagcaacatataaccca

SEQ ID NO: 5684 - DNA, 20 bp, Artificial Sequence
  Primer
ccattcttgtacgggaacct

SEQ ID NO: 5685 - DNA, 20 bp, Artificial Sequence
  Primer
gcctcagcaactcttgttga

SEQ ID NO: 5686 - DNA, 20 bp, Artificial Sequence
  Primer
ccgatccgcattttcttcca

SEQ ID NO: 5687 - DNA, 20 bp, Artificial Sequence
  Primer
ctcggacagcattcttacac

SEQ ID NO: 5688 - DNA, 20 bp, Artificial Sequence
  Primer
gcaagtgtgcgaggaattct

SEQ ID NO: 5689 - DNA, 20 bp, Artificial Sequence
  Primer
gcagttgctcgactattcct

SEQ ID NO: 5690 - DNA, 20 bp, Artificial Sequence
  Primer
cctgctacacaagctctatc

SEQ ID NO: 5691 - DNA, 20 bp, Artificial Sequence
  Primer
ctatgaagagctcttctcca

SEQ ID NO: 5692 - DNA, 20 bp, Artificial Sequence
  Primer
tcttggtatgacctgactgc

SEQ ID NO: 5693 - DNA, 20 bp, Artificial Sequence
  Primer
cgatctctctccttttgcac

SEQ ID NO: 5694 - DNA, 20 bp, Artificial Sequence
  Primer
cctcctcaaatttgcgtcag

SEQ ID NO: 5695 - DNA, 20 bp, Artificial Sequence
  Primer
ttcattgccttatccggagc

SEQ ID NO: 5696 - DNA, 20 bp, Artificial Sequence
  Primer
cgatctctctccttttgcac

SEQ ID NO: 5697 - DNA, 20 bp, Artificial Sequence
  Primer
ctaccttcaactcgctctct

SEQ ID NO: 5698 - DNA, 20 bp, Artificial Sequence
  Primer
ccaaatccccagggaaacat

SEQ ID NO: 5699 - DNA, 20 bp, Artificial Sequence
  Primer
ctctgaccgtagcgtagaaa

SEQ ID NO: 5700 - DNA, 20 bp, Artificial Sequence
  Primer
gacttcctggttactcgaac

SEQ ID NO: 5701 - DNA, 20 bp, Artificial Sequence
  Primer
cgcttccctctagaaatctc

SEQ ID NO: 5702 - DNA, 20 bp, Artificial Sequence
  Primer
cggggaaaattgctctcact

SEQ ID NO: 5703 - DNA, 20 bp, Artificial Sequence
  Primer
cctggaattgcttcctttcc

SEQ ID NO: 5704 - DNA, 20 bp, Artificial Sequence
  Primer
ccgatttctcaagcattccc

SEQ ID NO: 5705 - DNA, 20 bp, Artificial Sequence
  Primer
cggagaagctccaaccacat

SEQ ID NO: 5706 - DNA, 20 bp, Artificial Sequence
  Primer
gcagctatgcgattcttgga

SEQ ID NO: 5707 - DNA, 20 bp, Artificial Sequence
  Primer
caacacaagcggcttgtaga

SEQ ID NO: 5708 - DNA, 20 bp, Artificial Sequence
  Primer
acagcaaaaggtgttggcgt

SEQ ID NO: 5709 - DNA, 20 bp, Artificial Sequence
  Primer
cctgacctttcttatgtgcc

SEQ ID NO: 5710 - DNA, 20 bp, Artificial Sequence
  Primer
catggtatccgatgtgttcg

SEQ ID NO: 5711 - DNA, 20 bp, Artificial Sequence
  Primer
ccaacgagaccgatatcagc

SEQ ID NO: 5712 - DNA, 20 bp, Artificial Sequence
  Primer
acgataccatccgctaatgc

SEQ ID NO: 5713 - DNA, 20 bp, Artificial Sequence
  Primer
tggcggctttcggcgcctcc

SEQ ID NO: 5714 - DNA, 20 bp, Artificial Sequence
  Primer
gagcccccattccccccatt

SEQ ID NO: 5715 - DNA, 20 bp, Artificial Sequence
  Primer
cgcgtcctgaattccttttg

SEQ ID NO: 5716 - DNA, 20 bp, Artificial Sequence
  Primer
cctgtcagccctgaaagcaa

SEQ ID NO: 5717 - DNA, 20 bp, Artificial Sequence
  Primer
gaacacgaaactctgtaccg

SEQ ID NO: 5718 - DNA, 20 bp, Artificial Sequence
  Primer
ggtacctattgctgcttatc

SEQ ID NO: 5719 - DNA, 20 bp, Artificial Sequence
  Primer
agatccgccaggttgaactt

SEQ ID NO: 5720 - DNA, 20 bp, Artificial Sequence
  Primer
ccatttgtcaggaggccaaa

SEQ ID NO: 5721 - DNA, 20 bp, Artificial Sequence
  Primer
gctgtacccgggacctttgt

SEQ ID NO: 5722 - DNA, 20 bp, Artificial Sequence
  Primer
cccacggagcttttgcttat

SEQ ID NO: 5723 - DNA, 20 bp, Artificial Sequence
  Primer
gccttagatgctaaaccagc

SEQ ID NO: 5724 - DNA, 20 bp, Artificial Sequence
  Primer
gccggcaaaaagacagtaga

SEQ ID NO: 5725 - DNA, 20 bp, Artificial Sequence
  Primer
gctgatggagctttggtcat

SEQ ID NO: 5726 - DNA, 20 bp, Artificial Sequence
  Primer
ctgaaggaccgactgagcca

SEQ ID NO: 5727 - DNA, 20 bp, Artificial Sequence
  Primer
cggaggagctatttatggag

SEQ ID NO: 5728 - DNA, 20 bp, Artificial Sequence
  Primer
ctggactctctacggaaact

SEQ ID NO: 5729 - DNA, 20 bp, Artificial Sequence
  Primer
gatccaggaaccactcaatc

SEQ ID NO: 5730 - DNA, 20 bp, Artificial Sequence
  Primer
ctagccccgacgatgtttta

SEQ ID NO: 5731 - DNA, 20 bp, Artificial Sequence
  Primer
cggaacttcagttgccatcg

SEQ ID NO: 5732 - DNA, 20 bp, Artificial Sequence
  Primer
ggtggtgcttacgtaaaagg

SEQ ID NO: 5733 - DNA, 20 bp, Artificial Sequence
  Primer
cccaacaggagaatatgtcc

SEQ ID NO: 5734 - DNA, 20 bp, Artificial Sequence
  Primer
cattctctcaatgtagcggg

SEQ ID NO: 5735 - DNA, 20 bp, Artificial Sequence
  Primer
ggttctagtagttctagcgg

SEQ ID NO: 5736 - DNA, 20 bp, Artificial Sequence
  Primer
catctactcccgagtctgac

SEQ ID NO: 5737 - DNA, 20 bp, Artificial Sequence
  Primer
ggcaaggaataccttgccta

SEQ ID NO: 5738 - DNA, 20 bp, Artificial Sequence
  Primer
ggaggctatgttggcttcta

SEQ ID NO: 5739 - DNA, 20 bp, Artificial Sequence
  Primer
cggtggagccatcacctctt

SEQ ID NO: 5740 - DNA, 20 bp, Artificial Sequence
  Primer
ctagggaaacctagcagact

SEQ ID NO: 5741 - DNA, 20 bp, Artificial Sequence
  Primer
ggagccaatccttcattctc

SEQ ID NO: 5742 - DNA, 20 bp, Artificial Sequence
  Primer
caccgactcccattttccta

SEQ ID NO: 5743 - DNA, 20 bp, Artificial Sequence
  Primer
tggttcttcacacacgagga

SEQ ID NO: 5744 - DNA, 20 bp, Artificial Sequence
  Primer
gcacatagagatagtgagcg

SEQ ID NO: 5745 - DNA, 20 bp, Artificial Sequence
  Primer
aaggctctggctcttcctca

SEQ ID NO: 5746 - DNA, 20 bp, Artificial Sequence
  Primer
gcttccgtatctttgctcct

SEQ ID NO: 5747 - DNA, 20 bp, Artificial Sequence
  Primer
aaacgctcatcttcccctac

SEQ ID NO: 5748 - DNA, 20 bp, Artificial Sequence
  Primer
gtccgtcgtcatgataaaaa

SEQ ID NO: 5749 - DNA, 20 bp, Artificial Sequence
  Primer
gcaaacttcccagagaggaa

SEQ ID NO: 5750 - DNA, 20 bp, Artificial Sequence
  Primer
cctcaagtcctccactatct

SEQ ID NO: 5751 - DNA, 20 bp, Artificial Sequence
  Primer
gccggaatgatgctagagaa

SEQ ID NO: 5752 - DNA, 20 bp, Artificial Sequence
  Primer
acccaggagaaggaactcaa

SEQ ID NO: 5753 - DNA, 20 bp, Artificial Sequence
  Primer
gaggtgttagatcccgaaca

SEQ ID NO: 5754 - DNA, 20 bp, Artificial Sequence
  Primer
cgggaaaaacttatcgcagc

SEQ ID NO: 5755 - DNA, 20 bp, Artificial Sequence
  Primer
cgtattcgcatcgttaagcc

SEQ ID NO: 5756 - DNA, 20 bp, Artificial Sequence
  Primer
cagcctaaactcctagattg

SEQ ID NO: 5757 - DNA, 20 bp, Artificial Sequence
  Primer
caggatgaggctctacatca

SEQ ID NO: 5758 - DNA, 20 bp, Artificial Sequence
  Primer
cactcccctctcttacaaac

SEQ ID NO: 5759 - DNA, 20 bp, Artificial Sequence
  Primer
gaacagcaacctcgccatta

SEQ ID NO: 5760 - DNA, 20 bp, Artificial Sequence
  Primer
cgtagccaatactatcggag

SEQ ID NO: 5761 - DNA, 20 bp, Artificial Sequence
  Primer
ctctaccgaccaactgaact

SEQ ID NO: 5762 - DNA, 20 bp, Artificial Sequence
  Primer
tcagagcagaacctctgatg

SEQ ID NO: 5763 - DNA, 20 bp, Artificial Sequence
  Primer
ccagattccaagcccaaagc

SEQ ID NO: 5764 - DNA, 20 bp, Artificial Sequence
  Primer
gcttatgtcgtccaccttct

SEQ ID NO: 5765 - DNA, 20 bp, Artificial Sequence
  Primer
ccgaaccacgaatttgctga

SEQ ID NO: 5766 - DNA, 20 bp, Artificial Sequence
  Primer
ccctgcgtcttcttcacata

SEQ ID NO: 5767 - DNA, 20 bp, Artificial Sequence
  Primer
cgcccagacaaagaagcatt

SEQ ID NO: 5768 - DNA, 20 bp, Artificial Sequence
  Primer
gccttatctccagcagcaaa

SEQ ID NO: 5769 - DNA, 20 bp, Artificial Sequence
  Primer
gcaagcttcccgatttgaag

SEQ ID NO: 5770 - DNA, 20 bp, Artificial Sequence
  Primer
cgctgaatcatcttcttcgc

SEQ ID NO: 5771 - DNA, 20 bp, Artificial Sequence
  Primer
ctgtaacagcagcaccatca

SEQ ID NO: 5772 - DNA, 20 bp, Artificial Sequence
  Primer
tggggacgagtcttttgcct

SEQ ID NO: 5773 - DNA, 20 bp, Artificial Sequence
  Primer
ctatcttcatccctaaggac

SEQ ID NO: 5774 - DNA, 20 bp, Artificial Sequence
  Primer
gcgcctctatctcagtaaag

SEQ ID NO: 5775 - DNA, 20 bp, Artificial Sequence
  Primer
caacaatcccaatcgaagca

SEQ ID NO: 5776 - DNA, 20 bp, Artificial Sequence
  Primer
cagaggtgtggtcgcaaaca

SEQ ID NO: 5777 - DNA, 20 bp, Artificial Sequence
  Primer
cagttgcataatctcagcac

SEQ ID NO: 5778 - DNA, 20 bp, Artificial Sequence
  Primer
gctgtgctctcctttttctc

SEQ ID NO: 5779 - DNA, 20 bp, Artificial Sequence
  Primer
ctatttctcaagccgcctct

SEQ ID NO: 5780 - DNA, 20 bp, Artificial Sequence
  Primer
agctctttggcagagaagag

SEQ ID NO: 5781 - DNA, 20 bp, Artificial Sequence
  Primer
gtggggagaggaatgttcaa

SEQ ID NO: 5782 - DNA, 20 bp, Artificial Sequence
  Primer
gggacgttcgaaggtattct

SEQ ID NO: 5783 - DNA, 20 bp, Artificial Sequence
  Primer
ctcttcttgagagattctcc

SEQ ID NO: 5784 - DNA, 20 bp, Artificial Sequence
  Primer
gctgacacgctttcacgaaa

SEQ ID NO: 5785 - DNA, 20 bp, Artificial Sequence
  Primer
caccgctctccatcacaaat

SEQ ID NO: 5786 - DNA, 20 bp, Artificial Sequence
  Primer
ccggaataacgacagcatct

SEQ ID NO: 5787 - DNA, 20 bp, Artificial Sequence
  Primer
gggcttcaaaaagcgttctc

SEQ ID NO: 5788 - DNA, 20 bp, Artificial Sequence
  Primer
ctcctgaacatccttcacca

SEQ ID NO: 5789 - DNA, 20 bp, Artificial Sequence
  Primer
cgtaggcatgagcttgcttt

SEQ ID NO: 5790 - DNA, 20 bp, Artificial Sequence
  Primer
gcctcttttcacggcatctt

SEQ ID NO: 5791 - DNA, 20 bp, Artificial Sequence
  Primer
agatgtggacgctagcaata

SEQ ID NO: 5792 - DNA, 20 bp, Artificial Sequence
  Primer
gttcgtgtgcgagtgtttga

SEQ ID NO: 5793 - DNA, 20 bp, Artificial Sequence
  Primer
tggcatgacttcaagtctcg

SEQ ID NO: 5794 - DNA, 20 bp, Artificial Sequence
  Primer
cgcgcttaccaaggaaacaa

SEQ ID NO: 5795 - DNA, 20 bp, Artificial Sequence
  Primer
gcaaaggaagacaacccgtt

SEQ ID NO: 5796 - DNA, 20 bp, Artificial Sequence
  Primer
cgtccactcttcaggttgct

SEQ ID NO: 5797 - DNA, 20 bp, Artificial Sequence
  Primer
gggataacaaccccgttcta

SEQ ID NO: 5798 - DNA, 20 bp, Artificial Sequence
  Primer
gattgcgagaaccacttgtt

SEQ ID NO: 5799 - DNA, 20 bp, Artificial Sequence
  Primer
ccgagctaattcttctcgct

SEQ ID NO: 5800 - DNA, 20 bp, Artificial Sequence
  Primer
gcagaccggatctttttcca

SEQ ID NO: 5801 - DNA, 20 bp, Artificial Sequence
  Primer
gcacggagactacaggtaaa

SEQ ID NO: 5802 - DNA, 20 bp, Artificial Sequence
  Primer
cggacaatccatccaaatgg

SEQ ID NO: 5803 - DNA, 20 bp, Artificial Sequence
  Primer
ccgaggaaatacctatctgc

SEQ ID NO: 5804 - DNA, 20 bp, Artificial Sequence
  Primer
ggaaacatcctttcgccaga

SEQ ID NO: 5805 - DNA, 20 bp, Artificial Sequence
  Primer
gggttaggagagagactgtt

SEQ ID NO: 5806 - DNA, 20 bp, Artificial Sequence
  Primer
caggagggagatttagagac

SEQ ID NO: 5807 - DNA, 20 bp, Artificial Sequence
  Primer
cagctgtattccttccatgc

SEQ ID NO: 5808 - DNA, 20 bp, Artificial Sequence
  Primer
cggtctaaagtctcgccaaa

SEQ ID NO: 5809 - DNA, 20 bp, Artificial Sequence
  Primer
ccggatgcactatcagatga

SEQ ID NO: 5810 - DNA, 20 bp, Artificial Sequence
  Primer
cgctctaaccaactgagcta

SEQ ID NO: 5811 - DNA, 20 bp, Artificial Sequence
  Primer
gctccggtgttttctttagc

SEQ ID NO: 5812 - DNA, 20 bp, Artificial Sequence
  Primer
ggcagaaccaaaagtacaca

SEQ ID NO: 5813 - DNA, 20 bp, Artificial Sequence
  Primer
catgctccctcacccattac

SEQ ID NO: 5814 - DNA, 20 bp, Artificial Sequence
  Primer
ggtcgcccaaattccatgtt

SEQ ID NO: 5815 - DNA, 20 bp, Artificial Sequence
  Primer
ccttatcccgatatcgttcg

SEQ ID NO: 5816 - DNA, 20 bp, Artificial Sequence
  Primer
ctcctatcttccggaaaagc

SEQ ID NO: 5817 - DNA, 20 bp, Artificial Sequence
  Primer
ccgcgtttcgcgttttaaca

SEQ ID NO: 5818 - DNA, 20 bp, Artificial Sequence
  Primer
catgtgacggtattcttggc

SEQ ID NO: 5819 - DNA, 20 bp, Artificial Sequence
  Primer
ccagcaacaagatgtctgta

SEQ ID NO: 5820 - DNA, 20 bp, Artificial Sequence
  Primer
gtttccgcttctatacaggc

SEQ ID NO: 5821 - DNA, 20 bp, Artificial Sequence
  Primer
gggagagaaggtcgtaacta

SEQ ID NO: 5822 - DNA, 20 bp, Artificial Sequence
  Primer
actctcgtcaagggaagcaa

SEQ ID NO: 5823 - DNA, 20 bp, Artificial Sequence
  Primer
gggacgttacggtaaagagt

SEQ ID NO: 5824 - DNA, 20 bp, Artificial Sequence
  Primer
cgttgcgctttctcaaagca

SEQ ID NO: 5825 - DNA, 20 bp, Artificial Sequence
  Primer
gatctagcggtctgctcaaa

SEQ ID NO: 5826 - DNA, 20 bp, Artificial Sequence
  Primer
gtgcgagagaattctggggg

SEQ ID NO: 5827 - DNA, 20 bp, Artificial Sequence
  Primer
catgcccaagagttagggat

SEQ ID NO: 5828 - DNA, 20 bp, Artificial Sequence
  Primer
cgttaggaaggcgataatac

SEQ ID NO: 5829 - DNA, 20 bp, Artificial Sequence
  Primer
cccttagcctatatagggct

SEQ ID NO: 5830 - DNA, 20 bp, Artificial Sequence
  Primer
cgtacagaagagcataggga

SEQ ID NO: 5831 - DNA, 20 bp, Artificial Sequence
  Primer
gtttaggaagaagagctcgc

SEQ ID NO: 5832 - DNA, 20 bp, Artificial Sequence
  Primer
tgtgcggagctaaacggaat

SEQ ID NO: 5833 - DNA, 20 bp, Artificial Sequence
  Primer
ctttctggcttcttcgttgt

SEQ ID NO: 5834 - DNA, 20 bp, Artificial Sequence
  Primer
gagcgggtttactgcttttc

SEQ ID NO: 5835 - DNA, 20 bp, Artificial Sequence
  Primer
ggaaggaaggcttccatacc

SEQ ID NO: 5836 - DNA, 20 bp, Artificial Sequence
  Primer
ggtacggggttaccttttca

SEQ ID NO: 5837 - DNA, 20 bp, Artificial Sequence
  Primer
cgactatgcaagatcctgtg

SEQ ID NO: 5838 - DNA, 20 bp, Artificial Sequence
  Primer
ctgaggccggattatttcct

SEQ ID NO: 5839 - DNA, 20 bp, Artificial Sequence
  Primer
catgaagagcgccgcaagcg

SEQ ID NO: 5840 - DNA, 20 bp, Artificial Sequence
  Primer
catgaagagcgccgcaagcg

SEQ ID NO: 5841 - DNA, 20 bp, Artificial Sequence
  Primer
cgtaataggagctccgtcaa

SEQ ID NO: 5842 - DNA, 20 bp, Artificial Sequence
  Primer
gtagataacgctaggagctg

SEQ ID NO: 5843 - DNA, 20 bp, Artificial Sequence
  Primer
cctttcttggaagagggaga

SEQ ID NO: 5844 - DNA, 20 bp, Artificial Sequence
  Primer
gctatagaggaaccgtcttc

SEQ ID NO: 5845 - DNA, 20 bp, Artificial Sequence
  Primer
cgcgtattgctcatcagagt

SEQ ID NO: 5846 - DNA, 20 bp, Artificial Sequence
  Primer
caaagcagggggaactaaag

SEQ ID NO: 5847 - DNA, 20 bp, Artificial Sequence
  Primer
ggagaacttgtcgtagttgg

SEQ ID NO: 5848 - DNA, 20 bp, Artificial Sequence
  Primer
gagtagctactccgcttaac

SEQ ID NO: 5849 - DNA, 20 bp, Artificial Sequence
  Primer
catcaggatcttgttgaccg

SEQ ID NO: 5850 - DNA, 20 bp, Artificial Sequence
  Primer
tctcatatatgggcgctggt

SEQ ID NO: 5851 - DNA, 20 bp, Artificial Sequence
  Primer
tctggcccttgctcgattac

SEQ ID NO: 5852 - DNA, 20 bp, Artificial Sequence
  Primer
ccttcccagtcaaaatcctc

SEQ ID NO: 5853 - DNA, 20 bp, Artificial Sequence
  Primer
agactggacctctcgattgg

SEQ ID NO: 5854 - DNA, 20 bp, Artificial Sequence
  Primer
ggggtgaacgggaaaaatga

SEQ ID NO: 5855 - DNA, 20 bp, Artificial Sequence
  Primer
gcgcgcggtttgaatttcta

SEQ ID NO: 5856 - DNA, 20 bp, Artificial Sequence
  Primer
ggaagcgtgtagtgttgctt

SEQ ID NO: 5857 - DNA, 20 bp, Artificial Sequence
  Primer
gcaccatgtgtcgggggaga

SEQ ID NO: 5858 - DNA, 20 bp, Artificial Sequence
  Primer
gccaatgtacactctggtct

SEQ ID NO: 5859 - DNA, 20 bp, Artificial Sequence
  Primer
gcctcaggtgtatagccaat

SEQ ID NO: 5860 - DNA, 20 bp, Artificial Sequence
  Primer
gtgccccatttcaatggtct

SEQ ID NO: 5861 - DNA, 20 bp, Artificial Sequence
  Primer
ctcctaagacaagcacgtgg

SEQ ID NO: 5862 - DNA, 20 bp, Artificial Sequence
  Primer
gaggcatccattgcgcattt

SEQ ID NO: 5863 - DNA, 20 bp, Artificial Sequence
  Primer
ggatgcggctgtttgagttt

SEQ ID NO: 5864 - DNA, 20 bp, Artificial Sequence
  Primer
cttaagggaatagcctatgg

SEQ ID NO: 5865 - DNA, 20 bp, Artificial Sequence
  Primer
cctgggcatatcaaacaagg

SEQ ID NO: 5866 - DNA, 20 bp, Artificial Sequence
  Primer
cggtattccgcttttcatcc

SEQ ID NO: 5867 - DNA, 20 bp, Artificial Sequence
  Primer
ctcgcgatgacctatctcct

SEQ ID NO: 5868 - DNA, 20 bp, Artificial Sequence
  Primer
atccgcagagatggctcctc

SEQ ID NO: 5869 - DNA, 20 bp, Artificial Sequence
  Primer
ggatgtaggctcctagaaag

SEQ ID NO: 5870 - DNA, 20 bp, Artificial Sequence
  Primer
ctgggtaaagggtgtggaaa

SEQ ID NO: 5871 - DNA, 20 bp, Artificial Sequence
  Primer
ctaggacatagcttgttccg

SEQ ID NO: 5872 - DNA, 20 bp, Artificial Sequence
  Primer
aaagaaagcggggcagattc

SEQ ID NO: 5873 - DNA, 20 bp, Artificial Sequence
  Primer
gcggaatctttcttcgagga

SEQ ID NO: 5874 - DNA, 20 bp, Artificial Sequence
  Primer
ggactgcatcatgttgcgtt

SEQ ID NO: 5875 - DNA, 20 bp, Artificial Sequence
  Primer
cctccttgggaagaatttgc

SEQ ID NO: 5876 - DNA, 20 bp, Artificial Sequence
  Primer
gcggctaattttggatcgtc

SEQ ID NO: 5877 - DNA, 20 bp, Artificial Sequence
  Primer
cagcaagagcagtgcgaaaa

SEQ ID NO: 5878 - DNA, 20 bp, Artificial Sequence
  Primer
tacaatcacgacagctaggc

SEQ ID NO: 5879 - DNA, 20 bp, Artificial Sequence
  Primer
ggatgaggagatcgcatctt

SEQ ID NO: 5880 - DNA, 20 bp, Artificial Sequence
  Primer
gtctttgtttccggttttgc

SEQ ID NO: 5881 - DNA, 20 bp, Artificial Sequence
  Primer
gctcttcctctgaagggttt

SEQ ID NO: 5882 - DNA, 20 bp, Artificial Sequence
  Primer
ggaacaggacagcaatcttg

SEQ ID NO: 5883 - DNA, 20 bp, Artificial Sequence
  Primer
ggagatctaaaggacaggag

SEQ ID NO: 5884 - DNA, 20 bp, Artificial Sequence
  Primer
ctggaggcagcaaaacaaca

SEQ ID NO: 5885 - DNA, 20 bp, Artificial Sequence
  Primer
ggagattggtctgaggctaa

SEQ ID NO: 5886 - DNA, 20 bp, Artificial Sequence
  Primer
ccttgtgtttcgttgctcag

SEQ ID NO: 5887 - DNA, 20 bp, Artificial Sequence
  Primer
cgctttctcagcggagattt

SEQ ID NO: 5888 - DNA, 20 bp, Artificial Sequence
  Primer
ggtcgcgctagaggatctga

SEQ ID NO: 5889 - DNA, 20 bp, Artificial Sequence
  Primer
gacaagagagcgataagggt

SEQ ID NO: 5890 - DNA, 20 bp, Artificial Sequence
  Primer
cccgatgcgtaatcctgagg

SEQ ID NO: 5891 - DNA, 20 bp, Artificial Sequence
  Primer
cggactgttcctccagaaaa

SEQ ID NO: 5892 - DNA, 20 bp, Artificial Sequence
  Primer
ctgcaataatcatcgctccg

SEQ ID NO: 5893 - DNA, 20 bp, Artificial Sequence
  Primer
ctcgcgattctctccaagta

SEQ ID NO: 5894 - DNA, 20 bp, Artificial Sequence
  Primer
tcccccttaggtctggttta

SEQ ID NO: 5895 - DNA, 20 bp, Artificial Sequence
  Primer
ggcattatctccacagacga

SEQ ID NO: 5896 - DNA, 20 bp, Artificial Sequence
  Primer
cctgccaaaaaccagcctat

SEQ ID NO: 5897 - DNA, 20 bp, Artificial Sequence
  Primer
cctcagcatctggatgaaga

SEQ ID NO: 5898 - DNA, 20 bp, Artificial Sequence
  Primer
tggggaagggtaatgccttc

SEQ ID NO: 5899 - DNA, 20 bp, Artificial Sequence
  Primer
cgaggatgttgcgagttttg

SEQ ID NO: 5900 - DNA, 20 bp, Artificial Sequence
  Primer
cgccatcgcctttgatattc

SEQ ID NO: 5901 - DNA, 20 bp, Artificial Sequence
  Primer
ggatcaagatactcttcccg

SEQ ID NO: 5902 - DNA, 20 bp, Artificial Sequence
  Primer
actgcttgggagctgcagga

SEQ ID NO: 5903 - DNA, 20 bp, Artificial Sequence
  Primer
gaagagcttgatgcagccat

SEQ ID NO: 5904 - DNA, 20 bp, Artificial Sequence
  Primer
cgagagagagaagctgtcat

SEQ ID NO: 5905 - DNA, 20 bp, Artificial Sequence
  Primer
ggctttctacatggccaaac

SEQ ID NO: 5906 - DNA, 20 bp, Artificial Sequence
  Primer
gaatattctaaggcgcgcga

SEQ ID NO: 5907 - DNA, 20 bp, Artificial Sequence
  Primer
ctgactaggttgggcaagca

SEQ ID NO: 5908 - DNA, 20 bp, Artificial Sequence
  Primer
gctacaggtgtatggttccg

SEQ ID NO: 5909 - DNA, 20 bp, Artificial Sequence
  Primer
cctgccaaaacaacacgaac

SEQ ID NO: 5910 - DNA, 20 bp, Artificial Sequence
  Primer
ctccatcaaccgtttggtaa

SEQ ID NO: 5911 - DNA, 20 bp, Artificial Sequence
  Primer
caggaaagtctccatccttg

SEQ ID NO: 5912 - DNA, 20 bp, Artificial Sequence
  Primer
cgcgaaggatctacagaaag

SEQ ID NO: 5913 - DNA, 20 bp, Artificial Sequence
  Primer
gtacgcgagctgggttcaaa

SEQ ID NO: 5914 - DNA, 20 bp, Artificial Sequence
  Primer
gccttttagggtgactatgg

SEQ ID NO: 5915 - DNA, 20 bp, Artificial Sequence
  Primer
ggtgaggacgagacatatag

SEQ ID NO: 5916 - DNA, 20 bp, Artificial Sequence
  Primer
gtctgtagggggagaagtca

SEQ ID NO: 5917 - DNA, 20 bp, Artificial Sequence
  Primer
ccctagccatttggctagag

SEQ ID NO: 5918 - DNA, 20 bp, Artificial Sequence
  Primer
gggttacagcttctggaact

SEQ ID NO: 5919 - DNA, 20 bp, Artificial Sequence
  Primer
tgtccctaagttttgccgac

SEQ ID NO: 5920 - DNA, 20 bp, Artificial Sequence
  Primer
cggccgtttttgctggttac

SEQ ID NO: 5921 - DNA, 20 bp, Artificial Sequence
  Primer
gctgaggagaggatggttta

SEQ ID NO: 5922 - DNA, 20 bp, Artificial Sequence
  Primer
gagcaaaagccatgttggca

SEQ ID NO: 5923 - DNA, 20 bp, Artificial Sequence
  Primer
cttgggagtcatacaggagt

SEQ ID NO: 5924 - DNA, 20 bp, Artificial Sequence
  Primer
gatcgctgcttgccctaaaa

SEQ ID NO: 5925 - DNA, 20 bp, Artificial Sequence
  Primer
tgaatggagctcaggtaggg

SEQ ID NO: 5926 - DNA, 20 bp, Artificial Sequence
  Primer
gtttcccatccgttatccct

SEQ ID NO: 5927 - DNA, 20 bp, Artificial Sequence
  Primer
gggaacccaaagcgacgaag

SEQ ID NO: 5928 - DNA, 20 bp, Artificial Sequence
  Primer
aaggattcggcggattagca

SEQ ID NO: 5929 - DNA, 20 bp, Artificial Sequence
  Primer
gccggctttcttatgtagac

SEQ ID NO: 5930 - DNA, 20 bp, Artificial Sequence
  Primer
gctctcttggaggagaaggg

SEQ ID NO: 5931 - DNA, 20 bp, Artificial Sequence
  Primer
cctgatagtaaattgcaggg

SEQ ID NO: 5932 - DNA, 20 bp, Artificial Sequence
  Primer
ggacggctgccacagagttg

SEQ ID NO: 5933 - DNA, 20 bp, Artificial Sequence
  Primer
agtcaggaatagggagacct

SEQ ID NO: 5934 - DNA, 20 bp, Artificial Sequence
  Primer
ggttgatggagaagacggtt

SEQ ID NO: 5935 - DNA, 20 bp, Artificial Sequence
  Primer
tctgagaggaggattttgtc

SEQ ID NO: 5936 - DNA, 20 bp, Artificial Sequence
  Primer
cccaattgctccaccaactt

SEQ ID NO: 5937 - DNA, 20 bp, Artificial Sequence
  Primer
agtttcgctgcggcaaactt

SEQ ID NO: 5938 - DNA, 20 bp, Artificial Sequence
  Primer
ggcttcccatcaacgtaatc

SEQ ID NO: 5939 - DNA, 20 bp, Artificial Sequence
  Primer
gtcgcaatcaacaccatcca

SEQ ID NO: 5940 - DNA, 20 bp, Artificial Sequence
  Primer
cctaaagcgcctttcatacg

SEQ ID NO: 5941 - DNA, 20 bp, Artificial Sequence
  Primer
gttttatcggtagggctctc

SEQ ID NO: 5942 - DNA, 20 bp, Artificial Sequence
  Primer
aggttttggggttggggaat

SEQ ID NO: 5943 - DNA, 20 bp, Artificial Sequence
  Primer
gtctttcttttgctagcggc

SEQ ID NO: 5944 - DNA, 20 bp, Artificial Sequence
  Primer
gcactgaaagcctttatggg

SEQ ID NO: 5945 - DNA, 20 bp, Artificial Sequence
  Primer
agcttcgccagtacttgttc

SEQ ID NO: 5946 - DNA, 20 bp, Artificial Sequence
  Primer
tccgaagattgggaagctgt

SEQ ID NO: 5947 - DNA, 20 bp, Artificial Sequence
  Primer
ttctcccagttgaaatccgc

SEQ ID NO: 5948 - DNA, 20 bp, Artificial Sequence
  Primer
cacccctactggagagaatc

SEQ ID NO: 5949 - DNA, 20 bp, Artificial Sequence
  Primer
cacaggatggatccgtattc

SEQ ID NO: 5950 - DNA, 20 bp, Artificial Sequence
  Primer
cagctggaacggctagcggc

SEQ ID NO: 5951 - DNA, 20 bp, Artificial Sequence
  Primer
ctcgtaacgaaacatgggca

SEQ ID NO: 5952 - DNA, 20 bp, Artificial Sequence
  Primer
ccgacgcgtaaaaaagtctc

SEQ ID NO: 5953 - DNA, 20 bp, Artificial Sequence
  Primer
cattctcaggaaaggtgcct

SEQ ID NO: 5954 - DNA, 20 bp, Artificial Sequence
  Primer
cctctggcttaccagaagaa

SEQ ID NO: 5955 - DNA, 20 bp, Artificial Sequence
  Primer
gctcatcaatagcccaccaa

SEQ ID NO: 5956 - DNA, 20 bp, Artificial Sequence
  Primer
ccgagggaaatgctgctaaa

SEQ ID NO: 5957 - DNA, 20 bp, Artificial Sequence
  Primer
ggatccgtagtcttaatggg

SEQ ID NO: 5958 - DNA, 20 bp, Artificial Sequence
  Primer
ggcacttttagacaatggcg

SEQ ID NO: 5959 - DNA, 20 bp, Artificial Sequence
  Primer
ccatcttacgggagaagaac

SEQ ID NO: 5960 - DNA, 20 bp, Artificial Sequence
  Primer
ctctcctccgcataagacaa

SEQ ID NO: 5961 - DNA, 20 bp, Artificial Sequence
  Primer
gaggatagtgcgtcataacc

SEQ ID NO: 5962 - DNA, 20 bp, Artificial Sequence
  Primer
ggcctttttaagaaggatct

SEQ ID NO: 5963 - DNA, 20 bp, Artificial Sequence
  Primer
gcggcagcagaagttaacat

SEQ ID NO: 5964 - DNA, 20 bp, Artificial Sequence
  Primer
ctgggaacatccagaaactc

SEQ ID NO: 5965 - DNA, 20 bp, Artificial Sequence
  Primer
cgctcctgcaccttatgtaa

SEQ ID NO: 5966 - DNA, 20 bp, Artificial Sequence
  Primer
ccttctatgctcgctctctt

SEQ ID NO: 5967 - DNA, 20 bp, Artificial Sequence
  Primer
cctatctcaagaactctccc

SEQ ID NO: 5968 - DNA, 20 bp, Artificial Sequence
  Primer
ccggtcggactataggcaat

SEQ ID NO: 5969 - DNA, 20 bp, Artificial Sequence
  Primer
ctcccttgcatcgctaaaga

SEQ ID NO: 5970 - DNA, 20 bp, Artificial Sequence
  Primer
gggatattgctgtcctatgc

SEQ ID NO: 5971 - DNA, 20 bp, Artificial Sequence
  Primer
ctctccaagtcctctaccta

SEQ ID NO: 5972 - DNA, 20 bp, Artificial Sequence
  Primer
ccagggaataaggactgtgt

SEQ ID NO: 5973 - DNA, 20 bp, Artificial Sequence
  Primer
cctaatccacatctagtcag

SEQ ID NO: 5974 - DNA, 20 bp, Artificial Sequence
  Primer
gaaactagccctcatagaca

SEQ ID NO: 5975 - DNA, 20 bp, Artificial Sequence
  Primer
gaacctctgttggtgacaca

SEQ ID NO: 5976 - DNA, 20 bp, Artificial Sequence
  Primer
ccctcttttctgaggagact

SEQ ID NO: 5977 - DNA, 20 bp, Artificial Sequence
  Primer
ggcagaacccttcttcaaag

SEQ ID NO: 5978 - DNA, 20 bp, Artificial Sequence
  Primer
ctacccactctctcttatcc

SEQ ID NO: 5979 - DNA, 20 bp, Artificial Sequence
  Primer
agatcccgtagatgctgcta

SEQ ID NO: 5980 - DNA, 20 bp, Artificial Sequence
  Primer
ggaacgattctgttctcctc

SEQ ID NO: 5981 - DNA, 20 bp, Artificial Sequence
  Primer
gaggggctatttacgggaaa

SEQ ID NO: 5982 - DNA, 34 bp, Chlamydia trachomatis
atctggatgatgatagatgagattattacgacag

---

What is claimed is:

1. An isolated polynucleotide sequence obtained from *Chlamydia trachomatis* comprising a polynucleotide sequence encoding a polypeptide selected from the group consisting of SEQ ID NO. 1083, SEQ ID NO. 1089, SEQ ID NO. 1091, SEQ ID NO. 1095, SEQ ID NO. 1096, SEQ ID NO. 1105, SEQ ID NO. 1117, SEQ ID NO. 1159, and SEQ ID NO. 1167.

2. A polynucleotide encoding a fusion protein, comprising a polynucleotide according claim 1 ligated in frame to a polynucleotide encoding a heterologous polypeptide.

3. A recombinant vector that contains the polynucleotide of claim 1.

4. A recombinant vector that contains the polynucleotide of claim 2.

5. A recombinant vector that contains the polynucleotide of claim 1, operatively associated with a regulatory sequence that controls gene expression.

6. A recombinant vector that contains the polynucleotide of claim 2 operatively associated with a regulatory sequence that controls gene expression.

7. A genetically engineered host cell that contains the polynucleotide of claim 1 or 3, or a recombinant vector according to claim 4 or 6.

8. A genetically engineered host cell that comprises the polynucleotide of claim 2, or a recombinant vector according to claim 4 or 6.

9. A genetically engineered host cell that contains the polynucleotide of claim 1 or operatively associated with a regulatory sequence that controls gene expression in the host cell.

10. A genetically engineered host cell that contains the polynucleotide of claim 2 operatively associated with a regulatory sequence that controls gene expression in the host cell.

11. A DNA chip containing an array of polynucleotides comprising at least one of the polynucleotides of claim 1.

12. A kit comprising a container containing an isolated polynucleotide of claim 1.

13. The kit of claim 12 wherein the polynucleotide is a primer or a probe.

14. An isolated polynucleotide comprising a polynucleotide that encodes a polypeptide sequence selected from the group consisting of SEQ ID NO. 1083, SEQ ID NO. 1089, SEQ ID NO. 1091, SEQ ID NO. 1095, SEQ ID NO. 1096, SEQ ID NO. 1105, SEQ ID NO. 1117, SEQ ID NO. 1159, or SEQ ID NO. 1167 wherein the polynucleotide that encodes the polypeptide sequence has the polynucleotide sequence of the genomic DNA obtainable from ECACC Deposit No. 981 12618.

15. An isolated polynucleotide sequence comprising, a polynucleotide sequence that encodes a polypeptide sequence selected from the group consisting of SEQ ID NO. 1083, SEQ ID NO. 1089, SEQ ID NO. 1091, SEQ ID NO. 1095, SEQ ID NO. 1096, SEQ ID NO, 1105, SEQ ID NO. 1117, SEQ ID NO. 1159, or SEQ ID NO. 1167, wherein the polynucleotide that encodes the polypeptide sequence has the polynucleotide sequence of the clone DNA obtainable from ECACC Deposit No. 98112617.

16. An isolated polynucleotide sequence comprising:

a) nucleotides 78482 to 78736 of SEQ ID NO: 1 (ORF 1083);

b) (the polynucleotide sequence complementary to the full length of nucleotides 112069 through 111734 of SEQ ID NO: 1 (ORF 1089);

c) nucleotides 144164 to 144427 of SEQ ID NO: 1 (ORF 1095);

d) the polynucleotide sequence complementary to the full length of nucleotides 150698 through 150369 of SEQ ID NO: 1 (ORF 1096);

e) the polynucleotide sequence complementary to the full length of nucleotides 197313 through 197083 of SEQ ID NO: 1 (ORF 1105);

f) nucleotides 303155 to 303469 of SEQ ID NO: 1 (ORF 1117);

g) nucleotides 610110 to 610391 of SEQ ID NO: 1 (ORF 1159); or h) the polynucleotide sequence complementary to the full length of nucleotides 679528 through 679253 of SEQ ID NO: 1 (ORF 1167).

17. A recombinant vector comprising a polynucleotide according to claim 16.

18. A genetically engineered host cell comprising a recombinant vector according to claim 17.

19. A DNA chip comprising a polynucleotide according to claim 16.

20. A polynucleotide encoding a fusion protein comprising a polynucleotide according to claim 16 ligated in frame to a polynucleotide encoding a heterologous polypeptide.

21. A recombinant polynucleotide comprising a polynucleotide according to claim 16 operatively associated with a regulatory sequence that controls gene expression.

22. A recombinant polynucleotide comprising a polynucleotide according to claim 20 operatively associated with a regulatory sequence that controls gene expression.

* * * * *

UNITED STATES PATENT AND TRADEMARK OFFICE

CERTIFICATE OF CORRECTION

PATENT NO. : 7,041,490 B1
APPLICATION NO. : 09/201228
DATED : May 9, 2006
INVENTOR(S) : Rémy Griffais et al.

It is certified that error appears in the above-identified patent and that said Letters Patent is hereby corrected as shown below:

Column 27,
Line 25, "ORF451;" should read -- ORF511; --.

Column 43,
Lines 14-15, "primers;
however," should read -- primers; however, --.

Column 55,
Line 19, "F(ab')$_2$ fragments," should read -- F(ab')$_2$ fragments, --.
Line 65, "(1975, Nature 256:495497)," should read -- (1975, Nature 256:495-497), --.

Column 56,
Lines 18-19, "PROC.
NATL. ACAD. SCI." should read -- PROC. NATL. ACAD. SCI. --.
Lines 20-21, "1985, Nature 314:452454)" should read -- 1985, Nature 314:452-454) --.

Column 69,
Line 34, "less than 11 ml." should read -- less than 1 ml. --.
Line 54, "of 101 g" should read -- of 10 µg --.

Column 74,
Line 11, "(1% column)" should read -- (I% column) --.

Column 78,
Line 17, "less than $e^-$ ." should read --less than $e^{-10}$. --.

Column 118,
Lines 18-19, Table 1, ORF1020

| "ID | Species | Score | I % |
|---|---|---|---|
| D64006 *Syn-echocystis sp.*" | 347 | 44 | |

should read

| -- ID | Species | Score | I % |
|---|---|---|---|
| D64006 | *Synechocystis sp.* | 347 | 44 --. |

UNITED STATES PATENT AND TRADEMARK OFFICE

CERTIFICATE OF CORRECTION

PATENT NO. : 7,041,490 B1
APPLICATION NO. : 09/201228
DATED : May 9, 2006
INVENTOR(S) : Rémy Griffais et al.

It is certified that error appears in the above-identified patent and that said Letters Patent is hereby corrected as shown below:

<u>Column 218,</u>
Line 27, "Ann., Intem Med" should read -- Ann. Intern Med. --.

<u>Column 221,</u>
Line 23, "claim 1 or 3, or" should read -- claim 1, or --.

Signed and Sealed this

Nineteenth Day of December, 2006

JON W. DUDAS
*Director of the United States Patent and Trademark Office*